United States Patent 7,365,185 (GENOMIC PLANT SEQUENCES AND USES THEREOF) - sequence listing, part 41

SEQ ID NO: 63549 - DNA, 692 bp, Oryza sativa
agtagttggtgtttgtttgcttcttctagagatgagtgagtcagtgagagcagatgccgttggacagttattgtctaaggagtatggtgtccggtcttttttcacataatactataatttcagattatataattttcacaaatatcaatttctactttttaaggagtacatgccaagttgccaatttgattttagtgtttgggtattagcggaacagcttattaacgattaaataattagttatattttcttagtgatacaaaagcaaatacttaaaaataaacatgagaaaaaacctaaaattaactctaagtttaaatttaattttaaagtttagcttatgttggtaatgtaaaggctaaacggtggggctgaacagggttttagaagtaaagaattaaaggttttctttccccgaaaaagataaaggggttttaaaattcggttcttgattgagtttagatttcttggaatataaaagatatatgcaggacaatgtgaagaggactttgacgtttgaaacctcgcacggacgacttgtggagctcaaatgcgacggcgacaagcggcaaagaaaaaaaaaacacaccagcttggaaagttggtttggtaagcaggacaatgacaccccagtaaattacaaatggagagaaaaaaattacagtttaggccgagtttagttccaaattttt

SEQ ID NO: 63550 - DNA, 540 bp, Oryza sativa
gcccagacaatggaagatttctgagcaagtggtttcagaagaggtaacagagtaaatctgggtaggttcatgtactatgcaatttcttaaaaattaagctaacatcgcaacacatgatgttgcatacctttcaaaaggacaagagaatgacgcatcccaagtgcaagcctcacaacatgctttgtggtaaagtatgccacttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaacttta

SEQ ID NO: 63551 - DNA, 684 bp, Oryza sativa
cgatgtgaatacactacccatggtacagagcacattattttcaccgcgctaactctctactcatgccaacggaaatcaaatacagcctctacagttcatgaaacaacgtttttatcctcataaaaaaaactgattaatggggacaaattaatgctataatctgaaaatctccacaacgcataaattaaactctatcctgtttaggagtccatctgacaacaaaaccgccacctaaatttcaaatcgtaaaacacaccttttaaattttggttttccatatatgctcaaaaatacatcaaaccttggggatgctctactagctaaagtaagtaatcatgaatctcggctcttaattcgctatagctagcacacacatagctagagagatcacgaacataatcacatgccaacaaacccaagtgaaaaagatctcacgaacataaaaactggattgccaacccagagatcgagagaattaatttgccccccggaatataatcgacacgggattttgtttccttactatagccgcatgcatatctcgacagtatccatggcggcgcccccccctgccgaatttgggatcccgttcgttcgttcgcaggagacaacaagaagttaatgacggaaatgcaagctcaccacacgcgtatctgatcattcatgtttgccgatcaatgccga

SEQ ID NO: 63552 - DNA, 5772 bp, Oryza sativa
actattcatacgttgaatttgtcttttttatatctcgacgtgtgagcggagtttggacttaagattttgtgaagttgtatatatgtgttgtatgaatgttgtcaaatttttctagaatttttcataaccgtttagatggtttttgagcaaacgagggaacatcccctcaagggattagaatagtttcccttctatatgtgtcaaactctgttttgacaggtttcgagcaaatgtgatttgcctgaaaacacagacaacttcttgtcctactatagtactcctactaacttttttttcttactactactgtatactactataacaaggaagaaagcctgcactaatgggcgggcatttatttatttttaatgataaagagaacactaaaagaattatctcaacatatacatcttagaaattcaccgtaagagatggtaaattatcttataatgataactaaaatggaagaaaaaaatacttataccgtgaaatagatcatagactttgatatactaaattataagaatgtctctcaaattttaaacaaaaatcacttagtcctgcttagatataaactcacctatcaccactatagattattattgtcttgaaagttgggtcccttgataaatggaattgtattagtaccataaaaagagcctaacacatcagtaatacagtaaaataatcacgaacactttacacataattctctgtcttatgtccaaatctatgtatagatatcttaaaccattcctaccaattaacagggtagtacaattaaaattaaatatgaatgtctccctaacatgtgaagccggctaatactacgtactgagaaccatgtgaaaaaaatattagctcgagtaacaatctctcactaacacaggggttagtgggttccgatttttctttcttgtattacatctgaacttttgttttattattttttcccgtgcaatattacatccctaggtggcatgcatttttttttcagcgaatagctttttagtcggacagatcataagcatacgaacataacaacatttaatctgagaattgagaggggagaattgattttttttttcctggtcttacatacgtaggtattatgtatgtctttttgggagaatggtgtgtcctacgtatgtatgcatttttttggcatttatctagcgaatagtttgcacgtatttttcttgtcgtcgtacatacacgtatggacttcgatctgctaatgacattgacaacgggcacaacactacaatttaattttgtacggtgattatggatggatgcttctcaattggtgtacaaattaatgtatggattgtgcgtcgtgctaaattgttacttatatgtatcagatattcagaaggtagctaggcttgttcatcttgccgagaccaactcgtacaaaacttctcgtgcataaaaaatgttcaaaaagagaagttcacacacacataattgtgtcatacctgcacgtgcagtagattagaagggagggtttttttttcggttgtatacaccctattacgtacacggaagaagattaggagtggtggatttttaaaagatctaatctaatggtctaaaataacataacaggtccaccgatttaaataaaaatagagggtttagatgtttcttgccacgtgacggtctaagagtgtttatagagtgtcatatggcggcttagtagcgtttataggatgtttcatggacttttagtatacaataactaggaaggtagcccacggattcacgcgggcatgtatcttaagatgtgtttgagatacttatatagttataaggatggaatattaacagtagaacaccgtcacgcttcgaaaacaatttctatgtgcattttttttgtcatcattgcctgtaattttttttgtcatcattgcttgtaatttgattaatccccataagaagaaggaaaacttagtttgttttaaaaaatatatctaacaaattaaatgtaaattaaaaatcctaaaaatggaattattagatcccaaattgataaattgttgtttaaatggaattattagaaataattttaaaagcctagaagaaaagatctaattttaagtaataaattccaatataaaagagggctagataaaattttattaaatacttctcttgattctatagttcctagatttttctgggatttatttgagccaagaaagtatttttaataaatggaattgcatttcatgaataatttaaaaggaaaaaggtttaaaaatcctttttttggttttgggcgaaagtcagcccaagtctctctctctctcccccggcctgtgcacgcccggctcaagccggcccagtccgcccctctttccctcctctcccgctgacaggtggggcccacctgtcacggtcgtcttccacctcccgccgccagccacccctagccgcgcgcaagccgccgccgccccttccaaattcggtcgcatctttcccgatccgatcaaattgatagaggggaaatgatcccttcgatctcctctatcttttcccctatagaaactttagctaatttcgtttggaaatcatcggattcgagttcgattcggatttgatttcttccctgcaaccctaaaccttgcatcgccgccgttagtcgccgtgggcctagccgccgcctcctagcccctacaaaaggatccccaggacgtcctctattcgccgccaccttcgccctagcccgccgtcgcttgtagcaccgcctccgcgtcagcccgtgcgccgccgtcgccgccgcaactccagccgtgcgccaccgccgctctggtcgtcgtcgtcgctcgggatggtcgcagtcgggttcgccaagttgttgccgtcctcgtcccgtcctccgtttccgccgaagatcgccggagcaccgctgtcgccgtcgacccgaacgtctccgccgcctcgacctcgccgacgtcactgtcggttgtcgtccatcgtcgtcagagccctcggtgagttcgccgcgtcgccctctacccgtaggtgctgtccgtttgcaccgccgcgccgtcattcgccggcgagcacgaggtgccgagccgccatcggcaatgacgtcatcgtcgacgtcagcgccacatcagccgtagacccgtggtagatcggttagatctcggcctttcgttttgtttagattagatctcagccgttcgttccgagactgcttctgtgcactcggtccaccgtgaacccgagccccgctgacgcaataaatcctttttccttttcaaaaataattctttattgcgtcataatccaatgaaaatctatataaatgatttaatccgatttaatctttaaaaattaataactaattcatcttagctcagatttagctggttcaagtctctcaatttctctaaaattgagatctacatgttaaaaatatccacatgtgctgtttatgattgtttatgtactgttttggtgatttttctcttttatgcttagattccgacgtttccagagagtccgattttgcaggagaagactttgaacaattccaaggccagcaaggcaagtcacacagatcccaaacaaccctttgtgcatgttgattgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagtggaattacggtctagcgaagctccggctccactcccacaggcagctcaactagggtataagccaaacgtcttctccttcgcaacttgtcttcaactcaggtttgattgattattgcaagaatgagcatatgacatactcaacaagccacacagcaaatatgcaagtgcacaaggataccaaaggatggcataatatagggctcatttgcaaaagcagcatttagcaaacatttgagaattataaaacaatagggtaattaatcatcaatattaatcaacactgaacagcacacccatgctgcacaggcccaaccattctgaacaaccatatccggctgcacagatctatctccaaaccaggagctaaacaaattattaccaattataacatcttttattatggtgagaagtgtgagactaatcacgaaagacattgttagacccgcccatgaccgcgggcacggctattcgaatagttttactctggccagaggtgtaccactgtacccacaagacacagccccacaacatgtcaccatgcgcctcaataccaccacggtacctcggaaaagagctgtgacattacccctcgcacaacacaatccaccacagtgcactgttcccggatcatagtcacccccttataaacaaggcatggactccccagcgacccccgtgggcttatctccgccacttctcagtctggtgctccgcaatgaaccatgctatacaaaaggtaaagccgttgcctacgctggcttgtggttggcacggttaatgtttcacaaccgaaaatcgtgaaccggtccttaattgtcatgagcacgactctcaaaaccatgtgctcacaacccaccattatcaagttttagttggcaagtaattaattaaccaatcacgattggccatcgtgagctatcattatgccatcattaaataatagagaaacattaattatcccaatagtgtgctaatgtttctaagcatggctaagcaattatatctaatacatctagttgaaccaatatataaatccaactagtcaaattataacccgaggtaatcaagacatagggtaatcaatgcaaactggccataacaaaggaatagggtcacaccacccggtgacattcaaaaataaatgcacagttgaaataaatagagaatttaaatataggatcaacatgctcaaaggaattgtttgggatctgtgtgacttgccttgctggccttggaactcctcaaattcttctcctgcgaaaacggactctccggaaacgtcggaatctaaatagaaaagagcaaaaacaccaaaacagcacataaacaagtacgaacagtacatgtggatatttttaacatgtagatatcaattttagaaaaatttagagacttgaaccaactaaatccgagctaagatgaattagttatgaatttttaaagattaaatcggattaaatcaattatatgggttttaattgaattatgacgcaataatgaattatttttgaaaaggaaaaatgggtttattgcgtcagcggctagggtttgcggtggaccgagtgcacggcggcggctcacagaaacgaacggccgagatctctccatccaaaacggacagccgagatcgactggtccacggccggaccacgagagacgacgacgatgacgtcagcggtgacgtcaccaccggcggcggctcaggcttgcaaactcgccagcgaacgacggcgcgatgacgcgaacggagagcacccacgggtagcggacggcacggcgaactcaccggtgaccaaagcaacggcgaaagatcaacggacggcgacggcgtcgaggaagaagcggcggcgaccttcggcttgacgacgacggcggtgttccggcggtcgacagcaacggcggaggggcggacgaggacggcgacgcgacggcgaccacgatggcgacctctccgagcgacggcgacgactggagcgacggtggcgcatagctggagcggcggcgacgacggc

SEQ ID NO: 63553 - DNA, 823 bp, Oryza sativa
  unsure (1)..(823): unsure at all n locations
atgtagagtagtatttagtcatataagcacggtgcttagttcattagataccatcatttggggtaatatacagtggttctcaggatcattagttttggtcacaagtccgtctggcaatcctacatacgccaagacaattcgcaggatatcgtctttagggataagctcggctagtccctcacggtgtctccggatactgcaagagaaccggaaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccccccccaaaaaaagggttttaaagggcggaaaaggggaatnttttgggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggtgatgaactactgtaccatcaagaaagcatcac

SEQ ID NO: 63554 - DNA, 2453 bp, Oryza sativa
agtcggtgtgcttgtggattggaaagacaagcttccgctgttctattatttatttggtcggtcggccaatgtaactaaagtagatgtagtttataatcactttcatcttatttgtgtttgctatgtataatcatgcttgagatgaaagtgtgaatctagtgcacatcctgggaattagattcacatgagtatgagttaagaatatttgagatgttgtagatcttaagccatttttgtcaagtctcctaaatgtgtaacatatctggtcaccgccttcgagtggtttaacgggcacatctcaggctgaagttgactggcaggctaaaggcccaacaatatctccaatattactctctcgaggcgtcggatatttcattatgcttgtttgatgacttgaattatttatttcatctcttaattataatggaagattcggagagcctacgacagataaaaagaattattgcaattatatgcacgcataatcggataaaaagaattattgcaattatatgcacgcataatctctatccttcaacgctctcttcctctactcactcatttaattcctttatctcctaatttttaactaagtaaagaaatatcaataattagaaagctaaatgattataattcttaaattaaatcataattttaacttatttgaatttttgtttttttacaattaaataaaatatttaagatccatattacccatatttcactctataaaaaatgaaaatatgtcatttaagcatagacactgttcctttgcatggtaaccaaatagaaaaaacacggaccataatacaaaatgaaaataagtattatattaccgtaaatcactggacatcctctgagcacactcaaggcgtcatgtgttacgccttaaataaaaatataactttacaaattggaagaaaaaccatcttagcatcagtttccacttaaataggtagatccattattttcaaccaatagatattcttttaagaaaatcttaagcaaccatgtgttacgtcttaagaattagaaaaaaataacataaaatgtgagaaaaaaatatatcattggtttcacttaaatcatttagataaaatagaaaaaaaatacccctccacttcgccatcccccacacatacgcacaacacggcactattcgccccatcccttctcgtcttgagctctccactctaccccttcctgtttatatagccgaaaataatcaaaaattttaaaacttgcataaatttcaagctacacatccgatttctaatttagatattgttgtatttataattaaaacattgatttaaagatcaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgtgagcacggctattcgaatagatttggtttactcacattgcagtggatgtacactttacccgcactccgcgactgcccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattagggttcaagttaagttctctctctcacatactcatggcagtcctaccaatggcgacaccgatgtagggcacgcctctcgaccctacctcaacggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccaccccagtcgaaaacagttgtttaattttatttctcctttcacaaatcatgtcctcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacat

SEQ ID NO: 63555 - DNA, 6759 bp, Oryza sativa
caaaatccccaaaatggttttagcttgggctcgggtgcatggttttgatagtatcacctcggccatataaggaccggtcttcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcacagggccggtgtcctgctgttaggagctcagtcctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttatcaactaaaatgtggaatggttggcctgggttggcttgggacgagctgggacccagggtcgggttgccagttcggtctgaatcatcataggccttgggttaaggcaggttcgtgtgggtccacggccttgattaataacattgtatagttctaggatcgcgtttacaaaatagctttgagcaactaaacgtctttaaatgctgtttactgcaaccctaacccctttatggtaattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctactcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcaatattttcaaaaataaaaatcctttgttatttgtgaaaactgtctagtctctctctatcttgctgcttcatttatcgccaaaatctgacctttaaaatgttgtcttttctttttgtttttgtttgtagatggccggcagcgtcacccgtcgtggtttgcacatgactggcttcgtcttggagctgcgaggcatgtgcgtggtcttggggtatccacatggagtggactaccaggccaggccgcttccggagcaggagggtgacgatgcagagccccacgctggttgggaggtcactgcagtgatcctctctggctctcccgagcggacttcgctggcagtcaccgcgggtggagattccttccccgccgcttgccagaacgtcgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgcatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttcttcctcgtttgtcttcttgttgggtcgtgtggggcatggtcatgccggtgtgtggcataactgtgtcggagcctgtctttatttatttgcctaagcaacttgaactttaatgaacccatttaatagcagtaataaattcaagaattatggtagttgtgggtggttagttttaattgttagctctttctctgtttgctggttctgtgtggggttttcagatggtgacgaccaggagaaatgctgccaccggtgatggcaaccaacctgaaggcagcaaccacaaccaccagggcaacccacctccaccttctccttcgcctcctccaccaccaccagataccaatgccattctcacccaaatcctcgcccagcaggccaacatgatgactgctttcctccaccacctccaaaatccaccacaacagaatgctccaccaccacccccacaacactctaaactcgccgagttcctccgcatccgtccacccaccttctctagctccaacaaccccgtggatgcgttggattggttgcatgccgtggggaaaaagctagacacggcgcagtgcagcgatgaggagaaagtcatcttcgccgcccaccagctgcaggggcccgcatctctatggtgggaccatttccaagctacgcagccagaggggcaacctattacttgggcccgcttcaccgccgctttccggagaacccatgtgccagctggagtcgtggctcttaagaaaagggaattccgagagttgaagcaaggcaaccgctccgtgatggagtatttgcatgagttcaacaatctggcccgttacgccccggaggatgtgcgggaagatgaggagaagcaagagaagttcttggcaggaatggacctcgagctgtccgtccgtctagtctctggggactatccggatttccaacgtctggtggacaagagcatccgcttggaggccaagcacaaggaactggagtcgcacaagcgccgcttggcgaatttccgcaatcaacagtgtgctaaccaaagggtccgctacaccaatccctatccagggggatcctcttcgcagcagcaacaacagcagcagcaacctcgctccgcgcctcgacctcaattcgtggtgcgcgtcccacagccgcagcagcagcagaatcagcaagggactcgtgcgccccgtcctcctacgccaactgtgcagcccggtcaaggccgcagggacgctcaaggtcagcagcgtctgtgcttcaactgcttcgagcccgggcactttgcggataaatgcccgaagccaaggcgtcagcaaggtcaagcgcctccccgctccaacaacggtgggaaggatgtcattcggggtcgtgtgaatcacgtgacggccgaggacgtgctgacaactccagacgtcatcgttggtacgttcctcgttcatcccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgaggcgcactgtcactctgtaccgagggccggaacaaccggttgttttctttgcacccccaacctctgtcagtagttcagaactgcatcagataggactgtcagaaatccccatcgtcagggagttcggagatgtgtttccggaagaactacccggtatgccgcccaagcgagagattgagtttcggatagatcatgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagactaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtgatgtcgttcggtctaaccaatgcacctgccttcttcatgaacttaatgaacaaagtgttcatggaatacttggacaagtttgttgtggttttcatcgatgacattctgatatactcacaatcagagggagaccatcagcaccatctccgtctggtgttgggaaagctgcgggaacatcaattgtataccttcgggtcacgccattgcgaggtgtacacaggtttcagacaaaagggaagctcgcacctcggtatgtgggtcctttccgtatcattgctcgacacggagaagtcgcttaccagctggagctgcccgcctccttgggcaacgtgcatgatgtgttccatgtgtcgcaactcaagaaatgccttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggtccagtggagcaaccatgccgaagaagaagctacttgggagcgtgaagacgagctgaaggcagcccatcccgatctcttcgtcagttcttccgaatctcggggtcgagattccgtttaaggggggtaggtttgtcgcgtcccaaaacgactctaaaatacatcctcgaaattgtgccgagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaataagtccttttcccccccttcctctcttgggccggcccggcccaactccctccctctctctcctctcccccgcggcccatcggcctcctccccgcgcgcgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttaatcccgcaaagttcgccggcgcatcaatggagcccgagatcgccgcgccggtttccttcctccccggccgccctctctccctcccgtccctatataattgttccccgtgcctcactcctccgtttccgccactcgccgctcgctctttccgtcggattcgtgctcgcgccgttgtactctctctccgccgtcgccgccgagctccggttcgccgccgtcgtcgctccggacctcctcccgtctcggcgtcacctccttcggcttcgccgcgtccccgtcaacctcgtccaccccttcgtttcgcccgccgaccgtcggagcgccgccgtcctcgtcgatccgaaccgcgccgccatcttcctccgctccgatcgtcgtctccgccgccctcgtcgtcccggggtgagccgaggaccgcccgttcgcttcccccttccctcctctctctcgggtgccgctccgccgcgccgttggtcgccggcggcgaccatcggggcgcgggcgcgccgcctcccgtcggccgtgccggcaaggccgccttcgggcgcgccccgcggctgccaggtggggcccggccgtcagccgcccgcgcccgcgggtgcggctgacgcgtgggacccacggcgccggccggcgtcagccgcgtgcgcccggtccaccgtggaccgagaggctgacgcgtgggccccactcccgtggacccggtccgcgcgccctctctcccggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccag

SEQ ID NO: 63556 - DNA, 10375 bp, Oryza sativa
ccactcctcgtcgtcgtcgtcgtcacccgggccggcaccgacttgtcgtcgtcgtcactagggcagtgccgatctgagggggtggcggcgccggctcgccgtctcgctgcaagtcgccgctgtcactgcaagtcgccgccatcgccgcaaggagagaaatgtggatagggttgggtggatggagagggttttctaagggtattctgggtattatgaatattagttgtatttctttttcattttaaatcaaaacttaacggactaatggaaatagggtcagacgggaaactcgtttttgaaaaggagggtcaaataagtgttgatgaaaaacaagaggcctaggagatctgcttagctccagtgcaggtccaaaactcgccttcgggtatgctagcttgccagttgatttgatccagtaatcaacaagaaataaagacaaagaaaccgcggttaaacttataaacgatagccgatcggctaagggccaatgacatatcatttatctttgaggcaatgtcatatatgtatcgatcggcagtcatgaataaataagaaagaactaaatctactcgatcggctgtagatattaacgatatatactccttatatcgatatatacttaaatcaagtgattgggatagatcggtcgccatgccgagacagtataaatcacttagatcgaaatatatattaataatgggacaatatatgttcatagcatagccgatcagatagatctagcatgtatcggctagtactccgatacgactctatactaagatattaaagcaagtagaatataccaaacaaaagcctaatatacttaaatgcaacaagatctcaacataaagggcagatttaacatgtcaataaagcacataaaacaaatatagttaaatcaggtaagatcggctgaaactccgatactaccctaatcggcaaccaagaagcaggctagagattgagattctaatcacgactcaaaagatcaaacaactgatgcagctataagtatgaagggaagaacaatatctagacaatcaagctgctggaagtttcatagagtggtggatatcttatataatctgaatcaacatcgatatttaacctaatcggctgccctctatcgacagatgttagccgattgtaagttaaatagcaatattgctagagattatgtaagatatatgataactcgatgaattacataaacaagattagagtatcataaagatgaaagcactaattccgagaatgcaagccgtcataacaagttttacctcttgttgaagatcgaaaccgatgcagcttaacccgaaagcaagaactcgtctaaataagactaaagcaaaaagggtggcgatgcaccgagattgtattgaacgtgtatgttcaatgattacatggggttcggggtctatttatacccgaaaattacaaactatgtccataccggacacgactcttatatctaacaaaccctaagataccataagtctttgcggcagacttttgcccaaacatatctctaaggaaattacataaaatatcctaattaatagagacaattgccttcttaggactctattaatgtgtggcaatcatcttgaagcatatcaactgaacccgatgtcgcacaccaaatcgtattgtcggaatcagctgtatcggcttacccagtctgactcggactcagccgattctgatcgtagccgatttggactccaaccgattcttactctgtttccgcaacgatcttcaccttcgattccgcttcgattcagtcttcttctccgatactaatattaccaaacttggtcgttaacacatgccccccaagtccggaatattggataatgtttcggattttccatatgccgattccgaaagaaatccgctcttgtcattttccgaccgttactcccatgctttaaatactaaccgttacccccaagaaatctcacatcatcttcttccgttttcaccgctgaagcaaattttgccctctctctctctccggcgattcctccgacgcaaaaggcgatcccagggcgattccatctccggccagatctccgcctgcagtgatgtcgtcctccgacaacctgcctactgtgccgtcaaccgagtacgatgaggtgagttcccatcggttagatctccttttcccgtatcggattgatttcccttttcctcatcttgttttcttcttctcggttcttttggatttgcaacatctttctaatttgatcgcaattccaagcctatctcacgagaatcattattttcttggtccaatcggcaaccttgatcccaccgagttcattattggtgaaacaaataggattcctttcagattagccaacccagatctacatcactggaagaacacctttaaatcttggccatcacttgagaaaacccacccgagaagagctggattacatggtacaagcgcgtatggccaacaaaaaagttcattgggataagatcggaatcggccaagcgcttgcccttaccatagccaactcagctaaggacggacctctgatggctgccgctacctatttctggtccagcaccatcaatgcctttctgttcaaccatggaccgatgactccaactttgatcaacaccaccatgatcactggattagatgtaacttcatcggctaaccctatgagtatgaataccaagaaccaatttgacttcaagaccaaaagcataggaggttggtctggctatgtagcggcatatatgggcaaagggcctatcactcctcgggagcatgtagctttcttactaatgtggctagaaaagttcctcttctgtggatccagctatggtcctacaaccaattggcaatttgtagccgaagccctggaatcaaagaagcaatttcccttaggcaaaatcctcctcggcaatctataccaaatgctgaataatgcatcagccaagatagctgtcggctcagtagtgggagtaggtggaccatggtggctgctgcagacttggctaaatctgatggtcatgaaagttgtcaatcggccatctgtgacaaaagctgaatttccaaggttggagccgattgtggaagatgcccgggtttggtttccttatgaagactcagcagaccttgagcttccatcggactttatatttgaatacatcaatcatgaaagatatcaaaagtccagggatgtgttctcagctgcaatcagcccatgcattcttcctttcggcattcatcaaggaagaaacattcaagtctcttatgaattttatcacccgatgagctcagctagacaacttggagtgggtcaactcccaatcggcttattcttcgccgataagatccaatgccgaggagaaatttcatcaaccttaatgatggatcggctgctaaaaaactaaccatatccatggcgactctcttctctggcgacgtccatggcgactctctctagaagatggtcacgccggcgccgcctactggatgggatttctccacgggggattccatccgtgatgaagtttggagccgttttggttcaccggttcacttttcctctcattttagccgttctacgtttcgattagtggttgatgttcctcgttcttcgtttcgattgacctcgtcctcggtggcgcttgctcttagagcggcgattggtggttctccgtctgatcttcatgttgatcctttgattgatcgaagttttacttttctggtgtgttctaagaaagttggactctggatctactctctcagatccttttcttgtaaggatttctcggttcggtattttctctggaagaatggaggtcctgattggagacgggaatgggatctctggcaagctgagcaatataatgaatggaccattgtaaagcggcgatattcttcgggtaatcgttctcagcatttgataaaggcttcttctgtttttgatcgtcttaagtttgatattccatcatctccgaagaggattactcagaagtctgattctattgtctccaaggaaatttttcttgctaattctgatccgaaaggtacgcatcttaatcgtgataagcgcggaattcttccttttcaaattagaaccgatctgggctggtttgttttcggtgtttgggctctgatcacctcatccgggattgctgctcggaggttagatgtttgcattgtaaaagtctgggccatattaaaaagttttgcccttctgttgggcttgttaagtctccatggcccaataaagtggtgtctgctaggggcttgggaaaaaaactgtctgtcccaaaaaaggagcaacctttgcgcattaaaactccacctaatcaggtctgggttaaaaaaaataagaaacccccttcgtcttctccttaagttgctcgctctctagtagtggcgtcagaatcgcagcctcaacctaatcctttccctgctccaatggcaaatactaaccttaatccccatcgcttcctgcgtgcggggcaagtggtacatcaaggtggtgatcgtgtgccaagaatcaacctctctgctgctaccaagccgccaaggtctcatgaagagtatgccagctttggttgagcccatcttgccggaggaactttgggatgatcatcggattctaatttctgaatacattgagcaggtgcagcactttactgttcgccgtagttttcctcatgcttcagctgtgggtctattcaagtttggttctgccatggttagggacctgctagtttatgctcccccttttatgtatgatggtatacatcaggtcaactttgtcagacatgatcagagtcctaactggcgtgctgctccatttactagaactgtctggtttttattgctcgatttccccctagattacatcaacatgcagtacatttgtctggttgtctcttctttcgggcagttggaggaatggtatcaaaatgacccaatagagggcaaagttttggtcagagctatgttcaaggactttgattcagtcccaaggaaaattgttcttcaagatcccacaagtggtgctggtgaatcctggaccatctctgtttttaccttggagggtgattttgctgatatttttccccctgatgaagaccttccccctactggtccaaataatgatgaaaatcctgatggtaatgatgatgacgatggtaatcaagataatatttggcaatttggcccacatcctgtggttcttgcagaaagaagaccaggcttggaatcaggctgctgtgggccatcaggccatggaccttgaacaagctgctcctgagaacatgggccagattgataacaaccatggctggaatctggttgctaacagaggtttaattttcacccttgctgatgctttcaaagatgccttcaattcctggtatgccaactctctggcaaattcagcccttcatcctgcaaagcttaattttaatttgggaaatgaaattgtgccgtatgattctatttcttttgaatcttctgctataatcctgagccgagaacctctagctgtcatccctccgtagtctgtgatgcctattttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttagggatggtttcaagaatattctgcaagaggatccaaacatgggtgttggaaagccaagagggaaggcagttaaaaagctgaaacagttggctgaggtaagtggaattattttcccatccgattcattatcttctattgatttaaatcctgatatatcttgtgaatctgaaagtgatcttacatctgttatacctgctaattgtgatatatcttttctccagaagattggatctgagatgtgtgggacttcccttgaggaggtttcaagcttggtggacttgggagaagctcaggtcatcaagctgaaaaccattggaccatccaatgatgaagcctagttctatcagacttttagggctgctagttgcactctttaggggcatgtgtttattcctttatcaacccttttattttgtgtttaagttatgtaaactctatgatggtactatgtgttggtgtgcttgggacctgcatggattattcctgcttgttatctttctctcttcaagactagttgtcaaatgaattcggctatgagaaattggaatgtcctctgctggaatttaggggtctgaattctgatgacaaatggttagccactagaaataaaattgaggaaagtggttgcgctgttttttgccttcaagaaacaaaaagatcttcttttgatcattcttacataaagaagtttgctcccaaacattttgacaagtttgctttctctccatctgttggagcttctggtggcattttagttggctagaacagttcagtttttcggggatcagatattgtaattgaaaggtttgctgttaagattactttcacctcaaatcattctggtttagtttggactttcgtttaagtttatggtccctgcactggtcctgaaagaaataacttcctgtcctggctccaccagttgaacattcctgatgatgacctctggctcattcttggagactttaacttctatagatcagttacaaatagaaataggccgggtgcagacatgaatgacattttcctgtttaatgcaatgatcagtgatctgggtctagttgagttgcccctcaagggaagggctttcacttggagtaacatgcagcatagtcctctactagagcaattggattggttttttacctctactgcttggaccttaaccttcccccataccttagtaaagccacttgctcggtctacttcagatcacacaccttgtgttgtgcaaattggaactaacatccccaaggctgacatcttcaaatttgaaaatttttgggtagagcatgatggtttctttgatttagttcaatccatttggcaaaatcatgggtatgaaggtaatgcagccaagaatatttctgttaaattgaaggctttgaggaaaggtttgaagaagtggagtaaatctctctctaaacttcaattgttgattaaaaattgtaatgctgtcatagcttttttggactccattgaaaacttgagagatctcactgttcttgaatggaactttagaattcttatcagaaacaagctactactatacctgaagtataaacaaatttattggcaaaagaggtgtactatcatatgggccaagtttgggggtgagaatacaaaatttttccatgctatggctactgagtcttttagaagaaatgcaataccctctttagtagattcttttggtttagtttgtacaagacatgaggaaaaggctcacatagcgtggagtgctttctcttcaacaatgggttgttctcagtttgagtttatgccttttcagctgcaagaacttttccatgcaaatcaatctcttgcttctttggatcaaccctttggtatttctgagttagacaaaattatacagaatctgcctatagacagagcccctgggcctgatgggtttaatgggatgtttgtttagaaatgttggccaatcatttgtcaggattattatagacttgcagctgagttctactatggtacactggacctggatcctttaaaccattcttttatcatcttggttccaaagaaatctgtgccaaaaggtataaatgactataggacaatatcactcatgggaatctctcttaagatttaaacaaaagtcctagctgatagactgcaaaaggtgatattggagataatcagtcaaaatcaatatggattcataaaagggagaactatacaagactgtctagcatggaactttgaattccttcatcagtgccatcactccagaagggaaatagtccttctaaaattggactttgagaaggcttttggcactattgaacatgaagctattttgcatgtaatggaagccatgggttttagtgctacatggtttggatggataaggaagatcttttcttctgcttcttcttcagttctggtcaatgggatacctagaaaaaatttccactgcaagagaggagtaaggcaaggtgatcctctgccacctttactctttgttttaggagctgaacttctccaggtcattgttaacagagcttatgcaatgggtcatctatcaaagccttttccatcagactttgacccaaattttcctattgtccaatatgctgatgacaccctgctttatttgaaagctagtggttaagagctctttactctaaaggctttattgcaaactttccagctgggaactggtttgaaggtaaattttaataaatcttgtctcatcccaataaatgttgatgaatggaaagctcagaacttagctgcagttttgggctgtcaattgggatctttgccttttacatatttgggtttaccatttggtaccactaagccaaaggtaatagattttgcacctttagttgacagaattgaaagaaggcttacatcaaatgcttcattcttgtcttacggagaaagacttacactggttaattcagttttctcttcactacctacttattacatgtgtactttaatgttgccaaagacagtgattgataacattgacagagcaagaagacattgtctttggagaggctctgaggtcaactccaataaaacatctttggcagcctaggataaagtgtgtaagcctaagagaaaaggtggtttaggagtgctaaactttactatccaaaatcatgctctgctcatcaaatttttggacaagttttacaataagaaggatttgccctgggtcaatctggtttggtttgcctattatggtaactctgtccttcatttgacaaacttgaagggctcattctggtggagagatatttgcaaactaatggatgtctttagaggtattgcaaagtgtaatatgaaaagtggaaatacctgctccatttggtatgatgtatggatgatcaaccccctctttttcacactatgccaaagctttgttcttttgctcaaaaaccaaaatgcatctgtctctgtgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggcagatgcatgattaatgcaagggggtacaaggggtaataatataggggttaagttttgcagaaagcagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattcca

SEQ ID NO: 63557 - DNA, 6295 bp, Oryza sativa
atctcggccgccattgatgacgccggcgagggtttcgggaataaatccgagcgaatccgagggagagagagaggggaaagaggggggaaagagggagggaatcacggggagtgatttccccctctttatggcgcgcggggacggcgggatgcggcggattcggcggcggcggcggcgctagggcacgggcgggcggcgggtgcggcgcgaggacagggatgacaggtgggccccacccgtcagcgagggtggcgggcgggcccgcccgtcagcggcgcgcgcgcggggagaggccgagtgggccgcggggaggaggagagggagggaaggagctgggccgagccggcccagtaagggaagggggggggaagaagactttttaggatttttctttttataaaaccattctaactttgtttatttcttaataattattatttgtgctctgaaaattccactaaaatttgagggctccttttagaccaaggagaatttaacaaaaattctccgggccacatttgaatttttcttatacgcattttagtgtttaccaatttcttttcgaattttaattaattctattattccttttagagaatgatttttatttcgggatgaatttatcaggacgtgacaaatccaccccccttacaagaatctcgtccctgagattcgaggaggctagcatgaagataggttgggcggtcttctcttcttgtctgacttcttccgctccgtcttctataacaaacttgcctaacaacacttctccactctggactgcttggctcgatctcctgttgcaggtggaatcttctcttcacccgacttgtccctagttgaacctttagctgacttcgactaggttgcggcacttgaagatggggcttcagttccagaacttcttataattcatatcttcggcgtcaacctcacacaagttatcaacttcatatcatgtgtcgtaacctgcttgtcattactaggataccatgcttggcgtttccttccagcttaccaccatatgctttagactatgatatcccacttaccaaggataccatgattgacaacttgccattaactgtctcattttagctttcctggtctccggtgctaggtacttctgctattcgatgcaagggtcaaccactctaactataagttatgcttcccaggagaaccaatttatcccacttgacatgctttgacgtcttcccgaatgactttgctgctggacttgttattgtctgatcgtgatcctgccagatctgaagcttcgttgttacaggtgattttaatctgacctctgtagactatcttcgatcatatcacttggttcataactgggaatagctcccacgaacaagcagctcggattcactttctttacattcagtttacttcccattgttatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccctgccttcatagaaacacttttacctaggtcatattgcttacttaatgacaaggtgactgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagtgaaaccttgatgtggttcgtcacaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaattattgatgtctcctggatcttcttaactgtttgcaggtatatccgaacttatcaatgtagaggcatggcgggtacccttatgggtttcatccaacaagccttatcttgatctgtaaaaggcgtatccaaactcctatccccaactactgtctcattggctttttaacccaacacagtttaattggttttcttttccatccacaggttggttattaactcgaggttagaatatagttcctctgacacgagaccctaggtctcctttgtcagtaaacaattatacacctgatcacatatccgcatcttccaaaagaatcctcttagaacttgtctgtattacacatttctcccttattacacgaatacaaggcactgccttaaacaaaaagggaaggtgcttatcatcgatacattgtatcctcaacatgaatcatccctaaacatagcaagctcactgtttacaggcatgaatatatttatttattacatgattgctgcaaactttcgattacacattgataagtagcgaactggaaaccacaaacatggatacatagctggcattgttctagtgactgcatccttgattggttctgtgatgatgtgataggactgcatattgctattattcaccggagaagtttccttctgattgctggttgaggcgaataacggtcttctgctcggtatcgccctccggaggttgattgccctttgcttggcctggagtaggtcggggagagacacaacttctttcatcgacgacaattctttgctgaggctgtcggtgcagagaatggttggtgttgaaggtattatcgctatgatttattgcagagtcaggtgcagcaggaggagcattggtgctggggatgatatcgtcgatgttgctgttggagctgactagctgatgagacaatcgtagggttgttcgttggatttctgcggtcttggtcaacaacaccctgagttggcaatccttgggcacatggtttgcaccttcgcacagaaaacatgtgaccttgcgggtgggacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcggaaagtatttcctctttgacgtctaggaatagttatccctgctggaggccattcggtgctggtaatagtcatcttacgtacttctgcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctgcaatcatgacaaaaggggacatcctcttctggcattggaagctcattgacctgggtggcaaatgctcgatcaaacacatattgattttggtcttgacttccaaccaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagataggaccttaaaggaactaactcttcttgttgatgtgttgtttgtttcacttattctgcaagttgattaagcaaacaacctagcatggttacatcacaacccacagatgcaaaccacgcgctacacacacaagcaaggaaacacacgacaaacgaaacactagagggtggcttaggttctgcgacgggttcccaagatcttcactcctgcttcacagctggcttcactgcttcctccgcttcgctagcggatcctgcagtcttccggagcttcggcaaacgactgacgatgtcttcttcttcactgacctgaccatctagtactagttgaaaatccgaagaagggagaacggagtaaaccttttgcaaatagcattaggggaaggagaaaaaggaactttcacaaatatatttatttataaaatatgtccttaggttttatccacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccactccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccaatccgtgtacttttgtttataaccagactgaaccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaatttcatagtgtccaaatgatatgagaattcccaaagtctaaagttataaaaccacctaatattgcctaattaatcagcgaagcatctacctaaattcatactagtggaaccataaatagagtacccactagttggggttttgtttatcctagggtgaacaaggtaatagtaacaatagcaataataatgaggtcataacaaaggtaaataggcatggctaaataaaacagtgataacgcgggaatttaaataaagcgataatgcattaatttaaattaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagtttagccatttgaagttatatgctctttaa

SEQ ID NO: 63558 - DNA, 725 bp, Oryza sativa
cgagcagcccatgcacctactattggtacagtagttcatcaactctattcatggatccactagtatgaagataggtagatgcttcgctgattaattaggcgacattaggtggtcccataactctagactttgggaatattcatatcacttggacattatcgaatggttagatcatggtgggaatggatgcacacctacccctctattcaaaaccctcaaaatggttttaggctgggctcggcgtgcatgggattgttcatagctccttggccacctaaagacctgtcttcgaacctctgatgcaaagcactacctgacttgcacatgactagtgggttaggcttagtttgaggctcaggctgagtataacacaaaaaggcacggatggagatggatgaagccatgggtcgatggacatctgtaggacaaaatgaaggctacacaggcttctgaccggtataccagatgtcatggcacatggctgacgcgctgctgctatgagctcactaatgactgactgtctaggggttccggacgtaagtaccgtgcgtcagtactctcgtctatggctacgatgggctcgagactatggcatgtcttacgtacatatgccaaggagctatgtcacacgtggatgcacgtgaggaagacatggcttgagaggtaagacgtacaccattgaacagagtgtaacctattggaatagccgctctctctgtaatggg

SEQ ID NO: 63559 - DNA, 772 bp, Oryza sativa
atagggggagtgtgcgcccaaaccgacttaaggacttcactcaatgtcagttcattccgtatacagtacaaccacatatgctagtatgggatagcccaagcttagtaagttgtttatggtttagccttacattctggtaggccggtgtgtatgagttcatataattcagaggagcttcctatttaccccgacgtggtagtttaggtgactaagtgtgtccaatacaacggtattgtgccacgtggtgggttcccgttgtgtccgtcaccacggcgttaagtttaaggcgtgggcccaccacttaacggttctaggccatatatcgagtatggcttaggatggagtaacacgtatcgtgctggtgtaaggctaaatcatgaattttggaaaagctttgttgcgggtaataaatcgggtacttatgtatcgcgtgccatgcttttgcatgattattatttcgtatcatgtgggtaaagtgtacaaactctgcaaagttaaaactaatcgattagccgtgctcacggtcatgagcggcgtgtggatatgtattgagtatagacttgtgtttattctcctgaatgctgaaatttaccttcaaattgtgatgagatttgagaatgatctccttgctgccatggatggcaatgaggtggatatttatacatgattaatgcctactttgatgcccatatgttaagtactagcttgctgaaattttatttgaaagcaaatccgttttgaatgcgttttatgcaaataaaacttgctttat

SEQ ID NO: 63560 - DNA, 2971 bp, Oryza sativa
tgctgaaacattatttttatataaagtgaaacaacacccgatttaaacgagtgaaacattttcaatctacttagtaaaacaattccaatatatcatgcaacatttaaaaataattcaataataagctatttttttcgtcggaatatatccatgtgtggtcttgttttgaagatttaattacaacgaaattaatggtgcaatcggatcatgatttggataagtaatttaagagaaaaaacagtttaaagtagtttttgcacataaatcagggactgatgtcagcgcccgatttttctcaaattcgatcgggcgaccaatccgaatgagcgtccagtaaagatatatacgaccatggatcaattacgatgaatagtatgtctttttttgcaatgcagccgtttgtaaccgttaattaaattaagtcgtacggtgagtcagacagctgggttgtatgcatagcaatttccttttatttttatattcctctagttttactttggttctccactttgttagatatgagaggttattgatggattgaaataatctacctacaaagtaagtgtgcctttgtcactgatatgtgagttcatggatcaccaagctcacatgttggtaacaaagtcacatgacttgtagaggagcatcatccgacaccatacgatacgttgatatgggacactacgtttttagaaaacatggatatggtaaaaaaagaaaatcagtattacttcgaattggaaaaactactgctagtagtgcccaaggagggaactggatttctttctacgatcaaagtaaagtccttggcaagctaacatttttcaattacaattggcaagactaaagatgtgttttaagcccgagtaattaaatcccatcgagaaccttgcaaacatcacccgacactcttgctatcaatgttatggaagacagaatatggctatcgggcaaaaaggatatacatctttctcgaatagagcattgatggttaatcgaaaatatacggaatttggcgtgacagattttatttatttgaaactcagacaaaacaattggattatactccacatcttgttttccagagactagacagaatgtttatgttgttcttaggtgaaagccaaatcagcactgctatacatacgatatttttttacgatggcataacgcttctctcctatcgaacattaacggttagaaggtatggatccacatggaaaaagattactctcccatagtgagcccatgtccaaggcccaaactcatcatgtctaggcctgccatctcgtaagcatcctgatacagcgaaccgaagtaattttcttcataaccaatctatatacatcatatctttatcatatctttctggtttcatataattattaacgtttaaattagaacatgttctttaaaatatatctttgactatatttttatataacatttaccataaagacaaatctatatatgttgtaaactaaatatttttttaagttattgatagttaaagttataaatatttaaccttaaccttatctaaaacgtaaagaatcatataatcagaaggagttgttgtacttcggcactcaacatttaatttatcatgtggcgaattgatcaactaagaaaatggcatgttttgcaaagcaaaaatttatattaaaatattataagagggcattttgtatatgtttggcaactgttttttctcttttataccagcattatatggtcttggacattaaataggaaagaaaataaaatggaaagtcatatttacgacataagctaagaggcaaagaaagaagatgagtctagatatgagatatgggcttgagggtccatgagctctacgctcctgacccctgtcgtacattttgttcgtactaagattgtacgtaaaatatcgtattcatagcatttcctgaaccaaattgctcgtgtaccactgccacatgccgttgctctagacctacacttgcattaacattacattcaataagctgattaatcgaagaagacccatcttaaaagaatgcattattctgccttccacgtccttccttcaagtgtagcaaagctgtaaaccaccgatgtcttggctcaaataacaacactcaatggtttaacagtgagtttttttatggcgtctttttatttcctttggtccaatatgatgggcatttgactacaaagttttggcacgggctgaatgttaccattgccaaaatacaggaaatactccgtacaatatagctatggagcattgtatacaagcaatcacatccaatttttacgctatcaatctgtttaacaaaatttaactgtggtaaccaaaaatccaaaccataccatactggaggccttcatttggaaaggagagaaaatgaagccattaggatcaatggaaatttctggagtcctacatttcctttgtcacggacacaatgctacaaattttcagcatacatccacttacggtcagaatactcaccacaaatcgcatggacatctacaagcggcaacctcatgcgggagccaataaccaagcgtagttcagcatcatatgatatcaagccccagcatcctttcacccttgcaatggagattgggctttgttctcattgaatccatacatcccatacccatagtgatctatgtcagcaatagcaaggctcaaaccgtaataaaactactggtataatgcatcccaacggtatgcaaagcaacttctctgttccgactaccaacaggacaacaggcaagcaaaagtacacaacacaacggtggattttcagcatttcaaaaataattctgaacatagccattttgagaggaaaaaacagagacacaaacttaattggaactaaagactagataatgggaactaatgaagaaacttattcgcaattctcagctggaatatcaaagttctccacgtgatgcagaggcaaagggctgcaggaat

SEQ ID NO: 63561 - DNA, 12960 bp, Oryza sativa
  unsure (1)..(12960): unsure at all n locations
cttatgaagagggtcagcctggttatgtgggacggggacggncggcgcgacctgtcgaggacgttcacgtcggagacccaggtgaagncggtgcacggcgaggtggagggcgaggaggtgatcgtccgcaacggcggcgaggtcgacgcgtacagcctccggcgcggagcgtggttgtgggtgcgcggcatctccagctcgggtggtcctgtactggatgtggcgctgctggcgcaccgggacagcgtcgtacaccacgacgtgagcttcggcgaggcgtcgcggcctcttcgataccccgacgacatccatggccagcgtttgtttgtataatcgcatattcaatttgttttcgttaaggcccgttaaaaattttcaccctgtaatatcaaatgttttgatatatacatggagtattaaattaaatataaagaaaaaacaactaattacacagattgcttataaattgcgagatgaatcttttaagcctaattgttccatgatatgacaatgtggtgctgtagtaaatatttgctaatgacggattaattaggtttaataaattcgtctcgcagtttacaggcagattctgtaatttgttttgttgttagtctatgtttaatacttcaaatatatatccgtatatccgatgtgacacgccaaaactttacacctgtggatataaacatagccttagtacagcaaactttacatgagacatgaatacactgtatgtaatatatctttattatgttgtatataggaatataggatccgcacatatatacacagacaaatatatcacatatatacaaccatgtatgcatatagtccatactcgatccctcgcccctaaatataaggattttttgttggatatgaacttgtccagatttgttgtactagtatgtgccacatccaaccaaaatcccttatatttagggacggagggattaacaagtagggaaggttggagacatcacatgaaaatcttcccatcgggcgcccaatgccccccaaaaaaatcggtcggtcaaatgtttcagttgaccaacgaataaagcattaagttatatatagtgaaaaaaatagcaaccgaaatatttaaaaattttatgaaacatggtgaagtacatgttaaaacatgtcgctatatcatatgaaacaactaatgttaacggattgaaacttatgttttttttcatcagaatataatcatgcgatatcttgtcataaagatttaattacaacaaatacaacaacgtgattggatcgtagattagataattagtttaggagaaaattcactaaaatgcaattatatccaatcacatgatataatacattatcgtagatcggtgtcacatatattagaccctgtttagttcccgagcaaaagttttattccctgtcacatcgaacgtttggacacatgcatggagtattaaacatagaaaataataactaattacacagcttgcgtgtaaattgcgagacaaaatttttaagcccaattatccatgatttggctatgtggtgctacagtaaacatttgttaatgatggattaattaggcttaataaattcgtctcgcagtttataggcagaatttgtaatttatttttattattagtgtacgtttaatacttcaaatgagtatccgtatatccgatgtgacacgacaaaactttacacccctaatctaaacacccccttagtcttttgcatgctgtaaaagcagttatccaatcacatgatagaatatatgattgtagatcggtgtcacatatattagtcttttgcatgctgtaaaaggaaatctactccaccttcacatcgtagaatacacaaacatcaaaatgctctgtcggcccgtgctagcttgggccttggagcaccactgttatccgataaccataacgaattggatgaccataaggaagcaacgctctcgatagaactagaagccgtgcagcccatctgcctggcatggctataggatcagcaggtttcagctccggcgtccctcagcagcagcagccgccgccgcctcctttgcaggcatctggtggcggcacatggggcacgtgccgtgcacgcgcagccacttcaccaggcacacgccgtggaaccggtgcccgcacggcatctccttccaccgtcccgccgccgccgtcgccgcgtcctggccgtggaggcagatcgcgcactccgcggccggcgccagctggtcgacgacgacgtccctgagcgcctcgatcgcctccttgaatgcgggcgccacgccgccggtggtgcagccgggcagggaggtggagataatcatggagacatgttgctgctgctggcgctggagatggtcgtcggagacggagagcagccgcgcggcgagcatcgcgagcgactcgcggctatacggcgcagcggcgggcgtggcggcgctgttgatccaggtggagtggagccgcatgaggtggtcggagttggaacggaaccgcgaggcgagcacggcgcgcgacggcgggaggccgccaccgccgacctccgccatggcagcagctgcgcccgtggtcgtcgtcatttggacgtacgctcgtgtaccgggtttaattggagtgcgtagaatcaagctaagcgagcgatcgatcgagcgcttaggtttgcagctgcaatatatgcatgagacaggcggctgtgttgttgttgattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactcacaaagaacatattattgtctacactactctagaaatttcacagagaaaggacttgctccttgacttttgtttcatgagtagtagagagagttagagagtaggctggtatgttctagaaataaattaactccaacaaactcccccttaatttatttcttgcaaactccgatgagctctctgtcgcggacaaatttttctttggataaagccttggtaaatatatctgccaactgctcattagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgctcttcatatcgtcaagacatccagcccagtcactgtccgtatagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctaccttatcagctccatctctagccttttgcttttcatttggcaacaagggggttgtaactgacttgcagttatccatcttaaatttctttagaatattttcagcatatttcctttgtgatataaatattccttcatcactttgatgcacttccataccgagaaaatagtggagcaagcccagatcactcatttcatatgtatgcatcatatctcttttaaagtcttgcatcatcttctcactattgccagtatatatcaaatcgtcaacatagagtgagacgattaggatatccgtacctgttttgttgatatatagagtaggctcacttatgctcttggcaaatcctttctgaataaagtacttgtcaatttgactataccacactctaggcgcttgctttaatccatataaagccttcttgagtctgaataccttattttctcccccttggactgaaaacccttcaggttgttcaacatagatttcttcatcaagatagccatttaagaaagccgatttaacatcaagttgataaatcttccacctcttttgagctgctagagcaattatggtacgaattgtctctagcctggcaacaggagaatatgtctcataataatcaatcccaggcttttgcttaaagccttttgccacaagttttgccttgtatttctaaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttttggagacttccagttccatgtagcactctcatcaaaaatcacatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttggtactgccttggtaggacttctatttaaaatataaattgcagtattaactgcttcagcccagaaagatttaggcatacctttgtcttggagcatagaattggccatatcattgatcgtccgatttttccgttctgcaactccattttgttgagcactatagcctgccgttagctgtcttcggatgccagcattttcacaatatttctcaaattcttttgagatatattctcctccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagtgtgcactagttccaatggtgcacttgctctccaagctctactgtggggaaaagaagcccgaatttgttttccaaatacacatccttcacatgggtcagacttgagagtaataaatggaaggccttgaaccataccttttgtcctgagtagcttcaatgctctgtaattaagatgacccattcttttgtgccataaatcggaaatatcaatttcactcctgagagccatttgagttggatgattcatccttaatagaaaatttctgttcttctccatatttattttggcaaccagacgattattttacgatccaatattttgcaagaaaagacttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctgaaaataaccacggtctcgcattggaaatccatttttttgaaaatttccgcgaaaccttgagttttgaggcctgaagctcaactttgactgaaatgcattttcaatagagctcccttcgcgctgaagctttctttcttcgtgagattccaacgagctcattagttgctgaattgtgagagtcgacaagtctttcgactcctcaatagcagcaacaatgtactcgtatttttcaggcagactgattaaaatttcctccacaaccttctggtcgtttatatcttcaccatagaggcgtatctgattaacgatctcaataactcttgagaaatagtcttttaccttctctgactccttcattagcaaattctgaaattgtcttctcaaggtttgaagcttcaccgcaagtaccttctgagatccttgaaactcctccttcaacttgtcccatgcttccttggatttcttggcgccaataatacgcggaaatagactttccgcaactccttgttggatcaagaacaaggccttggcgtccgacatccgatcctctgccaaagactttttctgttccgccgtaagagtttctccagcggaatactcttgatagccattctcaacaatatcccacaatccttgagatagcagcagcgtccgcatcttgatgctccatatatcataattttctcctgcaaatacaggaaccatagactgcgccattgtggcgcccgaacttgaagccatacttgtagcttcaattgacaataccgatacgccgtgctactccgtcacgccctactcgaacctgggcgctctgataccagttgttgttgttgattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactcacaaagaacatattattgtctacactactctagaaatttcacagaggaaggacttgctccttgacttttgtttcatgagtagtagagagagttagagagtaggctggtatgttctagaaataaattaactccaacaggctgtacgtgccgttgggcttcgtgaacgccgagaagctatcggaattcggccatcagaatgtcattgggttctagtgatcaggactgtgatcacaagcaccaacgcattcggacttggacctaggactcggattcggcctatgttttcaactcgataagtcggaaaaaaaatgttttgactccattctaaaatatatataccgacacagttactacctccgtcctagaattcttatcgctttgagttttttttttttaatttttgatttttcgtcttattcaaaaaaattatggaatttttatttattttatttgtgatttgctttattatttaaaatactttaattatgacttcttcgtttttatatttacactaatttttcaaataagatgaaagatcaaacgttataagaaaaaaagttaaagcgactactaatttgagacggaggtagtaccttttttcaaagttctttagcgtttattacctgcagggtactgtagaataggtcccacggtaaaccgaaagacctgaggcccgatggcccggctcatggcacgagattttggcccagtccaagcacagcacgacctttaattagaccatgtttgggcctctgcctcggcatgataggccaatccggtatgacccagtccaacgattagagagttaagtagttgagggagccaaaaataaacttattctagccatataaggtatgtcccaaagagacgaggaatgcaaaataaacttattccaaacatataagagacggcacaaagagattagggagccaaagttttttcaagaaggagcaccgtaggctttcatgtcttcgggtcggcccggcacgacccaagtcttattgggctgtgcctgggctgatggtgcagcaagtgagtgggcacggcctagccctgcgtgtaggtcaggccgtgtcggtccgggcggcctatttggccatctatagaaaaaaaaactagaaaacttagcgcggctttgccgtgcccttacgataaacgggtacaaagcaaaagcatcaaataaatatgagaatttttaccattcttgaggaggtaccaagaggtaccaggtaccaggtaccaggaggtgccactcacatctaaccgtcgatctcagaggggtaggattggaaccggttaaacgggatgtagcttatcgtctccgccctcccagtatggaatgctgagctgcacatatactccctccgggttaataatacttgtcgttttggagaagggcacggtctccaaaaagtaactttgacaattattttctattataatatatatagaaatatcaacaaatatatggtttgtttgaagtactttttaagactaatctacacatatggtttttatatttttaagataaatattttagaaattatttgtagtcaaagattttaaagtttgactttacccttatccaaaacgactaatattatcagtccggagggagtatcttcttggggattcctagttggtgcgtgcgtgtcagcaacgcgcacgcggcccaacccttgtgcgacaacccacgattaacgttgtaattagcgccataactagttttgatttctcggtaatttgccgtgtcctaattttttaattttttttaagtaacagactaaaaacagatctacacgtgaagtcaaattttgaaaactttcaatctagatttaaaaacttttcaactcgaaatttgaatttttgaaatcaaaatttgaaaactttcaacttctcatctcaaatttgaaaaactttcaactagggtttgaaaactttcaactcgagatttgaaaactttcaactcgagattttgaaaactttcaactcaagagcaactcgagattttaaaaactttcaactcggattcgaaaactttcaagtcgagatttaaaaatttttaaattaattaagatttaaaaattttcaagtacagtcaatatttaaaaactttcaacacaaaaaattgaaaacacttgctgctggaagattaaaaagtagtgggaaaaaacgcaaaaaaaaagggaaagcgaaaaaaatcacggaaaaaagaaagcagaaaataagaagattaaaaaagtaataagaaaaaagcgaaaaaaagatgagctgcgcgaaaaaaagtaagattaaaaagtattaagaaaaaacgcaaaaaaaaaggaaagcgaaaaaatatcaagcgagaaaaaagagaaaaggaacagatgggctgcgtgaggggtgggccgcgtgcgagcatgggccaggaacacgcgttgatagtgcgtacgcgctaattaggaaaattgtatcttcttggctgtgtgaggcagcattaacaaattgagtgaatatgcaatgttcaggaaattccaaaatcatctaatggcttaatgcaacgacaattattttgatctacagtgtcagaaggcaatataatttgataagttaatttggacctcaaaatagcatgagttacttcgtattcactgccaaactgcatgcaaaaaataaacgtataacatgtcttggtcagaaattggtgtggggatgaaagctatatataacaaaaaatggcagcggctctgagcctctgatacttcctaagataaagagcatatgatttcagttattggtcactgcaagtataacaagtacataagtggttaataaaccctatcatcagttaattatgcttaaagtcatgcatattaaccatgaacacagtacatcagaataagaaaaaaagaagaattaaacttgttccgaagagcaagagatctcgtcaaaacatcaactcccttcgcagcgcttccttggttattaagtgatgccaacttgatttctttctcccgaaggttcatataacggaaaaaaaagtgaatacaccccccttatctactacttaaaatgttagtaatggtggtgtctatttccaaccacccctagcattgatatgtaggcttcacaatctatactattacattacctctcgaaaagtcctttcccgtttcactattgactcttctcaaacttcaaaatcacgtacttattcaataagaaaaattatagtattactaggactaaataagtgctcattaattgatttaataaggtaaaaacttaatgtgttttctgttgcaacgcaccagctctaggctagtcgaatataaacatttgcatgttataggtggaaatgaaaagtatacagcttcatgttggtagttccttcaccaattggaggctcttctactgtaacctgccatatgcgtacattctgatgtcttcatccacaattcctgccatggagaacaaatcaatttcactaatccatgaacaattgagcagatgaagaaccagggatatcaaacatgaccgctgaatcaaaaatccattcatcttgctgaatctaaatcgattgattctacttctgtttttgcattgagcaactgatgaacacattctttctccctcaattccttcatcaccttggctgccacgccttctccctccacatagcaacctgaaccaaatcaccaagaaacaagcatcaacccaagtcaaaaggaataaccaaacacgagattcaccaaatgggaacagcaccgctcgccatagcgttgagtttctggatcctatcgtgctgctcgtcgagcaccctgtcgagggaggtggccttctactccagccggtcaacctcggcgacgagctcttccgggtcggccccggcccgcgcatcgggctcctgccgccgtgccgcgtgggaggagccgacctgtgtggggcacggcacgctccggtgacctggaagaagaggcaggtcgggtgtgggcgacgccacacggctacttgcagatggggcaggtgatgagtgaacttattctcctctctcgggcagtactccagccattgctccaggctgcccaagattaaaccatcatcattcggaaatcgattcgaagaataaggagaaatttcataatataccattcaattcgcagcaccatcaggaattaccacctaattcgtagcactttcagaacataccactgagaacgcgaattgttccattccgtgacactccgtcccttcgcaagtcacgccgccccgacgcccttcatgtgtcgtccatcccttcatcttccgtcgctgtcgagcttctcctctcccacgccggcagctcctcctccccacgccgtccttcccctccccacccggcggctcctcctccccacgtcggcggctcctccccacaccggcgagccccacgccggcggcacctccccacgccggcgaacttctcccaacacatgccggcaatctccccacaccggcgagatcttacccccatgccgacaagcttctcctccgcactgccggcaagctcttcctctccgcggtggagcttctcctcgcgcatgtccccatcctcacaacgccggcaaacctcgacggctggatccacatcagccaccgccggcgctcgtcgtcccctcgttgcctcccgcaaggtgatgttgctcctgccgacgtggggaggagccgccggcatggggaggaggagaagctcgccggcggcggaagatgaaggggatggacggcgcgtgaagggtgtcggggcggtgtgacttgcgaagggacggagtgtcacggaatggaacaattcgcgtcctcagtggtatgttctgaaattgctgcgaattgggtggtaattcctgatggtgctgcgaattgaatggtatattctgaaaattctcaagaataagaggatgaaatggatttgggatggagggcgaaccacaggatgtggaagatgtgactccccgccaacggatccaaactccctgccaccgtagccacatcttttcgtcgccgaggtgcccacgaaaccatggtaagtggaggcaaaggggataaaggtgcggcggggagaggaggtcatggcggcggcgaggcaagagaggaggaaaccgagtgaagtgggaatttgggattgactgattttgaaaaaaaaaaaaccctcaaacttcgtatatacaacaaggtccaccgcagcgatctctcaccgttgatctaagctggaatcgcgcagggccacgtggaggggctatttgcacgtggatccgcatagatttcgatatttagagattcacagtgtcctaccgagagctaacggtgggacccacagaataaacgatcacactttctctttttttttccacctcaatcccttctcttgcatgttctgacaagtgggacaaacaattactccagtttattccataacaccggttgcttcggctaggatcgactcttctcttctcagcacatgttattt

SEQ ID NO: 63562 - DNA, 663 bp, Oryza sativa
tggatcgacgaagcgggcaccacgcgcgtgacggcgtggaggtgaagacggccccaccgccctggaaccaaaaaatttttagggggggttgggaagggtttttggtcgggtgatcaccgcaaaacgcaacgcaaggaggcggcgggggggatggctcataccttggcgcagggtccaggggacgagtacggcaggaggcgggccaccggcgaagagacggcgtggcgacggcgaaggacggcgcggagcgcggcggccatggcgtcgccgcgagggttttgggtttgctcgcgtctcgtctccacccactccggtgaagcgtacgaaggaagcgtctgtggactgcgtgtagtgcaatgaatggaagaaggcaataagccaagggagtctttatgggccgggccgggcctggctcagtgttggaaatgtaaaggaaagccactgaaagcaaaatgctttcagtttttttttttttggagaaacaaaatgctttcatgtttgtgtgccattactagaaacttatattgctcatctaataaagtttatacaaaatgctttcttgtatttgggttgatgaaccccctggctatattctaaatcatctggtaaatgatgtaacaattttatcatatcaataaagctagccgaatggcgggtaccgag

SEQ ID NO: 63563 - DNA, 1710 bp, Oryza sativa
ggggacagccgcggcggtggcgggggacagcgacggtagcggtgggggatgggcgcggcggcggcgattgaggcgacagggggacgggtgcggcgacggcagcggtagcgggggatagacgcggcggcggcggcagcggcgtcgacgggggacgggcacacggcggcggtggaggcgacgagggacggacgcggcagcaacgggggacgcgaatcgcgtttatgaagaggagctatcccgttgggggacggtatcccgtccctagcattcccgtataattaattcagtattaatttataaaattttgatgaataaatttgttggatttttttaagcaatttaattttcacacgaaacaccgtttagcagtttaaaaaatgtgttaatgaaaaatgatgaatagctaatccaaactactccttccgtttcacaatgtaagactttctagcattgctcacatttatatagatgctaacgaatttagacattattatatatatataaattcattagcatctatataagataatgctataaagtttccattgcgaaatggatgaagtaggtacgaagaacgcagccttcggcccgcatcaccgcggtgaaggcgaagcatgggcttttatcggcctttccaaccgtttcgtcttggaccgtcgtctgcaagccgcgagaccggcccggaaaggtggagggggccacgcacgcgccacgcgcggttcacttcacagttcacacgtcgctcgcgccgtctcagcgtggcagtttcggcgcggcgcggcgcagcgcagcgcggggagagcagcgagcacgggaaaaaaaatggtgggaaaagcagtacagtacagtaggagcgcgaaaccgaggggaaaactcgaaacgtctcccgcgctgctgctcttggatttcatcctcatcttcttcatctccttccttcctcttcccccatcgcgcgctctcgaatccggtgttccgctctccgctcctcggctcgcggcgtctcgattcggagtttggtggaagggggagagagagagagagagagagagaaccctaggcggcggcggcggcggcggcggcgacgacgtcatggagacggagcccttcgatgaggcggagctcctcgcgctcccggcttcccccgtcgcatcgcctccccgccggctcaagcggctgaagaagtcgtcccagatcgccaccgccgcccaccccgtcgtcggatccccacctccaccatctccgccgccgccgccgccgttggacgaggaaaccctagctcagttcccttccccgcccactaacccctccccacctccgccgccgccgctggatgcggatgcggctgcggaagctgctccctcccctgcactgacctctcctcctcccaacccgagctcctcgccgctgccaccgacagataccaccgaggaggaggaggaggaggaggaggatgacgggctggacccgctgttctcggagaccttcggcgccgcggggtgggacccgctggggatgccgaggatggaaggggagggcgacgaggaggagatgctgggtggagggctcatcgaggagctgcgcagggagaagtcggcgaagaagcggctcgacatggacgagggcgaagaaggcggcggcgaaatcgccatggatgccgaggtcaaggggaagcggagcaagaggaggaagaaggatgaggcgcccaaggac

SEQ ID NO: 63564 - DNA, 11346 bp, Oryza sativa
acataaatgatcattagattttgccccaactaaccactatggtcttgtccaagtttcacattaactccaagttgcatctttgacattgatttcaaacaaaagggtatacctatataagataattaaacaatcatgacgacacatatctactcataatctttgtatgataaagttaggtatttaaaaacataaaaaatggtcagataaaaaactttggccacatgcttcctttgataacaattgtttatgattcagaaatagtgttgaatttcagcagaactaatatgatacaagattgttttttaactgtatgtcaactaatatctgctcaagttagtttcaaaagatttaataagggttgtaggatggggtatttggaagttatcttgactcttttattcccaatggttttatatgatcctcaggtatttcgtgcttcaaacattactgttgacatggatcttgtgcgccaagttgaggccaagtatcctgcatttctttttaagcaacaacttacagcttttgtggaaggcttatatggaatgatccgtgataatgtgaagagagatatatcttcagtactcacacttattattcaggttaccccatctatcacgagtcatccgcaggttaaaaattatttcgtattttaaacattttttgtggtaccattatgggtctgagaataagtatacttctttggaatcttgatgcgcaagctagcattgcaagttgagaactagagtactaagatgattttaggtcgatcaaatttgtcttgttccccttagtagaacgcttgaaccctttgcacgcaaagtttgaagaaaatcataatgtcgttatatgatgtgcactattgtgcacttgtgctttgagtttttcttggttattgattaggttgtcatatagattttgaagcttcatgatagttgtataccctttttctcaatgagtgttaattatatatctaaacttaatgtcaagcagttatttatgttcctagtctaatgtcgattcttgtatgatattgaacacaccaagaagtgccaaagctggtttattaacagatcaaggtaacaattggcaagcaatagtcaatcatttgaatgacctcctgaaaaccttacaagaaaattgtgtaagtgttaatgtgcatatcggaattgcatttggttacgttgtatcttgatttttgatcactgtgctgaaatttcaggtcccatcaatttttgctcggaagatatttacgcaaatattctcattcatcaacgctcaactcttcaataggtgatttactgctgtctggatttttaattcccttttccaaatgttttctcattttcctggtactatgttctagccttcttgtacgccgagagtgttgttccttcagcaatggagaatatgtaaaacaagggctgcaagaactggaagcatggtgtacacaagccaagccagaggtaagcaaaaacatgttattttgctagtattctttttcaagatacacactttgtggtatgacattattctcatgtactttgtttaaatgccatcaactatataattcatacatgaaagatttgtgcatgtattgtttgacatattgtattaggggtgatcataattaccaaacatcgaacctaattgatctgaaccaataccgaacttaagtgaaaaccaagcaaaaaaaaacaatgaaataattcggtttttttttctaaaatttggttttcgaattacatcatcaccagttcactaatgtcttgcatgacctttacattttatctatttaagaaagcatcatatggattcaacactatctgttagtataaaaattattccatattacaatcatattgtgttgttagtatcttttcagtttttttccttgtgcagtcgtacctaactgagacactaacagtatgcaggatctgcgtgggatgaacttaagcatataagccaggctgttggtttcttggtatgtaactccaaacttaaacatgtggggcgttattaattactattatatatgtgaaaaaaataaaactgatgtaatgcatggctgattttgaatgatgtacacatgatctttcatagacaaaactaccttcttacatggggtttcttgttgtattttgtggtgcgctataggtcatcttcaaaaagttcaggatttcatacgacgaaataatcaatgatctgtgcacggtaagaccgcccctccctccaaactctcacatgaaaaaaagaaaagaaaggggatgtaggtgaagatgaaattaaacccattggcattattatatatgcaggcactgagtgttcaacaactttacaaaatatgcacgcagtactgggatgacaaatataatactgaaagtgtatcggaagaggtgagcagtagatgcaactaattaatataatgcatgccggttgagtacttgagttaccctttgcaaaacgattcaagatgaaggaataagacgtgcatgaaggtagtcgttggtgtgttgaaaatattttgacgagcatcgatgcttggttgattgtacataggtcctaaatgagatgaaaacattgatgaatggaaaggatgcttcggatggtaccttgaaatcattgatgaatgaaaaggatgcttcggatggtacctttttattaaatgaggagataaggtacgtactcaaatataacatatagctagagttttactagtactaccttcgttttctaatacaggatgtcattaactttttttaaaacgtttgattatttgtcttattcaaatttttttgcaaatataagaaaatttaagtcatggttaaagaacatttgacaataaatcaagtcacaataaaataaatgaaaattacatgttttttttcaataagacagaatagccaaacatatatttaaaaagtcaacagcgtcatatattaaataacggagggagttctattttgttgtgttttgtccgtgctgaaaatgaaaagtggatcgaaggaggttgaattaattagtttggagattattaacatgcagcatgccgttatcattggaggagataggcgattcaatggatgccaaggaatttcagaatgtggttccacctcaacaactccttgacaaccccgcgttccaattcttgaagagctgatatatactatattacggtccagctagcaatcgctgtaaattagtgtaggtttccaacatgttatttttagtatagcgatctctaggccggttgggttgggttggtggtgtgtaaggtgcacccacattctttataggcatcatatgcagctgacattgtttctttgtgtaagtaaggtatttaattactaggtactgtacacgtagggggatcatagaatagagagagagagagtcatatgtactactaaaactagctgacgagtaatttgtagtttgtacacacagacaaatagtcccgatggatgatatatgatgaatgcatcatgtgaatatatatatacgtacatacatatatactgtaattaattaaagtagtacgagtccgaaggtacggagcatatctgtaagaaattaagaaaaaaaattaatgtggtggagatgaaggaggagggatcctgaagtggtggagcgcggatcggccgtcgaggcctttggctctgtaatgcgagaggaactccggcatggtggtgctcctgtagagcggtggcggcggcgtggtggtgacgggggcgtacaccctggtgcaggcgtagtcgggacggaagaagcaggcgacggagaggcgaggctccgcggcggcggtggttgccaacacccggtgctccacgcttcggaagaggtcgttggacactagctggaggaggtcgccgatgttgaccaccagagcgccggccaccggagggacgtccacccaccgctggcgctgcctcatgagcacctgcaggcccttgctctcctgcagcagcactgtcaggaagctggggtcggagtggcgtgtggtgcccagcgtcaggtgcggctccgggcatggcgggtagtagtgcgctgccatggtagccagccccccaccgaggccgccgaggtactccggcgggagccccagcgcctccgacagcagctccaacagcgccccgcccagcctctgcaccgcctccacgtactcccccaccacgcccctgcacgccggtgggatctcctccgctgccggccccggccgtggcgtcagctccagcaacagcgtgtcacgccagttggcggccggcgactggaacaggtcgaaattggagttgaacttcaccctccgcccgctgtccctgctgtaccaggctttcttgccctccgccggctgctcgttgaaccgccgcaccgccgccagcatctcctccaggagctcgccggggatgccgtggttcaccacctggaagaaccccacacactgggcggccgccctcacctgaccaaccagatggcctcggtcaacgtccgcctgcagatcgatcaccgggataacatccgcatcctcctccgcatcgtccagtagcagcgggtggtggtggaagatggcggggatggttgtgacgccggcatcgacgaggcccttcacgccggcctttgtgtcgtcgaaggcctggaggtcgcgtagccggtcggagccggagctgctgcccatcgatcgatgacctgatctatccattccagagaggcagggacacactaatccaatccaatccaatcgattcgatgcgataccgattatacagtttactacttgtagttgtagaaaggaagggagggactgccggctatgccagaaatgggccgggtttcgtccaaatgttgtttcctattaggaataagtttaacttatgtccctcaattatcgccaagacttatactcgtccctaaaccgcaatatcagatatggcgtgtccctcaactcctaaaaccgtgcaaataaggtccaagaaggtttggagtgtgatttcgactaatgtggtacctacacggtattaacatggcacttaaagttagaaaaaaccatatatatgacccacatatcagctactgttcagttaaaaactagaaaaattatagtgagacccatgtctcctccccaagctcccagtctcctccgttcgtcagcaattgcatctccgacggcagcgaaggagtcttcctcccttacccacaatgcgagcttgtggtggtgatggattcctagccgcaacccccctccccctggctctctggcgttgccatgacgacggtgtagccgagaatgcttgacacccggtagcagttcgatcatgacaagacgtcggccgacatgatgtcatggctcaagatgttcttgccatagcatagcaggaggccgtactagtaccggaggaggatccagcgacttggaggcgggacccatgcaacaacggaggagacggggacagggagattgggttggaagaggagacctgggtctcgctgatttatttttttaattttaaccatacagttgtcgacgtttggtgtcgcaattcaggtatttgcatagtatggggatcgtcgatgctaggatatacgcgagactgaggtaaaagagacggagacagagatttttatataggttcgggcccctgagttgtcaagtaataaccctacatcctgttggccgaagccggtattgctcttattcaccataatcacaccagtacaatatgtgggtagcctatctaactgttgtcgacatgtcggtctgaaggtctgtaacgctccgctttttgtgaggcgttaaaaactaattcggcaaaatcctaatttcaaaaattccgttccttgtgtgcgaatctaagtcgtgccgtggatctcagtttaaatctatcgttgttccctctcgtcgccatcaaaatcctccacctctaaaatgtcaaccccaattcatcttccaaagtcaaacatcgaaattcaatcgcatccttcgaattcccgccaaatacctgtccccatttccgaaaatatcaaattcccatctcgaatcctttccttgattcctccctaaaccctcgactttgaatatcgaatttgaatccaaatccaaacttcaaatctcaataaaccagcctcctctgtgaaagtctaaatcgcctccctcaagttttgtgggccgattttgtccccctcggcccatctctctctcagccgtcccctccctcctccgcacgtgcgccgcacgcgcgtgtgctgagccgacgccgagctgagttctctctctctcgttctctcgatctctctccccgtttcactccctcccggcgacgatctcccgcccgcgagtttgaaatcggcgccgttgcttcacgcgcgcgcgcccgcgcggtcaccgccgtggtcagccgcctgcgccacgctgccgctcggccccgctgcctgccgcgagctctgcagcgcgtgcccaagccgctccacccacgtccgtccaaaactgagaagcagagccctctctctcccgcttctctccctcccgaaatcggcatggagcaaagccccctttccaccaccctatctccctttttccctcttcggttcgacctctctctctcccgcccctgttcgcttgcgcttggaggcagagacgctgacaccggtgcgccagttcgccgcccccaccttgactgcgccgagctgcccctcccccgctcgcgaatcaatttccaccgcccgatccaccgccttcgccgctctttgcatcctcgtcgtccgccgctcttgcgtcgcccgtgaccgccgccgagcgctcaaccgccaagtcggtttccacctccccaaaccgacctcgccttcgctataaaaacccgagcccctcccatcgaatccttctctcgtttcacttccatcaccgccgcgccattgttgttgctcgccccgctctcgccctcgccgtccgccaccgagcaccggaggagccagtgcgtgcgtggacgcgtgacgaggagctccaggctgcccattgccacctctccctcccttcttccccggccgtgcaccctcggtgccgcgccgccccgccgtcgcgtccacctcgccgcgactccatccgcgccgccaacgccgtttatctcgttggtgagctccccaccgaaccacttccccttgtcgcacgccgcgccatgcccgccgccgttcgccacagctcgccctcgcacctccttggctcgcgtggtagctcggctagcctctcgaatgcgcgtagacgccgtcccaggtctcgccgccgcctggcatggcctcgccgccattgtcgcccgctcccggagaccgccgtcgacgctggccctcctcggtgctcctccaccctatccggagccggaaacgggatccccgactcccagagatactcccaccaccttgaattgaatccttgtcgcccctccgccgtttccctcttttttctcaccgccagcgcgcgccgccgcaatccgccgctgtcggcctttctctcgccgattccttgcgccgcgaccctccccgtgtccccttgaaccttcccaggctgccgccccagtcgccggcctccccacccactcccgcgccatgtcgccccttcagccgccgcatagcgccgccgcgagtttgaatgcggtgaccatcgggtcccgcgtcactgcgtgcgcgtcgcaacaccataccggttcggctaagcccgagcccgcgcgcccttcgctcttctcgcgcgcggccacgtcggcgtgccggcgagattggccgccgccgccggccgtcgtcgcgcgacgtcttcccgatccgagccgtggaatgagttccccttctcctcctcctgccgccggtgcctgccgcccactccggttcaccgccgttcgtcggcgcctctcggccgccgtgagccgtccgatccgggcgagctcggcctccctctctcgcgcttgcgtggcagccacctcagccgtcggccccacttgacctggtcaagccggcgcccagtcagccgccccactcctcctccctctctctctctctctctccgcgcgcctcttgggctgcctccttgtgcccgcgccggcccaatggctcggccgagcctccttcaaccctttgggccgcaccaatgccacccgaaacaagtctaatatacatccctccttgattttcctttccaaaaaggatttaatacatcctttttcctttgttccataaatcaattccttattccaaaattccatgtcccgcttgtcagttgtcacgccccgaactagtcctgaccggaactagcccgtgacgctccaaattaacctattaatcgataccagtcccaggaaacagtgctggtatcacagggagacagaatatcacagcaacagaggtctctttattatagagtagagatacagtcatgttgggctgcggacagatcccgagctcacaactgcattacaaaagggaaacggaagccaggacttggaccaaacaacacaggcgcggcttgggaactaggccgaaaccctaaaactcatcgtagccagcttgctcctggaagaactcctcatcagcaggatccgcttcatcttctttagcaactgggggagattatttatatagagcaagggtgagtacgggggtactcagcaagccatgggaaataagtgtttaatgcatgcttcaaggaaaggctgttgtttttgcaattgattttatttgaactcctttctgaaaacaactaagtgagtgcttctcaaacgacacggatgagacagtgcgtctcgtccggtcggagtatgtgcaatgtatcagtctttagaattgaatcaaggttggcacccggccaacagcttttcaaacagccacccgggccaacaactttcaaatggccacccgggcctagctgatcccatcagctgcagatctttcaaacatcgaacccctttccacaacagcaatttcacaagcagtagtcaaacaaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatgacaaggcattttcaaagccgacacaggtttaccatatgccgacgagaggggtcccagaccaacaacaggttaggtcccaaaccatactgtgccaggaagcccaggggtcctccccgacaccaccccggcggatccacatgtctctcggcatcaaggctcccctgataagctagttactcagctaggggtgtcccattccacccatgtggtcgtacttgtcttatgtttggatgaaattccaaggaaacggtccttaagtgcaagagcgggaaaccgtacacccggtacattccccggtccgcggttttggaaattcatttagttcgcaagcaccaacccaggtgtcgggttttccaagtcttttgtaaaaccaaagttttacccaagttgttaatcagattttaagttttgaaggcgtccgtcgatactcgcacagggtgcacgaatatcgagacgcaactagatggttacaaggggacatgatataacaattaacaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtctttgggctccgaaactacacgcgaaacgggacaactcaacaaacggcgaaaataaagccctattaatgacctctaagcgtgccattagatagatctcgagatttgaggaattttggaagttggacggagtcaaacggatttacggttgggaagatattgaatttctaagattattggatttttggtctaaaggaaaaggatttaattaaatcctttttggaaaagaaaagaaaagaaaagaaaagagggagggaatatagacttctcctcggtggctagggcgcggcccgagagaattggggcggtccggccgagctaaatgggccggccggcccaaggcgcgcgcgcgggagggaggagagagagccggtggaccgggctcaccgcgcgcggtcccgggtgggacccgcttgtcggtgactcggttcaccgtgcggagcgagcacgcggcgcacgcgcgcgggcggggctgcgacgcagtgcacgcgcgtggttcgcggaggaacggatgcggcgggcccacgcgcagcctcacggctcgcggtggaacgcgcgcacgggaggggctgaccggggtcggcccgacccgatctcggccgagttggcgccgacgtggcgcctacgtggctgccacgtgggctggcgagaggaagacgaaggcgccggccgcgaatggacggcgggcggcggcggtttctccggggcgccttgcgacgatgaggggcgacggggcgtacaccgggatgacgagggagaatgagagggagcgagccaacggcttggattcgccggagggagtccggcggcggcggatttcggtggcggcaaccggcggagtgcaaagggggaaacggcgacgaggtcacgaggagccaattcccggcggtgagagcatctacgcggctacgggaatccgttgctagcgtcggattgggcggagctacgccgagcgaggccggcgacgagcgggtgctacggagctcgggcagcgacggcggcgagcacacggcgagcgacggcaacggtcggggcggcgccggctagctacggggaggctactcatgctaccaccgaaaactaagggggagagatggagcgaggaggaagaacggagggaggcactaccgtgcgggcggggcgcagtgacgagaggccgacggcgcgggagtaatctctccggcctcgggccggggaagaggaaggagagggtgcgctcggagtccccttccgcgtccacgaatgaaccggctctcccggcgcttggcgatgaacggcggaggcgagacagagctcggaaggcggcggcaacaatggcgatgggaggagaagagagggagggcgcctgggctttaagggcggcaatgtcggtttggaaccgacttgggcggtcaaggcgcgagctggcgcttggcgctcgcgtccaatcggcgacagggcggagggaggatgacgccggcgggaggaaaagggaaaaggagggagagaaagggggctcgcccctttcttctttggg

SEQ ID NO: 63565 - DNA, 1647 bp, Oryza sativa
gcttagacgggaatacccaactttaaaatcctggctccgccactgcatgggttccacgtggaccccaaatgacagcagccaacccatcttcctcctctctctcttcccaacggatgcatgtccagggacatatgcgagtactgcgcgtccgcggtggcgatgccgtccaagaaggcgctggtatcgtgtatgaggcggagcgaactccgtgagcgggacctggcctaagcgtgttgaagcgtcacgctcaagagcggcttcatctcgtcatcgttcttgttccccaccacgcaccctctcatccttctacccgcagcgggccattgctctctagataagtcagcttcacctgcctctgcagcttcaaaactccaaaccacatatctagtttgaatcaacacattcaaaacctcaggttctgaaaattgcatatcaagatacatttgaaaccctgtgttgaattgaagaactatatcgatatgagcaattttaccatttaacatttgatacccaaaggtacgtaccacaaatttttggtacatcgagataccttctagtataaaatttagtacctcgaggtactttgtagtataaaatttagtacctcgaggttttaaaactttatatgcaaaatgtggtacctcgatgtaccaaatgttggatggtaaaattactctaccggtatacgtgtgcacattgcactacacactactcctctcacctcttgtactactacttcctgtttccctgcgaggcagaggaggaagagagacgcggaggacaccgtcgctcacccacccatcactcacctgccgcgcgcgtggccatgaggctccacgcgctctccgcatgttctcttttttctatccccttttaatgaggttatctttagtcaagataagtgctaaccaaatgaacacttcgagtttaactgaaattttaaattcacatcttcttgaaagggtaaccacttgtttctattttcattgcatcataaaatgatttgactgaaaacaaaatcccattttttgtgagtatcccaaccattttgtgtctctatgtagcaattaattggtagtactgtcacgaaccttataagatttgaattcagatcagacactttccctcgtgaaattgctaaagtggtattgtaaactttttttctaagacaagcttctatttcagaaaaaaaaagtgttttgggcattatgttgttacatcttcaggtgcatctggtagatgttgggctaaattctctccaattggagcctgtgtggcatcccagctaagggcttaatagaattaatagaatactcataccaacaagttgcaacttcttttccggaagccgattttgaaagaactctgagattaagcgtgcttggcctggagcaatttcgggataggtgaccgactgggaaatttttcccgggtgcgcacgagtgaggacaaagtgggcctcggagagtgtggggcatcacagatggtatcagagccgacccttgcaactatacgtatatatacgccgaaaattgtttgtatatacgtggtgctaataggggatgttcctggcctgggttgaccaacgaggacgtcggtatcttaaggggggtgagaatgtgacatcccggcacaggtcttaatagg

SEQ ID NO: 63566 - DNA, 4887 bp, Oryza sativa
  unsure (1)..(4887): unsure at all n locations
tcataaaacagtgtgcgattgaggtcaaaagaatcatctctgcagttagtacgatcaagcttcgaagcaaccacctcaagcgacttgaattaggagcccaacactatatccacatatgtgttccactccaactccccattcaaatctagcatgtacttgtgtgaaatgggtcttgctccaacatcatatctaccttgtatagctatagactgattgctccaccccagcacatcctttgtacgacaaactaactcctcaaaactaggttttccaccaaatataagttgcttaacactcatcccttcgaaattgctaccactgttactttgctctaccaccgaaccaccatagtgcaatcgtactaatctatccatctacaacattaaccgacatattagcatattgcatttcttaaaaacttgaatttgcaataagaaaaaatctaacctacaactatgtcccccaacgaaattgtccataaatatctaaacatacacaatcttccatttgtaacgatccattctaaatttgaactctcgccttgtgataaaaattttaaaaaaaagaagtgttcttcactaatttgggggaaaaattagggttcttccctaagggccaaaaatctccactaaaaattagggttctatgagcatctaaccattgcatcaccaataacaactacaaccacagagtagagaaccaactaatttgggaaaataacctcaaatcacgattctagggttcatccatcaatgagcaaatccaagcaaaaaattgcgaaatgacgagaggattcggaggagaataccttgccactatgtcctccaacaatttcccctccaaaatgcgacgatttagtggagattttttcgattttttggaggggaggagagagatggttcggcgccgctgcgcctcagccgagagccactgaggaggaagaaagaagggccgggctgctgggcgcggctcggccaagggatgtaggacctcagcgccagacccgatggcgctgaggtcctgaaacacagcgccaatgcggtcggcgctgacattgtgccgttccgtccatcctcgtcttagggccgttacgtactcagcgctgatgcggtcggtgctgaggtgttcaagctcagcgccatcgaccatggcgctgaggtcggggtacgtccaaatctagtgatagtttttgccagggaccaaatttgcaaatagttttcaaaaagggccaaattgtcaaattttcggcaaattagtcgcctgctttcatctctctctcctcaattctctttttttcacgtaagaaaagaatgttgtggatctttttggagcctgccgagtcatcttattgtacctgctctaaactggttcattaattcactactgaatacgtggacagatttactcggtacacaccactgaattcacacgttcatcggacgatgaactttaaatcaaatcaagtattgagaaaggattcaaggaattagacaacaattttagagtaaggataatccctccgctgacgttgcctttgtcgccctacgtcgctccgtcatcttctgccggcgttgcctccgtcgttcgcaacagcgattcgtacaaggtacaaactgattgataaagcattcgtccgtcattgaaccctaaaaatcctcaccatcgctttgagaatactacgttttaccatcctgcatgtcaactctgcagggtatccgtgcagaaaaagaactaaaaaatttcggcaactagcacagacacccatctggcacaaactcactagcaaaaaaattagaatgttttggccaaagtgtgtatttcctcctgccttcatattccacttttgaagtagatccgatctaaccttcaatttctcggttgaggattctctaccataatgtcactatcattacagtcactggtacgtgggtctcacccttttattgccccacatatttatgtctatagtgatagtgccattatgatagagaatgtgaaaccccaatttctcatacccttcggcccggaattgcttccattattcagattgttgaattcttgctttgcttggatacttggagttggaggttgtctgaagattccttctgatgctcatcatcagttcgtcactttgtcatcagaagcctcgatcccatcgtacgttcctaacatgaagaattctattgtttgaagagtgataagacaacgcaaccaaatcggagattgagatagataggatggtttatctggaagcgttcccacgaatcgatcgagtgctcgccggagcttggcggcttcctcgatcgtcgtcatgctgtcatctggcaaaggaccccggaggtcgacgacaggagaggcgacgcgggacgacgaaggcaacggcggcgacggacgatgggtgcggttgagccgactccggtccgcctgggagccgagccgagaacgctcaagccgttggattatttgggtgaacacgtgccgcgtatcgggcacaggtatgcacaagagcccatttggagccgatcgatcggggccctctccattggactccgacgcgtccgtgtcgtttcgtgtaatccgactccgacgctgtctcgtcatccggccgccctatatcttgcgccgcgtgtagtgcatctctcccgcctggtcgatctcctcttctagctcgctcggcaatcagcctcaaatccatcacccaagcccaccttaataagataagccttcgtatttacttaatgataaatcaagctacaataaaaaaaacatatttactttatttttttaataaaacaaatggtcaaacatgaataaaaatcaacaacatcatatattaaaaaattaaggtacaatatatactctcatttaatttgttttcgacagtacaacaaacttgcatagttgcatgagacatgaatagttgaatactccatccgtttcatattataaattatttgactttttttctagtcaaccaaatttatagaaaaacttagcaacatgtaaaatatgaaattagtttcattaaatctaatattgaatatatattttaataatatgtttgttttctattgaaaatactattatattttttctataaacttggacaaactgaaataagtttgattaggaaaagagacaaacaacttataatataaaacggaggggaatactttacatatataaattgttactccctccgtccctaaatatttgacaccgttgattttttttaaacatgtttgaccgttcttcttattcaaaaacttttgtaaaacatgtaaaactatatgtatacataaaagtatatttaataataaatcaaatgatagaaaaataattaataattacttaaattttttaaataagacaaacggtcaaacatgtttaaaaaagtctacggtgtcaaatatttagggacgaatggagtattacgttgtaatagttcataacacaaatatgtcacattcaataccacctgtcaaatttgcctaaccttagacatggcaaactgtggcaaagtgtggcttgcaaccaaacacacccctagtatgcctgtagttcacaacaacgaagaagtggagacatcgtaggagtatttgttgcacatgtgatgcgtggggtgaggatgacacattgagaccggcaattcttcatggcacagtttaatttgaataatggtcatcgatcaatgtcgtcgttgatgctcccgacggcagcctcctccttttcggcgccgccgtcgtcactgtacctcgatgcatgacatcaccatcaatgtcttcgtcatcatcacctcatcagtttcgtcgtcgccgacctccttgtcatgcgggtgggcgcgggcgcggaagacaacgcgtcgaacaggtcaccagcgcccgcgctggtgatcatcttcatcaggctgcactgcagcatgtccagagccgacatggccgagtgcgcggcgatgtcgccgtacgtctgctgccagctgacgtgacattattttgactgataaataagatccatttaatattttttcttttcctttttcttcttttcttctcgtattttattttttttcttttcttattctttctctgtgaactaagcagaagaaaggaaaaaaaaaaaagaatgagtcgttgtgcttccggcgcgttcgtgggtgacgcgcgcgtgcggacgacgaatcctgtttgatctcggcacggcacattttactcatcgaggactctggttggtatcgtcccttgaactactacgagacgaacgatacataaagcgcagccatggaaggaaacaaccgaagaagtacgcgacatgcacacgtcgagatgatcaccgccgccgccgccgcggagcagcatctgccggacgacctgctccgggacatcctgctccgcctgccgccgcgcagcgccacccgctgcctcgccgtgtgcaagggctggcgctccctcgtctccgacccgagcttccgccgcgcccacgccgagcgccccgccggcatcgccgaggccgaccacacgttttgcctccgacaagacggcgactggaccttccagcaaaggctccgcgaggtcgtgctcttcgactcgttccgcagcagatggtgccgcggcgacgtccgcaaggcgccgccgctcgacctcacgctgatcccctcgccctacgccccggcggcgaccatggtcctcggctcctgagacggcgtgctctgagtcgagcgcggcgctcctccgctccggagactccgctggcgcttgttcggctggccagacgacgaaagcgggcgcaggggctacgtgctgtggcatccgttcgacatggcgtgcgccacagtatatccaccgaccggccgcggcggggtaccagctngaatatcaacaattttttctt

SEQ ID NO: 63567 - DNA, 14274 bp, Oryza sativa
gcacttgcatatttgctgtgtgccttgctgagtatgtcatatgctcacctggcaataaccaatcaccgtcagttgaagaaaaaggatccacagggagaagtcgtttggcttatacaccagttgacctgcctgtgggagtggagccggagcttcgctagattttattttccgctgcagttttcttcttgatgaggactaagtgcctcataagtaagtatttatcgttttagttaatttgatgaatctgtatattaaattgtcagtttgtgtacctcggttgattcctggacgaggattttatgcacaaattagttcggaaattactagtgaatttccgggcgtgacaagttggtatcagagccatctcgactgtaggataagccaagtggtcaaaccttaaggactaattttccgaaaacataatttgtgaaaaattttcctttcttccttatctagaattctttgcaaattgtttcattgtctactctcctctctcgttcaacttgagtagttctgaaactagtggttgaaacctgaagacgccaatgaggtctacttgtagaggtcagtaaagtggatcgaggaaggaccgaagtgcccagatgtcaagatagaatgaagttggcatcctaccttagaacctatgccgccaaagtgtctttgaagaatagttagtagggtagaacgtttgttgtttgttttgtgtgtaggtatagttgcattggagtagttcattgatgagtgtgtgactatactaggttgcttgcttaatcaacttgaacaatataatgaactacacacaccagatcagtggtaacctggttaaggtcttgtctttagtgtaacctctctcctcctatcttctctaatctgcaacagatggtgaacactcgcgccagtggaagtggaaacaataacaatgaagagaacccaacctttgctcaagtgctggctcaacagacccaattgatcaacctgttagtgcaacaaatgcagaaccagcaagggaacaacaatgtcaatcctccgccgccccagaacaagttagttgattttcttcgtgtgaagccacctaccttctctagcactaccaacccagtggaagcaggtgattggttgcacgctgttgagaagaagttggaattgctccagtgcacggatcaggagaaagttgttttcgcttcacatcagttgcaaggatctgcttcggaatggtgggatcatttccggatgaacagagcagaaggacaaccaatcacttgggcggagttcactgaagcattcaagaagacacatatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagttcttggaaggcttaaaggatgagctgtcagttatgttgatctctcatgactatgaggattttcaggagttggttgacaaagcaattcgactggaagacaagaagaacaggatggataaccgtaaaaggaaaatgactgttttccaggaggcacaaggtagtcgccagagacagcgtatcgagccactccaaattggtgaatctttttccgctggtcaaggacagtcgcaacagttgaacatcggtggtgagatcgaatcagagactaatgaaagcaatgaagtaaacatcgagcaagctaatcaaccggtgccagttcagcaggatcagtctcaagagaataacagtagtggaagggagcagcaggtatgtttcaactgttacaagccaggtcactttgcaagagagtgtccgaagtcaaagcatcagcagccgcaaggtcaggtcaacaacattgtcgtcacaggagccaatgcagtgccagttgcgtcttcaagagttgcgttctcaagggatacagctcagccaccagtttcaaagcagcagtagttttctttaaagccttagaataattatcggagttatggaataataagatagactgcagtttacctatgcctttttctttctagccgttccgaatctcgggacgagattctttgtaaggggggtagatttgtcacaccctgattttcctcttaggatttataaattatttaataaattattaatagaatttatattaaatgttctttaatttacaagtaaatttaaatgtgggaaataaaattttctaaatataaagcatggatggatttaatttttattaaattctccatggttaattatactctctggaattttctcggatttttcggagctcaattattaattttaatcatacaaagagaagttcagcaattatttaaatattaaattaatcatcaaatgatctaattataattgttaagtgattttcttgtttaaaaatccttaaattataaattgttgtttaaaaggaattattagaaatgattttaaaagcttaaaagagaagatctaattttaatttgctaaatctcaatataaaattgggttagataaaattttattaaatactatgcttgctcctctattttctagatttttctgggaattatttgagcaatggaagtatttttaataaatgaaacatcatttcacaatttatttttattgaaaaagttcaaaaagcccttccttagttgttgggccgaattcggcccaactctctttctctctccgcgcggccgaacaggcccatttggcccagccgagccggccgccctcctctctctcgtgtcaccgacatgtggggcccacatgtcggtagcatcttctacctccagccgccggcacaggccgagcccaagccgtcgcccgagccgctttcttctcctctcaaatccgctccaatccggcctcttttcttccggatttttgaggggttttgatcctctcgttctcctctatctcttcccccaagttttggagcaaatcgttgtgtatcttgttcgaatcaaactcgttttcgagtttatctccaaaaccgagttttgattttctcggatcgattcctcttgtttggagcccgatctcttcaatccaaggctatataaagcatcccctcgtcgccctctttcgtttgccccctctctcgtcctctcccgtgcaccgtagcgccgccgccgcgtgcacttagccgccgccgtcgccggccggtcttcggtcgcgtcgcgtcgtcgcctccgccgtcgccgccgcttgctgtcgccgccgttaggtacgccgtggtgaggagaaccccggccgccacctctctttcgccgccggccgccacagctcgccgtcgccgttcaaccgagccgccgccgtcgcccttctcgtcgccggccgtcgtcgttcgtcgtttgtcgtcgtggtgagtaccgtcgggttcgtctcgtcgtcctcttcgcgtaggtgctctccaatcgcccggccaaggtccctagctccggcgaggttgccgcccgagtcggccggccatggatgacgtcatgctgacatcatcgatctcctctttttcctttttttttaatagattaaatcttcggaaaatcatatctaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcttttgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttatttttgaatgtcaccgggtggtgtgaacctattcctttgttatggccaatttgcattgaatgccctattccttgataccttgggtaataaattgagtagcttgaaccttatgtattggtttggttcagctaaatgttatatatataattgcttagcaatgcttagaaacattagctcactaatgggatgagtcatatatactacattattatttatggttacattaaatggtagctcacgatggttaatcgtgtgatgataattaattgataattaaaacctggttaaggtgggttgtgagcatatggttttgacggttgtgctcatgacaattaaggaccggttcgcgagctactgttgtgaaacattaaccgtaccaaccacaagccagcatgggcaacggctttaccttttgtatagcatgattcattgcggggtgccagactgagaagcggcgagaagtccgtgggggtcgctggggagtccatgcctctggttgtagagggggtgattatgatccaggaatggtgcactgtggtgagttgtgttatgcagagggtattgtcacagcctctattcgggtactttccagtatcgcgacgcatggtagacatgatgctgaggctgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtacggttgttcaggatggttgggcctgtgcagcatgggtgtgctgttcagtgttgattaaaatttctgattaattactccactgttttacttctcttaaatctttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgagagtggagccggagcttcgctagattttattttccgctgcagttttcttcttgatgaggactaagtgcctcataagtaggtatttatcgttttagttaatttgatgaatctgtatattaaattgttagtttgtgtacctcggttgattcctggacgaggattttatgcacaaattagttcggaaattactagtgaatttccgggcgtgacacctcttcctcgaatagaccaattggtgaactcaacagctagatgtgagttgttaagcttccttgatgcttactctggctaccaccaaatcagcatggcgaaagaggacgaggagaagacagcgttcatcacgccattcagcgtattctgttatgtcaaaatgccgtttagactgataaccgcgggaaacaccttccagctcacggtccaaagggcacttaatgaccagcttggaaacaatgtcgaggcctacgtccatgacattgttgtcaagacaaagacaagcgagtcattgatcgatgacctccggcaaacgttcgacaacctccgacgatatcgtctcatgctcaacccagagaagtgcacgttcggagtaccatcgggcaagctccttgtcacgcccggaagtttccccctttttcatgctttaaaattttgttaaataaatcgtctggagaaattgttttaattaacctagagatgagttccttaattaatgaatgcaattaataattggaattggcattgtgggatttttcttgagttccacatgtcacaatatattaacaggatttttagtggaattttcagagccttggaaataattttaaccaattaaaaatcaccaaagtgcaattttaaatcccacgaaaaatcctttcccctttttcccctttttcccttttcttttcctctttttccctcttcttgggccaacggctcagtccgcctccccttcctcccgcacgcgctcggccttcctcttgttgggccggcccatgcgcccctccctcctctccctgggtcaccgacaggtggggcccacctgtcggccccgtcttactcctccagccgcccacgccccaccgtcgaaaccgtcgctccccacgccgtcgtggccacgtcgctcctaccgcgcccacctcgtcgaccacctcctccacctctcccgcatcagcgcgcccgattagaggccgtgattcggtttgaatcctgtctctcctctctctctctcttcctccctactcccccacgtcgccggccaaatcgagagggttcccggccacgtcctcccctccctcgcctataaaatccttcccctgagccccctctctcgtttcccactctcgccgccccctcccgtgcctcctaccgagcccgcgccgcacgctgccgtcactagagccgtcgcttcgccgcgcaatcaccgcctttagcttcgccgccgcgagagctacctcggccgccgctcgctttccgtccgccgccgccgaaccccgattccctcgcatcgccggtgaggactacctctctctcctccttcctttcctctctctcccgtgcacgccgccgccctccgcacgtgcgtcgccgcgcttcggccatgcgccgccaccattcggccgtcgccgccgcttcgcgcgccgccggtcaccgccgtcggtggccgtgcctcgccgccgcctcgcctcggtcggccggtcggccttggggccgagccgagcccggctgacgcctcccccctcccttttctccccttcacgcgtgcgccgccgcctttggccgtgccgccgctccggccgtccgccgccgccttgtgcgccgtccgccgccgtctacccgcgccgccagtcaccgttggtggtcgtgtgccgttgccgctcgccatggccggccggccggctttgtgccgggccgagctatgcctagccaccgcccgcaccgtccgatcggcctcccgaccgatctggatcatcggtctcgtggaccggcggtggacaccccgcgtggtcccggtccacggtggaccggccgccttgtgccgctgacccatggggcccacttgccggcgccccctccctctctcttgagccgctgacacgcggagcccgcctgtcggcgcccccccttttgatgacgtcagccctgggtatttattgcgcaataaaaaattaaggactttttctttattagtaaaacacaatttatcttctaaaattcataagtaattcatccgagctccgtttaagtctatttaagtctcagtaaatcaagaaaaatgcaaagaatccattaaaaatggttttgtttcctgtttcagtagtcttatagcatgtttggcttgtgtgctttgtttgtcgcgtagatttcggccgtttcgtcgatccgcggtttctcgaagacgttgctgaggtctcatcagtgcgagagcaaggcaagtcatgcattacaattgatcatattgtacccaatttacaaatatcccgtatttctattaaatgttgcattcttttacaacgtcacgtgggatgggtcttattacttagccatttattgtttaccttatgccattgataacttgggtatcaaaatgactagatgttggtttagaaattgcttagccacgcctagctgaactagtacacaaatggggatcacattattacatagactttgactatgagcatagttttggattggtgccaccacaatggtgttagctaattaaaatgcactgaatggtgggctgtgggtgcatggttttgctggtcgcacccatggcagttaaggaccggttcacgggaaaccctgggagacttaccgtgcttaccacaagcgggagtgagtaactgcttgatctgaggtatagctcgaccctttcctaggcaccggtggcaagggtgagcgtgatggagttgggtcggccagggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggtgacatgtgtggaatcgtgtcttatgggtatagttgtacacctctggccagagtaaaactattcgaatagccgtgcccgcggttatgggcgatcaaccagattcaccgtgattagtctcacacctagtttagtttaatgaactggtgtagttcaggaggttggttgggcctgttgcaacgtggtgtagcgttggacagtgattgattaatactgcttaattactacaactgttttactgctttcaactactgcttttaaatgcctgctttatgcaaaagaacctttagccttctttggttatatcatgcatcatacctcctcttctggtatgacttgctgagtacagtgggtagtactcagtcttgctctcttttcccccacactagagttgatgttcttctcagttggagccgtctcagagaggttggtttcatcgctgccgtcaaggattgcctgtggagtggagtcgccccgctaatgaagtcaagtttccaagtctagctcgttttatcttttccgctgcaattgcaatcttttctgtttttgtaagacgtggatctgtatgtcaacaattgccgtttgtgtaccctggttggtcctggacagggatttaatgcacattcagcttagaaattctagttcgagaatttctgggcgtgacactcctcagattcctcatctctggaagagggatcgaagcaaatcccgagaagatcaaggcaatcgagaacatgaagtcgcccacaagactcaaggaagtccagaagctaactggatgcatggcggcactgagcaggttcgtcgctatgatgggagagcgaggacaacccttcttcgcgctgctgaagaaacaagacaaatttgtgtggacacaggaagccgaagatgtgttcatcgcactcaagcgctacttgtcaaatcccccagtacttgttgctccccaacctaatgaagaattattcctctatattgccgccacaccatattctgtgagtaccgttattgttgtcgagagagagaaggtgcaaagaccggtttattatgtcagtgaagctctccacgacgcaaagacaagatacccatatatccaaaagctgctttatgcagtaatcatgacatcgagaaagctacgccactacttccaagcccacagagtcacggtcgtttcctccttccaccttggagaagttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataatcattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaaggtaaagccgttgcccacgcttgcttgtggctggcacgttaaatgtttcacaacagtagctcgcgaaccggtccttaattgtcatgagcacaaccaacaaaaccatatgctcacaacccaccttaaccaggttttaattatcaattaattaacatcacacgatcaaccatcgtgagctaccatttaatataaccatcactaataataacagtataacatagtttataattaaaccctttaattagctacgtttctaggcatggctaagcaaacttacatatagcatttagctgaaccaatccaatatataaggttcatgctaatcaaattataacccataggaaaataaagtcatctccggccaataattaattgggaaaggttcaccacccgatgacattcgaaaacaatgcacagttgaaataaaataatagctttaaacgggatcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaaagaaaaaagaaaggagatgatgacgtcagcatgacgtcaccccacggcagctggctagggtttgcgagctcgccggagatagagaccttggccggggatttggagggcatgtacacgtagaggacgacgaggcgaacccaacggtactcaccacaacgacaaacgacgaacgatgatggccggcgacgaaaaggacggcggcggcggctcggcttgacggcgacggtggagctccggtggttggcggcgaaaggggacgggcggccgaggttcccctcaccacggcgcacctaacggcggcgacggcaagcggcggcgacgttggaggcggcgcggcggcgcggctggagaaagccgacggcggcggcgagctaaagcaacgcggcggcggcgctacggtgcacgggagaggacgagagagggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttcggccgcgcgggagagagagagtgttgggccaaattcggcccaacggcttaaaggaggggatttttggtctttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacagaagtcgtgagaaacaaagacatcgtcggccgcattgcgaaatgggtagtcgagcaaagccagtttgatgttcactttgtgccccgaacagctattaagtcctaggtcctcgccgatttcgtagccgattggactatgcctgacaacatgtcagatagtcagactgacagcgagacatagacaatggcgttcgacagcgcactcaatagccaaggagcaggggtagggttcatcttgacatcacctttaggagatcagttcaagcatgcaattcacctcaacttcagggcgaccaacaacacagccgagtagaaaggattactcgccatgataagagcagcagccgcactaggagccaaccgactaatcgtgaatggggattcagaactagtcgcaaaccaggtgcacaaagactacaagtactctaaccccgagttacccaagtacctcgcagaagtcaggaagctggagaaaaggtttgatgggatcgaggtccgaaacgtataccgcaaggacaacatcgaaccagatgacctagcacggcgtgcatccatacgagagccactcgaacctggtactttcttggacgccctgacaaagccatcgatgaaagaagaaaacgacgaaggtagcatagttgtccccgacatcagttcgggggctacaggggcagaacaagtcgttgccgacatcgagaccacagacgactggcggaccctgctcaacaaattcctgagtagcgacgagttgcccgaggacgacgcagaagccgagaaaataacccgacaagccaaaaaggggccaaacggggtacttctcaaatgcatttcgttcgacgacggcaaacatctcctcctggatatacacgaagggatctgccggtcagacattggtcggaaaagcctttcgacaagggtttttctagccaactgtcacgccctaaaaatcgactaaattaaaaatgcatattttaaatcatttttagaaattattttaaaagcctacaggctaaaccctaattttctaggaaaattttcaacataaaaatgagctagataaaattttattaaatactatgcttgctcctctattttctagatttttctgggaattatttgagcaagggaagtatttttaataattaaaacaacatttcacaaattgttttatttcaaaaagttcaaaaaacccctccctaagccgttgggccgaattcggcccaatactctctctctcccgcgcggcccaggtcggcccagccgagccgctcctcctcctctcgggagaccgacaggtggggcccacctgtcggatccatcccctacctccagccggccgacgccaagccgagctcgagccgcctcctttccgcctccaaatccgcctcgatctctcctctccgagtccggatttttgaggggttttgttcctctcgttctcctctatctttcccctcaagaaacggagcaatccgttgagtatcttgcccgaatcgaattcgtttcgatttaatccctaaaaccgagtttgaattcttcccgagtcgattcctctcgtttggagttcgatctcttcaatccaatgctatataaagcatcccctcgtcgtcctcttttgtttgccctctctcccgtcctctctcgtgcaccgtagagccgccgccgcgcgctttaagttcgccgccgccgccggccatcttcggccgcgtcgcaccgccgcctccgtcgtcgtcgccgcttgccgccgccgccgttaggtgcgccgtggtgaggagaacctcggccgcccgtcccccttcgccgccgaccaccggagccccgtcgacgccgtcaagccgagccgccgcgccgcctcctctcgtcgccggccgtcgtcgttcatcggttgtcgtcgtggtgagtaccgttgggttcgcctcgtcgtcctctttgtgtagatgccctccaatttcccggccgatcgccgtagctccggcgagctcgcaagccctagccagccagccagggctgacgtcagcatgacgtcatcatcggg

SEQ ID NO: 63568 - DNA, 46661 bp, Oryza sativa
cacaacccaccttaaccaggttttaattatcaattaattaacatcacacgatttaccatcgtgagctaccatttaatacaatcatcattattaataataatataacatagtttataattaatcccttaagttagctaatgtttctaagcatggctaagcaaacctatatatagcatttagctgaaccaaaccaatatataaggttcatgctagtcaaattataacccctaggaaaataaagccatcttcggccaataattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaaagaaaaaagaaggagatgatgacgtcagcatgacgtcaccccacggcagctggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggtggagctccggtggttggcggcgaagggggacgggcggccgaggttcccctcaccacggcgcacctaacggcggcgacggcaagcggcggcgacgttggaggcggcgcggcggcgcggctggagaaggccgacggcggcggcgagctaaagcaacgcggcggcggcgctacggtgcacgggagaggacgagagagggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttccgccggctggaggtaggagatggatccgacatgtgggccccacatgtcggtctcccgagaggagggcacgggcggctcggctgggccggcttcggccgcgcgggagagagagagtgttgggccaaattcggcccaacggcttaaaggaggggatttttggtctttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacagaagtcgtgagaaacaaagacatcgtcggccgcattgcgaaatgggtagtcgagcaaagccagtttgatgttcactttgtgccccgaacagctattaagtcctaggtcctcgccgatttcgtagccgattggactatgcctgacaacatgtcagatagtcagactgacagcgagacatagacaatggcgttcgacagcgcactcaatagccaaggagcaggggtagggttcatcttgacatcacctttaggagatcagttcaagcatgcaattcacctcaacttcagggcgaccaacaacacagccgagtagaaaggattactcgccatgataagagcagcagccgcactaggagccaaccgataatcgtgaatggggattcagaactagtcgcaaaccaggtgcacaaagactacaagtactctaaccccgagttacccaagtacctcgcagaagtcaggaagctggagaaaaggtttgatgggatcgaggtccgaaacgtataccgcaaggacaacatcgaaccagatgacctagcacggcgtgcatccatacgagagccactcgaacctggtactttcttggacgccctgacaaagccatcgatgaaagaagaaaacgacgaaggtagcatagttgtccccgacatcagttcgggggctacaggggcagaacaagtcgttgccgacatcgagaccacagacgactggcggaccctgctcaacaaattcctgagtagcgacgagttgcccgaggacgacgcagaagccgagaaaataacccgacaagccaaaaaggggccaaacggggtacttctcaaatgcatttcgttcgacgacggcaaacatctcctcctggatatacacgaagggatctgccggtcagacattggtcggaaaagcctttcgacaagggtttttctagccaactgtcacgccctaaaaatcgactaaattaaaaatgcatattttaaatcatttttagaaattattttaaaagcctacaggctaaaccctaattttctaggaaaattttcaacataaaaatgagctagataaaattttattaaatactatgcttgctcctctattttctagatttttctgggaattatttgagcaagggaagtatttttaataattaaaacaacatttcacaaattgttttatttcaaaaagttcaaaaaacccctccctaagccgttgggccgaattcggcccaatactctctctctcccgcgcggcccaggtcggcccagccgagccgctcctcctcctctcgggagaccgacaggtggggcccacctgtcggatccatcccctacctccagccggccgacgccaagccgagctcgagccgcctcctttccgcctccaaatccgcctcgatctctcctctccgagtccggatttttgaggggttttgttcctctcgttctcctctatctttcccctcaagaaacggagcaatccgttgagtatcttgcccgaatcgaattcgtttcgatttaatccctaaaaccgagtttgaattcttcccgagtcgattcctctcgtttggagttcgatctcttcaatccaatgctatataaagcatcccctcgtcgtcctcttttgtttgccctctctcccgtcctctctcgtgcaccgtagagccgccgccgcgcgctttaagttcgccgccgccgccggccatcttcggccgcgtcgcaccgccgcctccgtcgtcgtcgccgcttgccgccgccgccgttaggtgcgccgtggtgaggagaacctcggccgcccgtcccccttcgccgccgaccaccggagccccgtcgacgccgtcaagccgagccgccgcgccgcctcctctcgtcgccggccgtcgtcgttcatcggttgtcgtcgtggtgagtaccgttgggttcgcctcgtcgtcctctttgtgtagatgccctccaatttcccggccgatcgccgtagctccggcgagctcgcaagccctagccagccagccagggctgacgtcagcatgacgtcatcatcccctttcttttttcttttttccaattttctaatagattaaaacttcggaaaatcataactaaataaccgtagatccgtttcaggtggttcaagttgctaaattcttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagctcaaggcaagtcacacagatcccaaacaaccctttgagcatgttgatcccgtttaaagctattattttatttcaactgtgcattgttttcgaatgtcatcgggtggtgaacctttcccagttaattattggccgaagatgactttattttcctatgggttataatttgattagcatgaaccttatatattggattggttcagctaaatgctatatataggtttgcttagccatgcttagaaacagtagctaactaaagggattaattataaactatgttatattattattaataatgatgattatattaaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtatcgtggtggtattgaggcgcatggtgacatgatgtggggttgtgtcttgtgggtacagtggtacacctctgatcagagtttaaactattcgaatagccgtacccgcggttatgggtgagttgagcaatgtttttcgtgattagtctcacaatactcattaatggttataatgtgataattaatttgactcctggtttggaatggtaaattcctggtttggagggttaatttgttcaaccggggttggttgttcaaatgtggttgggcctatgcaacacaggggtgttgtatggtgtttgtttaatattgattaattatacaactgttttactattctcttaaatatttattaaatgttgtttttgcaaatgagctatattatgccattctttgttatcctgtgcacttgcatatttgctgtgtggcttgttgagtatgttatatgctcattcttgcaatattcattcatcagaagaggagtgtctcagtgaaggtgatgatctggaggattaggcttgttcttggttaagatgcctgtggagtggagtcgccatagctgttccgtagattgttatcgttttatttttccgctgcgtagaatgttatttttttttgagaggaactatctacctctgtaatcttttattatttgcgagtattaaatagttatttatttgtactctattatcaaattgtcattgtgtgcctcggttgattcctggacgagggcttaacacacatgtaagcgtttggaattttggatagaaattccgggcgtgacaccaaccgcgctcaaagacgcttgtgacatggttcagcggtgtgaagcttgtcaatttcatagcaaatacacaagactaccagcgcaagcgctccagactgtacccctcttacttggccgttcttgtgctgggggctcgacatactcggaccattcccacgaggacagggcggctacaggttccttttcatggcgatcgacaagttcacaagtggattgaagcgacgcccattggagaaatcaaggccgacaatgccatcaagtttatcaaagggatattctgcagatacggattgcctcaccgcattataacagacaatggctcccagttcatcagtgccgacttccaggattactgcattggattgggagtcaagatttgctttgcctcggtttctcacccttagagcaatggacaggtcaaaagggcaaatggcatagtactacaagggatcaagacccgtgtctacgatagactcatgtcacatgacaagaagtgggtcgaagaactcccctctattctctgggccatgcgtaccacaccgacaacatccaataaggagacacccttcttcctcgtgtatggcttagaggctatgctccccacggagctacgacatcagagcacacgagtacagaagtactccgacgaggaacatgaggagcagcgaagcgacgatgtgaatctactcgaagaacatcgagaaagagttgacgtcagagcagccaactaccagtaggcccttcgccgataccatgtgtggagattatggttatctcatatctacatggcggttatattccagctggatatgtcgcgtcccaaatcgactctaaaattcatcctcgaaattgtgcaaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttgaaaaggtttataaaaagaaaaccctaaaagaagtctgtttccccccccttttccctcttgggccggctcggcccattccctccctctctctctcttcccccgcggcccatcggctccccgcgcgcgcgcgcgccgctgacaggcgggcccgcccgccactctcgctgacgggtggggcccacctgtcatcttcctcctcctgccgcgcccgccgccgcgcccgtgccctagcgccgccgccgccgcggattgcgccgcatcccgccgtccccgcgcgcattaaagagaggggaatcattccccgtgattccctctcccgtttcccccgatttcccctctctctctccctcggattcggtcgaatcgtggccgcattcgtcgccggcgcaatctatggcgcccgagatctccgcgcgcggtttcctctctccccggccgcgctctctccctcccgttgctttatattcgatccccgagctccgctctttcgtttccgccgctcgccgctcgctctcgccgtcggaatcgtgctcgcgccgtgctcctctctctccgccgtcgccgtcgaccttcggttcgccgccgccgccgctccggtcctcctcccgactcggcgacccctccgtcggcttcgccgcatcgtcgccgaccccgtccgccgctccgcttcgcccgtcgaccgccggagcaccgtcgtcatcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgcccccgcggctgccaggtggggcccggccgtcagccgcccgcgcccgcgggtgcggctgacgcgtgggacccacggcgccggccggcgccagccgcgtgcgcccggtccaccgtggaccgtgaggctgacgcgtgggccccacttcccgtggacccggtccgcgcgcccctcccctcggctgacgcaataaatccgatttttaattaaaatttaaatgaagaaattcgcaaatatccatttaaagagcatataaacttcaaatggctataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttaatttaaattaatgcattatcgctttatttaaattcccgcgttatcactgttttatttagccatgcctatttacctttgttatgacctcattattattgctattgttactattaccttgttcaccctaggataaacaaaaccccaactagtgggtactctatttatggttccactagtatgaatttaggtagatgcttcgctgattaattaggcaatattaggtggttttataactttagactttgggaattctcatatcatttggacactatgaaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggtagcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcgatgggtttcttttctggcatcgacgacttcgccttccctcccgggcaggcgttccagttcggcagcctcaacttcatcaccaacgacttcggcaagatctctctccttgactcggactcaaaccagtcggggagagaccaggtccccgtggcattcggaattccgaactcggccgaggcctactccaagatcatctctcccgagtcggctttaaaccactcggacgagatccaatctactctttcgcgaccagatcaagacgacgggtcctatccctcaatcctgatgaaacttcctgatgatttggccgttgtcttcactgccaagacatctgccacccgaagatctaggcgagctccggcttcggccccgatctaatctagatccagagaggttggcgttatactccaacctcttgggacagtctcaacggaagagttggatggttaccttagctcccccggcttcagttctcgaccaaccgagatcctcgactatgacaatttcggctaccactacgaccacggtgacctcgacaactttgacgacagctatgaggataactacacgcccctcttcttcaacgtattcatggctgacaacgaaacggaggaacagcgtcaagcccgagaagcagaccaagatagcgcacggcaagaagctgaacgtcgccgactagaggaagagcgacagcgacaggagcgagaacgactacagcgtgagcaacaagatcgcgaacggattgcaaaggaggctgaagatcgacggcaacgcgccttggaatctggacgctgagtgagagagctcattgggcaacaagacgtcgatggaacagcggtctttcgcaccccccagtagaacgcggttgcagctatcactctcctcgacaccctcgtcaaggaagacgtactcaaccaagctgatcatgttgtcaacatcttgaaccagacgaagaccatgatcgctgcctcggttccagccaactctgcaagcacccacaccccgactggtagccgagtccctcagctccaatctcatgattatcatcagccaagcctcagcatcatcggcataggatctagtcgcaggagcaggggtcacgacgaacgatctgttcactcgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtcgagtggattggccagccggctttaagccgactggaatcgagaagtatgacggcaccactaatccggagtcttggctcaccgtctacggactcgctatccgcgcagcaggaggagacagcaaggccatggcaaactatctacctgtggtcctagcggactccgcccgatcctggctccacggattaccccgtggcacgatcggatcatgggcggaacttcgtgatcacttcatcgccaacttccagggcacctttgaacgccccggcacatagtttgatctctacaacgtcgttcagaagtctggagaatctcttcgagattacatccgacgcttctccgaacaacgcaacaagatctccgacatcaccgacgacgtcatcatcgccgccttcactaaaggcattcgccacgaggacctagtcggcaagtttagacgtaaacctcccaggacggttaagcagatgttcgaaaaagccaacgagtatgccaaagccgaagatgctattaccgcgtccaaacagtcgggcaccacttggaagccaaagaaggacacgccgaccgtaggagggagtggaagtaacaaccacaaggatcgcaagcgtaagcccaaagagcttgtggcgaccacctctccatcttcccgacaacgttcccgcgtcaacaccttcgacaagataatgaactcccaatgtccgcatcatccaaactccaaccacgtggccaaagattgcttcgtctacaaacagttcgcggagcaatacgtcaagaacgcacgtaaaccttcagacggagatcaaggcacatcaaagaagaaagatgatgaagacgatgctccgactggttttccagatcatcgcaaagaacttaattacatcttcggcggaaccctggcttatgagtctaagagaaaacagaagctaacagaacgggagatcaatgcggttcagcctaacacgccccaatatcttcggtggccagagatagcaattaagttcgaccgctcggatcatcccgaccgagtagtccacctggggcggtaccccctggtactagacccagtggttcgcaatgtcaagctccgacggactctcatcgatggtgccagcgcactcaacatccttttcgctaagaccccggacgatatgcagattcctcgcacggaattaaagccgagtaatgcacccttccacgatgttatcccaggattgtcagctacaccagtcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgatgatgaagatgcctggtcctggaggagtcatatcactacggagcgacatcaagcaggccgtcacatgcgacaaagaaagttgcgagatgccccaaacccacgagactactctcgcccgcgaagagatccgactggctgcgaccacggcaagcgagggagaagtgcctgcaaccaagctgacgaagaccgaagaaagtgatgccaaaacgaaaaagattcccttagatccctccgatcctgataagactgctgtaataggcgctgagttagattgtaaataggaaagcgcgctcatcacctttctttagaataataaagatatttttgcgtggaaaccatccgatatgcctggtatccccagagaggtgattgagcactctttacatgttaaggaagatgccaaacccatcaagcaacgactccgtcgttttgcacaggacaggaaggatgcgatcaaggaggaattaaccaagctgttagcagcgggcttcattaaggaagtccttcatcccgactggctggctaacccagtcctggttcggaaaaagacggggcaatggcgcatgtgtgtcaattataccgacctcaacaaatcttgtcccaaagacccttttgggttacctcgcattgaccaggtggttgactcaacggctggctgcgagttactcagcttcttggactgttactcgggatatcatcagatccgactaaaagaatctgactgcttgaagaccttgtttattacgccctttggggcctttggggcctactgctacatcaccatgccctttggattgaagaacgcaggagcaacctatcaacgcatgattcaaaaatgttttcaacccagatcggtcacaatgtcgaagcttatgttgatgatgtagtcgtcaagaccaagcagaaggatgacctgattgcggatttagaagaaacttttaaaagcattcgtgctttcaagatgaaactaaacccggaaaagtgcatcttcggagtaccgtcagggaagttgctcggatttatggtatctcaaagaggcatacagcccaacccggagaaaatcaacgccatcctcagcatgaaaccgccaagctcccaaaaggacgtccaaaagctgactggttgcatggtggcgctcagccggttcgtctcacgactcggcgagcgggggatgcccttcttcaagttgctgaagaagactgacaatttccagtggggacccgaagcacagaaagcctttgaagacttcaagaaacttctcaccactccaccagttttggcctcgccacatccacaagagccgctactgttatatgtgacggcgacctaccaggttgtgagtacggtcctggttgtcgaacgtaaagaggaaggccatattcaaaaagtccaacgtccaatttattttgttagcgaagttttagccgactccaagacaagatatcctcaggttcaaaagttattatatggtgtcttaattaacgtaggaaattatctcactactttcaaagtaactcggtcacggtgatcacatcatttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggacaatgcattttgatgggtcgaagaggctcacaggcactggagctagggtcgtcttgatttccccgactggagaaagattgagctacgtattgtggatacatttttctgcatcccataacatggcggaatacgaggcgctactccatggattaaggattgcaatctctttaggcattcgccgattaatcgtccgtggagactctcagttggttgttaatcaagtcatgaaagagtggtcatgtctagatgataatatgaccgcttaccgacaagaggtatgcaagctggaagataaattcgatagactcgagctcacccatgtccttcgacataacaatgaggcagccgatacactggccaattttggttcaaaacgggaagcagccccttctgatgtgttcgttgagcatctttatgaaccaaccgtgcccaggaaagaagcaattgaagccatggatactcaaggcataagcatgattgaagccgactagagagaacctctcataaaatttttgaccaaacaagaactccctcaagacaaaaatgaagccgagcggatttccaggcgcagcagactttacattattcatgaagctgaactgtacaagaaaagtccatcaggaatactgcagcgctgtgtatctttggaggaagggagacaattgttgaaggatatacattctggtatttgtggtaatcatgctactgcacggaccattgtcggcaaagcttaccggcaaggttttttctggcctacagctgtgtccgatgcggacaagattgtgtggacatgcgaaggttgtcaattttttgccagacaaactcatttgccagcccaagagttgcaaaccatcccgttgtcctggccctttgcggtctgggggcttgacatggtcggcccgtttaaaagggcagtcggcggttacacgcatctctttgtggctatcgacaaattctccaagtggattgaggctaaaccggtcatcacgatcacaacagataaagctagagattttttcatcaacattgtgcatcagtttggggtacctaatcggatcatcactgataatggcactcaattcactggcggagcatttaaagacttttgtgaagacttcggcattaaaatttgttacgcatccgtggcacaccctatgagtaacggacaagtcgagtgcgctaacggcatgatacttcaagggatcaaagcacgagtttttgaccgactacgtccctatgctggtaagtgggtagatcagctgccgtccgtactttggtctttacgcactactcctagtcgggctaccggccagtcgccgttctttttggtttacggcgtagaagcaatgttgccgagtgaagtggaatttgaatcactacgatttcggaacttcaatgaggagggctatgaagagggccgagtagacggcatcaatcgattagaagaagcccgagaagcagctttcattcagtcgactcgatatttgcaagggttgcgtcgttatcataatcggaatgttcgatcgcgagcctttttagtcggtgacctggttctgatgaaaattcaaacaacacaggatcggcataaattatctcccttatgggaaggaccattcataattgctgaagtcactcggccgggttcttatcgactcaagcgcgaagacggtactctcatcaacaattcttagaatattgaacaccttcgtcgattttacgcttaggcatttcgtttgtatctttcctctttgactgctaacttcaagtttttccttgaagttttcagtcagggggctactataataataatggagtgtgatttttatcaatccaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttaagatatcaagcacagcataaattcatcagtattgtacaaattgtgcctccatcatcattaattatcaacatcattggtacattaatcagtatcagtcttttcatcatcagaattatcaggaccagtcggtcgaagatcggtgtcctgaaatctctcaactacatcagctgctatcttatcagcagatttttgtgcatcgctgatgaggtcaagagcagctccttcgctcgtcccgtctgcaaagccatcaatggcatcaacgtcaaccctcggataaagagatttggtcatcgccaacgccagacttgctctcatacttccagcttctttgatgctcttgaaatatgtatccagagcaactctcagcttgtcgaaaattttagaagcatcaagtgcactcaggccgttgttattgaagaacatcgcttgaacaattggggcagcagcgttagcaacctcatcccgggctccttcaagttttttgatcttgccaaccaggacgtcgaattgagcttgagatttgatcttgcggtctgcatcaacagatccacattaataagtcagcatatggaggataatggcttttgaggtattgattgttgataccttcaacttcctttaaagccaggtctctttgtcttgccagttctgccttgtcattttccagaatttgaatctgcttccccaactgagatatcttggcagcttgcactacattgattacggttaatcaagattgcaaagataacagtacgagtcagttgagcagagtttgtgcgtaccttttgatgagccactcagttcaaaatttgattcctggagctcagcgatccgatctttcagataatgttcattcttcctggcaagttctttcgcttcgtgcagttgattcctggtggcttcgagggttccgagatgagggactaacctttctaaggttaccgttttggcttcgttcctaagatgaatcctctgcaagacagtttaattagcgcatgaattaaatggcaaacaagatggttgagatcatgtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatccggaggatttcttattcatcaccaattattggccctagtgtatccatgaatgaagatgaagcagccaaataaagtctgttggatcaagatgatttcagatagcgtgtctacctgtgatgattcccggtcggggatgagtggactttggtgtcttcacaggagatttggtttctgattcactgtcagcatccttcccgagaggactgttcgtttgagcttcaacctcaggaatcttttggtttggccctgcatccgactggtttccagtcgggggctcctggttagcaccgacttcagattcggccgactggttcccagtcgggggctcgttgctgggttctacattgtcggttgtcggttgtttgtcactcggacaatcctctgcagttggcccggtttcttttgaagggtttgcctttatgtcagccggctcggggtctttttcagaaggatctatgtcagacggcttcctacgagtttgagttatgctgttagtattatttcaacagtgggtaagctgcaagacaaggaagatggccaaatgatttgtacctggaagactttctgatttttggcaaaggatgactggaggttttcttcttcggattagttggcttcggggattttccggtcgctcctttgtcttcgagccttccggtgtcatcgccttcctcgtcgcttagaaccagcttcctcttgcgagcatttgactggccgactggatcagaagcacttggtcgagcgtcagatcgaatttttggtcctccactcgcctgaccagtctactggcgaggtaatcgacgttgagcaattggaggatccgatttcatcaaagcaaattcctgggcatgatatttcgaactttcaattagcttaacagagggtaaaagcatacttttgaggaaggttgaaatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctatgcgggatctctctttgattggagctaatcgacttttgatgaagtgcggagtgatctgttctccctgcaaaccttgttccttcagttttagcatgcgttccatcaattccactgcctgagcagcttcatctcacataggcaatgagttccatgtgtcctggtaaaccggaggaagacagcagtactcagggagtgcgggctcaggattttgaacatagaaccagtttacatgccagcctttgtttgaggttttgaagggcatggagaaatatttttggctcaaggttcctctgagttggaaaccagctcccccaacaacgcacggtttgcttttgtttggctggggcttgaggaagaagatgcggcggaacaaggtgaaatgaagcctaatgcctagaaaagcttcgcaggcatggataaaattggcaatatgcactatggagtttggattcaagtgatgcaagctaatcccgtagaagttcagaatcccccggaagaatcttgaggttggaagagaaaatccgccatagaagaaatgagcaaataccacgatttcgtgtgtgtcaggggtccggaatgcttcgccgaacgccggttgccacccgataatctccatcgctgggagaacgccgtgcgccaccatctccttcagattatcttctgtcacatcggagggcgcccactgactctcgaagctttctctttcttccgccatgaatgtgaactggatggtttaatttggtccgagatatggctggagaggaatggggaatcggagtggtggacgcggggagaaatttcgtgaagtttttgagggtgggttggagcagattgatgaaacctagcttcgtcggcgcggttctgtactgtagcacggagtggggaatggcgagagtctcggcggggaagactaaacgacgtttggacttcggtgtttttagggtatcgggagtactaatgggcctgggcctgtacagtacttcagcccaattatgttttcagcgtggcctgttgtgatccctagggacttaggcgccttttgctttggcaatatgtgctcacaatgatgcggcccgatgctgttaaaatcctttttaacgcgattcaataattctttggaattaatatgatgcacatgaaaaggtgcccgacagaaaggtattataccatttttgtaagcttttttaggctacaaaagctgttgggttaatttgggatgactggttcattagtagtcatcctcctagcatgttatatgtttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatatttttttgtccttgatatattcaagtgagaagcagtcggctgagtatcttattgagtaccatgcatgcttcgatataaaatcgctcggttcttgactatatgtttagtttttcaactaatcacatagtcgggggctacacctaattaggtgcatctacttgatgcaccatgttttattttcgcccttcacagtcttttagcattcggcaagccggagcaagttgaattgaagcactcagattattgttttttgtttcgagaagactattttggtcaactgcgaaggtctcgggggctactgtggagattatggttatctcatatctacatggcggttatattccagctggatatacggtaccaaatatagatagaatatctttatgaggactcgggttagattctaaacttgtatgccaggaaaatacacgggatcctagtcggttacgattgtattttatctgtaatcccatattccgttaggatatggactgtactttgtattacggatcccttcccctatataaggaggggtccgggttcctctcggggcgattctttttctcccaatcatacaatcaataacacacttggcagaatcatccccggacaggagtagggtattacttcttgaataagaaggcctgaacctgtataaaattccttgtctccaaacccatccactttcctagcttgttagccacccccttttattattgccgaaatcttgtttcgacaccatgagaagcgcatcagagcatgcacactttcgatcgacgattacgtcctccgatgggttcaaagccaagcagggcgcaacaagctctcacccaaatgggaaggaccatacacgatcacacaagtcttgcggccaagtgcattcaagattgcagatggtgatggatgcgagttagcaaattcctggaacattgatcaattacgtaaattttatgtataaatcaatagtgtccatatttgtaagacatcttacgatttcaataaagttgatttcaggtaaagattacggtcaaagtgttccttcccgacgatcccttaccatgacgacacctagagttgaaacctatcctcatgtccgtttacaccgtcctgacaaggcctctgaggaacctaagggaacttcggctggggacgcccagagcggataaggccttgtcggatcatgtagagacaaacgaccatgtaagaccttgtcatgtaagagttctcaccgtgcgtattaaccaagccgtgtaatcggaaattgagttttccaacatcacggctgggcgctagggtcagtgctttttcaaccaaggcaggtcaagggtccaagagccttgtcatccgagaacgattctctgacaacaaggctgggggctagagagagtgtatggctcaactgactgatcaaagtcgcaaagtgagaaaacgctcatacacaacacacctagagtaagaaaacttagttagatagattccttctctattttacaagtgtttcttacaagtcataaatattccaaaatattccatgtttccttgagatattttttacaagattcaaaaactaccaggacggccaatgccaatccatggactgaaaaaccttctctgcaagcggtgccatcgattgcgcgagaccgtcgatctccgcgggagtcctccgagaatgcgagaactgttcgtggaggaactcgaggtgtagctgcgggtggtgatctcggatgcaggccagcacatgtcctccggcgtaccggcttgatcgacgacactcctgcttcagggcctcgtcgagacgtttgccgatcccttcgagctgtgcacaagccccattcagccacgagatatatccggccgccgactcctcgggatctccacggggaactcgaagctccttgtagactcccgtcattgccgtgcagcagctcttaaggtatgagttgaaccacacctcgcgacctcgaagagcttccacggcccggtccttcttcacttccaccatggtcctctcgagttcagccacctcgagcttcgtattccaatattggattcgacgatctcggtcagccaacgcatcctcgaggtctgcccagcacagaaaggactaagtcaggctgttcttctctcccaagaacacaacaaatcaagtcaatccgaatataaggagtgaaggagactaagacgcgatcctagggacgtcatcgccatatttgcctctgcggacgggctttgactgacctcctcccgcgacacgaatggctcgagcgcaagcgccgaaatgatcaccggcatgccaggctgcccgcgctgctggacactctcgatatcaacatctctacaacgacaacaaagtactttacagcatgatgtttaagaggtacaggggaaaacaaatatcctactcttcaaaaagggggaggacgaactcccccaagtcactgacttcttccatcacgcacttgcgtgtgtcatcagcggccccctgatccaaaaccttcttaaggtccaggtcagggtgcgccagcctcacgcacgcgaggacgtggcacgccccgttgaagaccccgttggacgtctcctcaccaagcctggctgcgtgcttggaggggatctcctccatcgccgtggccaactccacgagcgaggacgtcagtgagaactcatcagggttcgccgggatggtagtcgtgacaccacactccccagcgagctggtgtaggccggtgtacgatattcgcagtgagcctcggatttctgacagattgttctcgagctccgatatccgatgctcgagcccttgccgctgcctctcgttgccggccaccagcaccctcatcttcaggaggtcctcgcgggcctctgctaggtcacgtgccagctggtcggcacgctggtttgctgacgacgttgccgccttggtcccaccttgcgccgccttcgcccgcgccgccctacgaagagtttcctctctttcataaagctaggcgatcaagatttcgtgaatgagaagacttcaaaaacgtccacttacttctcgctgatcatcaccagcctttgccttcgctgaggtgggggagacgcgtccgattcctaagtaagatacgacggtgtgaggaccagtcattctgactacacgttaaaaaataagagggaggtttaccgctaggtttggcgccttacgacgggtcccgagtacggacgagaatttcctccccttcttcaaaacattgctgccacttgtggtagcagcagcagcggcaacgtcggacgcttctttggtgacgccctccttcaatgacgccgccacctggtggtccgcgagtggttcgatgacgtctgtcagagggagagcctgcataacgtgaagtcacaacgcgatctcgaggagaaggatgcaaaggagtcatcgagtacacttacattaattgcggcggcacgttcggccggacccttctcgcaaagggggatcgggatgtcgcccgccactgagggggcgctgatcatcacctggctgacgcggtgtcccacggtgtcactttccagacctgtaaatcaaggacaagaactcggtaagtcaggagaaacagacgcactcggagtaaaattcgaaatacaagaaaaaataccccgaggagaaactcggatcgcgtcctctggcacagagtagtcaaaggctggatgggcgcaggcctggagcggttggatccgcctacctacaaagtcggcaacgacttcgtaccctggcaacccctgtgttcagaggtcatcgatgatgtcgatgaaagaccggagagagggagtcagggcgggtttggcagtccactctgggattttgtctagttgttcttcagggacaacaaggacgggatccgagttttctatctgaagatagaaccatctcgcccgccatttgctgcaagaagaggggcactggaaggggatgtaacgcgacttcaggcaatcccgaagtcggaatccgacacatccagatacactgttgggttccatccgacgcaagtcatagtaaaagcggaagagatcaaggaagggctctaccccaatgtaggccttgcagatataagaaaagattctaaggaatgcaatggagttggggttcaaatgaagcaaagaaaggccatagaagttcaagacgagaagaagaaattcggaaggcggaggaagaaaaccgcaagaaatataatcttcgaccacaaccatatggcccaagatgggttcgggttcaatacctcctgtctccctctgcatggtcccgcgaccagggagggcgccgtcgtcctacaatttcttcaaagacgcggtggttgaggtggacttgtcaagatccatcgccgccggaggatcgccagagaacaaagcaagagaaatgggctagggttttctgtgcggagagcggagaagacgaggagcgctagaaggcaggagaagttttctggcaaacggacttttaatggattcccaaaatccctttaaataagcgcactaccgacggtgcgtattccaaggaaaggagagagattgccgccgggaaattctgggtccgttgcacgcagtagttttcaagacttcaatttaaattcactcatgaccgttgaacttcatgcggcgttgtcgatgactctttgtctctacggttctcatgccaagatcgaccagatgagaacgacaacgatttcgacatcagaagtcgtgattgattacatgagttcatttaagcagaagtcgggggctactatcagggttacggataaggtataccctttatccttggataaacgatgagtactgatacggtatgcccgcgcttatacggataattcctatatgcgttaaggaaatatatcacatgatagaaacataatccacgtatggaaggagtcctactcggacgagactgggtctttaccatatcgtgaggggttcgatatctccgagtcctacttggagatcaactgacccgcggtataaaagggaccccctgggcaggacctaaggcatcgaatatcaccgctaacacatccaccacagcctacgaagccggagcctacaggagctaagtcgtcgggtgatctagtcgaaccaactcgactacggtctcgtcggtaccatcgagttctgttattccctttgtaatatgtggtttccatcatataatctcataccaactggattagggctattacctaccaaggggcctgaaccaatataatccttgtcttatgtttgcttgatgtcgtactacgtagatcctcgtaccaacgtaccccaataccctctatatccggtctacgggtatcccgcgtcgacaatattcccatgcatttatgtcaggtctacctttaaaaatggtaaagcatgaaaaaatggttaatgttttggaggaatcccaattgttatcctacttcagacactgattctaaattcagagtacaaactagtaggttatgtatattaactgatggaaatataatagtatcactatatgaacaaggatgtaaagatattcaataatcagataacctgcttgctattgaaccattgaacttgattgtgcaatctatgtccatgcctatataatggtatgcaccatagtgcatttattcattctccaaaattgtttacatagtatggtaccataaatattacaccctggtccctgtattagcaggtacaactttgagcatgtaaaaggatgctccctcactagaaaattctacggcatatagttttggggctcatagaccaaggaagccaactattttatcttaatacctccatttattcttgttgcatgcacggtattaatgcatcacctcactaaaatcatctaactgcatgcatgcatacaggcctctttaagcatgggcactgggtaaatcatcgacagggaaggaaggaaggaaggaagggtacaaggagatctgtgcgccaaccgccccctgttgaggtaaggtgaggtgaggatggcgatgatgaaccggacgcgggatctgctgatggaggggttcgagggcctcgtgcgggagggctccttcacctggggcctcccccgccgcggggcttcgccggtgggcgacggcgatgaccccgacagctcgtcctcctccggcaagcaggcctccgtctccggcctctcccccaaggccaacgccgtcgtctctcgatgcgcccggtaatgacctagacacatgggtgagacaattgccttctactgaaattttgcctcgccttcgggatttcttgggtttctagggaagggaaatgctctgggacgaagcattttgtttctgatatactaggttaattgaatggaaagccactgcgttggatgtgacaattcttagaaaatctgcaaataagtggttgttcggtggctttatcagcaaccaatattacattgcatatgtttgaagatcgattattataatatgtagtgctcaggatgtgcagtagggcctatgagttcgtgtttgatctgaatgggtttggtttatgatgtccaaagtccagacatgaactgttgtgtgcaatgtagttcgttgcgtccattgtatacttgttccaagggaattctaatatagaatcaaaaccatagctgtttaagatctccctaaactgggtttttgttaagatatctggatgttggtaaatgaataacttgtgtgagctaatatagtttatgtcctttgagaacgatctgtaattcttttattagcttgattggaaacatgttgatgagcatcctgcttcacggaaccaatatgatgttgtttgcatttgctactgttctgttaagctaataggcataattatgtaatactccatccgtcccaaaatatgaaattttatataattagtattttcattgttatttgatgataaaacatgaataatactttatgtgcgacttatctttttaaattttttcatatttttttcaaataaaacggacggtcaaaacttgtacacggaaatgcataaataaacttattttgggatggagggagtattagttattcaaaatctctatgtcatgtaaaatcaattcccttttcatgcaaaaacatatgtaataccagtttttctttaattaggtgctgaacttatgccttttgtgttaattacatttcagggtacttggtacttccacggatgagcttcgatatgactttgatatgcaagcatctgattccataaagcagcaaataaattatgcaagaaattttttggaatattgttgtttgagggcacttgcacaggcctcacaaattgcagggtatctttctgacaaaagctttcgtcgcctgaattttgatatgatgctagcttgggaggttccctcttcttcaagccagctcactgttaaggttacaattttcttttctttacttgcttaaatagttttcttttgttcacaccttatataatttgttagcgttgcattaataaattttcccaggttacttcctcgtattaagggcttttaagaatctttctacatattgaatttcatctcctttcccttgcaggttgaagtagagagcacagtcagtttagaggctttttcaagaatagcacctgcaattccaacaatcactgatgtggtaacatgttcaaatctatttgatgtactttcatcatcaagtggaggccggcttacatttccagtatatgataagtaccttacaggattggacaggtcactttctctactggtctgtccattcaattttatttgttcatgttttcgttatttacacatggttagcaatagacagtgacgaactgccttttttaatttcatatcagcagaataaacaaattgaatgttatggaagttctcttgatgaaatgtctaccactagtaatatataatttatctgacaaatctaaatagttactatatgcctcttagttgtcaaagattgaatgcttgtaagcaaatgttgtaaactgatgtccttttgagaatacggggaggcagggagtattacttaccataattatcatacacattgacttatactttctcttttgcttaccttccaatcgtacatatagaacttagatttacatggcgcggtgtagcagaaacaactagtttcttgtcccatgatgaatatttttttccaaaatgaaatgcttctcttcagtgcttattcttatcagggataagcggataatccactttcttgatttaatatagtgaaaatttgggcaaccattataggtctatagctcttcatttctagatgtttaacctgctgttacaaccttacaatagatgccattatcttcctactttgcactgagaagtatatcacctgtttgagttaagattgatgtagtagatccccttcttaactactccctccatagaaaattatagggcgtatttcctcaagccctctgttgaagattatagaaacacacatacttcccaatccatattttgttggtaattttcccatagttcccatacttaaagaggcctgtatgcttgcatgcagttagattttagtgtggtgatgcattaataccgtgcatgcaactagagtaaatggaggtatttagataaaatagttggcttcctcggtctatgagccccaaaactatatgccgtacaattttctagggagggagtacccttttacatggtcaaagttgtacctgctaagagcaagtttaataatatagcgcactactagctccaattcatttatagccaatctaatagacaattcataaaataattgcttactatactattaatatatggtcccacctgtcatacacacattacgtcttggagtccgtactgcagctggctacagatctgtagcccgctgctcttctctcttatcttttatctcattaaaatatgtctgtagctagctaatattctactattgttcctgctctaatacagtgaccagggtgtaatgtttgtggtaccatagtatgtaaacaatattggagaatgaataaatgccctatgctgcataaaattatataggcatgtacatagattctacaatcaagttcaatggttcaatagcaggcaggttatctgattgttgaatatctttacatccttgttcatctagagataccattatatttccatcagttaatatacataacctactagtttgtactttgaatttagaatcagtgtctgtagtaggataataattgggattccttcaaaacattaaccatttcttcatgctttaccattgttaaaggtagacctgacataaatgcatggggatatggtatagcatatttgccaatttttgttaccaaaataagttcagttatgctcctttttctgaaggtagggtatgcaagcatataactttctgttggatcttgtttcataaagtcaggactgagagtatgttttatctcatgtagagcgattaagaaaatgaaaggacaatccgagtcctcgctattatctggccagcggtctcagagaggagaaaggattgtagaaatagatggaacattgacgactcaaccagtacttgaacatgttaggatttcgacatggccaggtatgtctagttttctcagtgaggagaaacgatttcttgttgtttacatgctggcatgtttttttaacttgccttgttacggttttatatcactgggtttcagcttttcctttgctggcacaggaaggttaacacttactgatcatgctctttacttcgaagcacttcgggttgtgacctatgataagcctaaagcttatgagcttgctgaagatctaaagcagtctgttaaacctgagctgactggtccatggggctcacggctatttgacaaagctgttatgtataaatcagcaactttgtaagttctttcacacgtagcaaagctaataagcaatagagtacatctatactactaaaaatgtcagtagtggtggtgtccattctgcaacaccacccctaccactgatatgtaggcccaataatctatagtattacaccaacctccaatgagtcctctcctgtttcgctgttggtttatcttaaactttgaaatcacctacttattcactctacactacaaatgtcagtagtggtggtgtctgttctgtcacactacccctaccactgatatttacgccccacaatccatagtattacaccaacctccaactagtcctctcccatttcactgatggtttatcttaaacttcgaactcatctacttattcaattaggaaaaacataaaagtgttaatttgactaaatatgtgcctaattgacttaataagctagaaactgaattccttttccgttgcaacgcacaggttcttggccagtaaacgtaatagctgattcctatagtggtattttgctaattagttttaatttacaagtcattgctatccattcctttttattcggagatagtagcaacatgtatccctataaccttatatctttatgactagcacatagatttgctcttattacctttagttacatgttttttctttttgttaatgcaaatgcagaacagaaccagtgatcttagaatttccagagttggctggccactttcgtcgtgactattggctggccattatatcagaaattctttgtgtccacagatttgttaggaagtttgacataagtggaattgacaaagaggaaacaattttgaaagctgtactaagcattctgcggctacaagctattgaagagttagccattccagtttctaatcgattcgagtctcttttgatgtttaatctatgtgacaaacttcctggaggtgatgtaatacttgaaacactagctggttctatatcattgagaagatcagctcaagttaaccaacctggcattagcagtgcaaggcattcaatgtccccatttactgttctgtcgaatcttggagtggtatcaccaattaataagggtgagagactctttgttggcgagatagttgttggggaaatgagtgccttgcagaaggtagttactgagtcaatgaacaactataagaaggttgaattggcccaagccacagttgatggagtcaaagttgatggcctagatacaaacttggcagtgatgaaggtatactcacaacagaattagccttttctcaactgttaaagatctgttcaattctatgtttggggtttagttactccctcgtttttcatgagcagtcttcctaatctgtgacggtgcctaattaatcagaataaattgtggtttatccaaattgattccggcaccattttgatctgttaaattattcagaacaaatctaacatatttagagcttgtgcatcacaaaaatataaagtaatttttgctgaagtatatatattcatggaaatcgaaagtaatctgcaatcctttatttgtgaccatcattcaccaaatgtggtttttagacctcaccgagatccttattccaatgtaatatttttgctgaagtatttcgttgcagaaatttgcctgatcctacctatattttccagcttttgcatatttctgcatgatatataaaattccaaaattatttcctctattttggagattgtatatgaattagagcttaccatattaccacttgttttgaaaggtgtgaatgtagtaatttgaattttgatgaagagagtttattcgcttatggaaatttagaaggtatacgcatattcactgcaaatcccattgtgtatgtactccctctgatcatatatatttgatgtttaggacaagatttggtccaacttttcaaactttgatcatcagttatttctcaatgcttagtttaaaaaggaaaaaaatggtaagcatagattttccttgaaaagtactagcatattttttttatgattttataaacttattctagtataaagttgatggtcaaaatttcaaaagtttgaccaaatcttgttttaaacatgaaatatttatcaccagaagatgtatattgcttttagccagaaggtttttgttcacagtattttatactatgattgcttgaaacatgtctagcaactatacagattcatgtttcgttttttttttgtttaatcctcacttgcatttaggaattgctatctcccgtaagtgagctatggaggtttttggtgttgctggcatcttgggatgagccgattaagtccatggtattttgcttttcatcgtcttatatcattatcaggtatgctaaactcacatggatattttctttttgactttattctgcatgatgcttttttaactgtggtacactattgtgatttttttttataattttgtgcaacttactaatataatgcaatataaatatatatcactagctcctttggagtgaatgttgcttcgattgcctctaatataatccttcccaaatttaactagttcacgtgctttccatccaccttgctgctgctccgttgacttgaattcaaggataccatatactcccatttgagttgcaccatggagtgatgtcatctgaggtggtggaacagtcgatggtgctataggaagctcctcatatatattaaggccttgtttagttcccaaaaagtttttttcaaaaacatcacatcgaatttttggacatatatatgtatagagtattaaatgtagattaaaagaaaaactaattgtacagttaggggggaaatcacgagacgaattttttaagcctaattagtccatgattagctataagtgctacagtaaactacatgtgctaatggcggattagttaggctcaaaagattcgtctcgcggtttccaggcgagttatgaaattagttttttcatgcgtgtccgaaaacctcttccgatatccggtcaaacgtctgatgtgacaccaaaaaattttcatttcacgaaccaggccctaagaagagcggtgtggatgttcctcatttctttattaaacacttgaatgatgattatgccttcctgcttataattacgatcagcgtaaaacctacctgatttaggaaggaggttaaactgggtagagggtggaagccaaacactagaaaagtcctctccttagtgcttattacactgcattgcaatgcatacaaaaagtgattctcaacagtacatcacaaattcatcagtaccttattgcagtgacacattcagcctagtaccacaccatttctaaatgctgtatccaacatcaatccatcctaaacagatagcctgattacctggtgaaaacaaccgtaaccactggattttgacattggttgaatactgagcatgtattaaattttttcaatgaacaattaagaatcatggatcagctgtgaggcatattttcatagtttacacttgcagcaaattacagttaataggattttagcattgctaataattttatctctaataattattacctaacaatcttagctataatggcattcttttgtaataaaatattttccttgaaatccaaggggacatgcaattcttgctgttcctagaagaatgtgtccataatatgatgaatatttgttcttttgtgatgcatactacacaatttttgcattcttcacatttgtaaattgtaatatcctctgtttctgtgatggcacagggggtggttagtctattttcttgttttggtgctcttgttttcggcaactttcatgttctttacaagactaactagccatgtaaatccaatgatggaggtcaaagtgacatctccacctccaatgaacacgatggagcagctcttagctgttcaaaatgctatttccaaagttgaagagcttgttcaggatgcaaatattgttcttctgaagattagagctttattgttggcttctccctcccaggtaactatatttcttagttcttattcttcaatccttttagggagctagtactttgttcattcattttttgtgcttcctaggctaacaatatatgtgcgctattcgttcagcttgttgatgaatgatgctatggaaagaaaataatgatatgtgaacacaagaaaaaaatagatacaactagaaattgatgaggttaactaatcatttgaaatcaaatttactacccactctgttttttctaagcgtagtacaacatatgcatctcgtctgatgtactgctaattattccacacatttagcatatcaacattttgtcttccaattatttttcttcatggtcgatagagacttttaaaattttccaattaaattccttttgtaatttcaaccctcataacagattatgcatgtaacttaatgtttcaaatttgtgtagttctatagaaacgagtggatatgcttctgtgtttatgttacttttgagttccatttgattttttttcccttagataaggtatattcatcaatcatgaggcataagctattgaagttgttttactttctgcatctacaaatattcagataatgattatttattgttattctggaagagcatatcaggtcccaattgctctccctcttaattttgtgaattggatgagcaaacaatcatttcatatttagttggaaggatttgaaaatttgaactgaaaagtagtataaattagaagaaaaaaagtagtcatcaaagaatatatgacgtaatgccaggattgcagatgatatacagtctttccttcttcatccaatctaacttgcagtttgtacaccttactatgtgactctgtacagaccattctgccttgctggacattggtctcacctttagtgttttgattgcctcatagaatcagaagctagatggcatcattaggggtgcaaaacttagatgaatatgttgaaactgttgataaaacttctgcatttttctaaactttgctgaaccttgtgagatccaacatattttgacagatttcaactgctttcttttacctcatatcttgcaccttcaggctatctatactcctttgaaaagaatcaaatggtggtgcattggatctgccacgccacctattcccgttatagtttgtacatattacacgataaacttcttaacaatatgtaagaaccaaatctaaatggagagccacatataaaattaaattaacgtgagtattacttatagctaaaagttgtgtaacatatttcatgaaaaatatgcttttacttattataggaaatgttatgggttttcttttcgttctatcagtggctagttgtttgtaaaagataaacatagcacatagcaccctttgtttcagggtctcaatgacacctgaaacaaacttataaaatgcatcaacctgggatgtttctttcctagccatgcctcaatcaaagacaaaattataaaaaagaaacataaaagctttaataaatgtgagactatttcataaaacgatgagttgtgccattctagcgcacatggtacgtttgaaacagtatgatgagaagccatgctgttgcaattgcaaatcttgccattgccagattcgctagcaaatgctatcttgcgatttaggtatcatagcaagatccccaatatgttgttttgaccttgcacatgtgcacgtcgcttcgctcacctacattattttggttgtcaatttcacaggccactgataaaactatacttgcgttggtagtgatggctctgagccttgcaatcgtgcccacaaggttgcttgtcctgatgatgtttctagaggtattcacgaaccactccccacctaggagagcaagcacagaaaggtggaccagaaggttaagagagtggtggttcagcattcctgcagctccagtagtcgtggagaaggataaagaagacaagaaaacaaaataaaaaatgtatatgtatattcaatgtaattatgtgccttgtttggccgatgggttggggtggatcaccaacgctcgtcttgtacagtagcagttagtatttttaataaaaatgcgagttctcacctagaaattaattgcttacctcgtattttgattatttcatatgtagtatcatcgggtgatcagggatgttttttttatcaaaacacagtgagggaggctcccacgatatatattaaagaataaaagagtatatacaatggcaagcaaaaacaaaaaaaaagaaatattacaattgatcaatccatgattgcactaaaggtttatgcacatccttgagtctagataaatgtagactcgatctgacttcaagtttttcttccaagaagaaactgaaagcagaatgccctgaaaaattagaccattcctttccttccaaatattctaggccacaagcagaaagagttccatgaaacaaggaaaaggaaatgaagcattttgagtttgaatcatttgatgaaagtccaaagaggtcgaccaaatccagcccaaactactccaacaggcaaaactgaaactgctgaggaaaaaaagatgatctctggtctccttgacatttagagcacaattagaacaatttgctgaggcattcagaggagcacaatgtttcctatccaaaagatccctggtgttaactatgtccatgaaaaataaccagcataagactttaatattcatgtttattcagctctgccagatccatttgaaagttacgggaggagataaaagaccagaaaattgagcttataaaatttctcagaagaataatttgatgaacccagatataaacccaagtgtcaattgaatcaaacagagtaaccagttaaagatcatgcaagagaatctcatattcatcaaacgcctgatgggataaaggaaagtgaaactggtcatcaggatcccttgacaagtgccgagcaacagaatcatatttatgtttagcaaaggagcacaatctagggaatttattagatcttacacaaccttcccaaagatcatcccaaaagagaatggcctgtcttgagccaagcactggcttagctattcccctgaaaagtatatcaaactgaaacacatccttccaccaaaatgaaccacaacatgttgccgcatgagggacctcaaaagaatagtaggaagaccatatcagattcacccaagggacatttatctttttgtagaacttatgcaaatgcttaagcaacaaagccttattctgaattctcagaaaaattacacaaagaccccatttttcttctcggttgcacaatttggacgatgcaaccaaatatttcttggtagaattaagatcacttcctctccaaaggcaatgccttctggttctatcaattgcatcaattacagagatgggcaatgatgtgcactagggttcccaatcttccgaaaaggttctgataaacaacaatttgggcggaatcgcgacacaaatcaatccggcttcttgaacgcgcacgctcttgagccccgtaatcgcagcaccacgtctcctctggttatcacccgtgttgaaacgcggattacctcgccgagaaggctaatctctgtttgccaattgaagaacacaaacaagaacgagatagaaaacaaccaaaattgcagatgaatgattaagctcacgagttggggtcttacaaaccgatctagcggcgaaactgttcttgacagattaatctaaggaaaacccaaaaacctaaagatggcggcgggtactgatatatagagtttagggttgtgcaaccccctctcaacgcaaccctaatgggttccaacacgatacacgggccaaaggcccaaatacggtgacacagcaccgctacagattctggacgtcaacttgtttggtcaatttacattgacccgaaaagaatttggacatgggaccaaaaccattggaaaggatatcttgttagctttccatccatataaagaatgccccaatccgagcacgtatgcgacctgggcgcccattttagtgcagactggtcctggactccgaattgcacccggcgtcgacttggtttgggcctccaccttgacttggtcgtactcgatgatcctccatggctctaagtccttctccaagtgtctccttgtcccctccattgttcctaatcacaatataatcattaggtagcaatctattctcgaattcatacaaagaagaacataggaacgaactcacctctaaatttaattgtcgcgcacaagctcttgttatcgctcattgaatgaccgttggaggattgttgtgtgtatccgaggtagtgatgtccccatcaggcaaagacaaagagcacatgtaataagttggaagggatgacataatagaattgaccaaagtgagtctgtctccataggataggaaggctgagctagctgttaatcttctctcaattctatcagtgagtggggagaaatcgaccactttgggtctagacgttcctaggggtaagccaagataagtaaatggtaaggtcccaattgagcaaccaaaagttgaggctaacatgcacgacttctcctctgagatatttaatggaatcatacaagatttggcaaagttctccttgagtccagaaggcaatgcaaaagaattaagtaaggccttcagagcaaagagctatggtgctgaagcttccatgaaaataagagtatcatcagcatatttttatttgaggtgaacgatggcagaagacctgccggaatttaatttaagggagtcaaaaaaaaatcacccaggaaggcctgggaaacgttacaacaaaagacaattagggtggccagaaagccactttgcgcaaatccaagtcttgttttacccgataagctactgacaactccgaactagataaattttggaagattctactatttctttctagccaaacgttccaccaagttgtcaggatagcacctcgagcgagtaattttttatcttctgttcctgcatccttaagctcatcccagcagcaggtagagacacaggatggaagggaattgaaaaccgggggcaggttttgccacgaatgtactgtagaccatacttgtctcataaacgggcattccgcgaacagatgattggtgtcttcgaaggcggaggtacacaagcagcaaatccaatcacacggccaatgtcttatgagcaagttttgagccgtcaaagttctttgatggaggacaagccacccgaaaaattcaattttaggctcagcccgggctttccagagtgaggtaaaatcgcttgtagtgtatgaaccagcaaattggtataagtaggcactcttggttgtataagttcgagattcagtccaattccagactatgtcatagacattttgagtgagttgaacctgttggagcaggccccccaattgcaccagctcatgtaattcttcgactgaggtaatttgtctgaaggatgaaagccagttattgttcgtcaactcgaactgaacccttctattctttctttttgctaaagagaaatagaagggggctaactcttttgggcacctcttgtgcagccaattatcatgccaaaaactagttttagtgccgttctccaccgagattgtggttgccgcctgaaacaattttttatctaaatcatcgcaggggatattcataccaacccaaggtttgtcgtcggatttccaagaaaaccacagccagcggaggcgcaaggcccttgcgaatctttcaaggtcaggaagaccagccccccctagagattatggtctgcaaactagttgccagttaatcaaactgtcacctggattagtatgatcagggtcctcgcctttccaaagaaaggatctgcgaaaacggtcaatccttttaaaaacccacttgggagcgcggagggccgttagatggtgaatcggtatagagcttagaaccgaatggcctagagttttacggccatcagaggtgaagaaccgccccttccatcccagtagacgtgacccaatcttatcaataagcgggatgaaatcaatcttccttagttttcgatagtgaagaggaagtccaaggtatcggcaggggaaggatttaatcatccccgggaaacttgaaagaagattgttcaaatctatctcatcacatctaataggaaagatttctattttgttgctgtttggatggagcccagaaatttttgcaaagaaatcaaggatgtgagagggaagacagttcggcactatttggatttgcaaaaactgccacatcatctgcataaagagaacatctgaatcttgcattgcgtccatttaccggttgaagaatagtagcatcttcagccgctttaagaattcgatggaaaggttccatggctaaaatgaagagcataggggacaaagggtcaccttggcggagtcctctagcattgttgatcaagtgacctggcgaaccatttagcaggacctgagaaggggatgttgccaggatatgagagatccagtttatccatctgttcccaaaatcgaaatttcatagagcttcaagtaagtagggccagcaaacagtatcaaaggctcttgctatatccaccttgatgaataagctttgcttttttgatctatgaagcagctgtatcatgttttgaacataaagaaaattgtcatgtaacgctctcttccgaacaaatgcactttggttctgggaaaccaactcattaagtcttggagctagtctattcgccaaagttttagtgattttccttgcaaaactatggaccagactaataggtcggtaatggtcagcgccagaagcgtcatctttctttggaatgaaacatataaaggccgaattcagtttttccagttgagatgtgttaaggttcatgaacgaattgattgccaccatgatatcatccttgataatctcccaggagactttgaaaaaggatccaataaaaccatccggacccggagccttttcgggaggtaatgagaagatcgtcgcttttatttcctcctccgagaaatcctcctctagttccgaaagatccaaggactggagccctaaagcagcccagtttagacccaatgatctttggttatttgtcccaggtctggatttgaaaaaacggaacagctcgtcttccttgtcttgtgccgatattgccactcctgagggagtttgaagtgattggatgtaattttttcttctcctagagtttgctttgatatggaaaagttttgaatcaacatccccctctttgagccaagtgagcctcgagcgctgcctaattttaattttattaagggttgagagacctagaaatcttgatttgagattggagaggagtaggttctcttgatcagatagtgacctggattctcgagctagctaaagctggaaaattacttcagctgcaacagctaattgcaatttgatgtctcccacattgcagcggctccatctcttaaggtcacgggctaaacgccgaagctttaggcgaaagatggctagtcggttagatgacaaaatcggcttttgccaagagtgttggaccacttctagaaaacctggaacttcaagccagtaggattcaaatatgaagttggaagatttgctcctcttttcattacccagtaaaaagagaggtgtgtgatcagagcatgcagaggacagagggtgcataatggagctctcaaacatcaagtcccaatccacagaagcgaaagcacggtcaatctttgtttgtgcaggatttgatccctcacctgcccaagtgaaacgccggcctggaagaggtaattcttttacctggatcttgtctaagagtctgcggaaatgttgcatcatcgctctgttaaggcggctattgtttttatcacaggctttgtaaataagattgaaatccccaataattaaccaagcaggtttcaaagagacttgaatattttcaagttcagctaagaagtttattttgtcagcatcaagttgtggtccatacaccacagtgatagaccaatttagtccttcttctcgcatggacaccgtagcagagagggagtactgaccaagaaccacttcggagattgaaaagaaattttcatcacatgctagaagtatgccgcccctagtaccatctgccggcagaaaagcatgttgctgtacaaactggtgacccaaagtgttgagaataatttgattggagatagcagaaagtttcgtctcctgtaaacagacaatcgtcggtttatattgctagatgcaaactctaacagagtcttgctttactttggcattcaaacctctcacattccagttaaacaggtaaacattgtcttgtgacataggaccaaaagggcacagcaactctactctcgcagaaacactcccaacgacgatgagagaaacacagcaagagaggtacaaaatagggacagcccaatacaacacaggaaactagacagtaggaagcagcttgacatagtggcaactgagacttgaacatcagggttggagacgtcatggatgttatgctcgatgacatctcagtagtaggggcgcttacaggggtgccacgaccgccttcttctttgcagccttcaagcggatggctttgcatccacccttctccactagctcggagattgtcttcaaagaggctggggataaaggcttgttgaagtgctgcaagtaaagctttttgacattatcatcaaaagaagcgtgatcatccatgaaaccaaattttttagaaataatttcttgagcaaaattctctaacttcgcgtctgaacgccgcttggaaagcaaacgagcactatgtctttgcgctgaagcaattgcaggaactgctactttaacacaggcatggcggtgagtgttgacgtcgggaacaggaagaagcgccggccggattggggtcgaaagctcagcaaggaaaccatccatctgatttccggaacttttgatctttggatttggactgacgagccaagagccatcccgaggggtggtcctttctcccttacatctgctgatgaagaagggttgccgacagacatcccgctccccgacctagagccccatcgcaatccgccgccctctgagcccaaagaaggctggacctacaatgtcctgatccatgtcgacacacttgaagacctccactcgcgcaaggcccgtgcctacaagtgggactacgaagttcaagatgatgggtcaaggtacaaggagtatccgctgccttgcagagcggaacctgatcctgctcggggtcccagggacgacaatgatgacaacgatgaccagtccagggggcgccataggagtcgttccctttggaatcgccttggtggacactcctcaagtcgcagtagggaacctgataggagggatgtgcaaaggcgtgaccaagagaatattggatgttcatcagcatattggatcactgggaaattatcatccccgtgaacagggataggcaaagataatatccccctctaatgtgcttatagcctgaagaagatctgctcctatggcaaacagaaggggggacaaaggatatatcgatccccttgtcttacacccctcttacattgaaaaaatttaccaggaacaccatttaatagaacaactgttgaggtagacgagaacatactcgtgatccattcattccattggggagggaaacccatagctgtcatttcattcagaatagcatcatgatcaattgtatcaaaagctttttcaaaatcaagctttagaagaactatctccctcttagacagcttacattgatggatgtattcgaaagcccatgctaagtagtcctcaatagagtttcctttaataaatccatactggttttgatggaccagctttgtcaggattgattgaattctatcagcaagaactttgcacataattttcactgagaaattcattaaggaaattggcctaaaatcattaggaggctgaggagccattttctttggaacccatgtgatataggaatagttgattgcagaaagatcagctgagttcccacaaaagtctgcacaaagccgatagaaatcttgagcaattagtccccaactggacttgtaaaagcatccattaaagccatctggtctaggagcttcatcaccagggatccttttcaccacttcatctatttctttggtagtgatttgtaaacaatgggacataaggtcacatttatcctcaataagttcactcagatcaaaaaccattttaggtttcatagaaacacccattctttccctaaaagcattccaaagaatggcagctttcccctcatgatcagaaacttggtttccaacagaatcaatgagagaagagattgcgttaattctaaacctctcagtagccatagcatgaaagaattttgtgttttctctaccaagaagaaccatttgtttatatctctgcctccaatattgctcttgccagttcacgaagttcttccaaacgatcaaacgaaagaattactttattacaattctcaatagccttagagagccagaagaaagaagaactccattttttttaagaaaccttctgagcttcttgaacttggcatagattagtttggtctgatcctgaatatacccaatatccacccaagcattagagacctgctccttgaaaccaagctaggaaatccaaaaatttttaaaacgaaaaatattggattttgggatcattgtagcaatctgaattttaattggggcatgatcaaacacatttttggctaacaccaaagcctgagtgttggggtatctagaaatccaattggagaaggtgaagacccaatcaagttgctctaaaaggggatcaccctgcatgttactccaagtaaaagcacggccttgaagagggatctcaagcaaactgagaaaaatgatgaattcattgaaaataaagatatcattcatgtttcctcctgtcttatttctgttcaaaaccgatctataaaaattaaagtccccaaggatcatccaatagtcattatcaatctggagatcatgaagccaatcaatgaactcatctctctcaggaccatgggatgggccatagacatttaccaaaacctattcctccccatttattttaaaaataaattgaacctctagggcaagttgagtctgttgcaataatacccccagaagctccaaccgaaggagaaaacaaataattatcaaagcgtcttagagccaaggatctaatgaaactatggtcaaagtgatctttttttagtttcctttaaacagtagatcgaacaagaactctcatcaattttctgcttcacggcttggcagcgaactggagaatttaggccacgaacattccaacataggacattgcaagatatatttggaggattcatatatcaaatatagacaggttacccaatcccatgcgaagcatggaacaaaagcaaggaagtgtatatttaaaatttataaatgatctctgatggagacaaaacatatataaaagttgtagatatagatgacatctacaattttgtagttgataaaattttcggttgagcacatatatgctgctaaatatagattataaatttggataacaataatcacaaaacaatagcatggtaagaatctttagaagcatgtctatgaatatgggttgcaaaaatcatttgatatgtgggaagcgaagtgtgaccttacaggggcgtaatgaaaatatcaaatattttttcatgtttcttagcgcctataaaaataacgagacaattgcatatttgaccctgttttgaaccctaactaccaatttgaccctacttcttgaagtttgcttatttaagcctccttttcaaaaacgaagctcccgtatgaccctgttctgttaagggcatctaacggtgttaactgaagtacaaaatgtctcttctgcccttactcatttgaccctattacatgtgggacccacccgtagttctctcttctcctctcctctcttctcttccttctcctctcctctcctccattgggcggcgactgatggggcagtggcggcggcggcgctctgagggggcgtaaggagggagcggcggcggcggcggcggtggcggctgacggagggggcgagttgcggcggcgcacggaggtggcgagcggcctcgctggctcatggagggagggaggaatgacggcggcgcaggcgaggaaggagggaggcggcagcggcggtgcaagcgcgcggaaggagggaggaggcggcggcgccaggtctgagggggtggcggcgccggctccgggtctttgtcgtcgtcaacacagccggctcctgctcttcgtcgtcatcatcaacagggcgctggcgccggctccggctgttcgtcgtcgtcgtcagcagggcaccggctctagctcttcgtagtcgacgagccaccactgccactcctcgtcgtcgtcgtcgtcaccagggccggcaccgacttgtcgtcgtcgtcactagggcagtgccgatctgagggggtggcggcgccggctcgccgtctcgctgcaagtcgccgctgtcactgcaagtcgccgccatcgccgcaaggagagaaatgtggatagggttgggtggatggagagggttttctaagggtattctgggtattatgaatattagttgtatttctttttcattttaaatcaaaacttaacggactaatggaaatagggtcagacgggaaactcgtttttgaaaaggagggtcaaataagtgttgatgaaaaacaagaggcctaggagatc

SEQ ID NO: 63569 - DNA, 8919 bp, Oryza sativa
gtgcacgtttctgtgcatctgttagccgggtttttgacgatggcaatctcctggccgaagcatccttctttttatccaaacattcctgtaatctaagcttcttatctttctctagcttctttacttcaccctcaacccccagtgatacatcatccgcatttgcatcttcaaccatgatggcaggttgaatctgcatctggctatcatagtccattgctggatcatatccatatgtgacatcttcatattcacgctctggcatcaactcatcgggctcatagaaaagttggtctccagcctttgcatctgttgtcttcttaacagttccaggaagctcaacatctatatcaatggcggtacagctttctggtccaagattatcctgtgagttagacctaacaggtatcataaaggactcatcagccacactatgcatgttcttttccatcagggttggactcttgtactgtccctctgcaagaggatccaaataactcccactgtccattggcttttcctgaccataaacgatgaagtcttcacttgctcctctcctgtatcctccacctccagcttctatctccttaatatcgccatccacaaaactcctaccttcagccgagatcacaagttcgtcaccagacagcattttcctggacctaatcctcccatgggctgaattgaaaccaattgtcttcccttcattgaaatcggtagaatctcgctccactaaaagaagaggatcatcagtggttctgctttctttccttcttgctggcggtggtcctctctcagtagcaaataggtctgcgtcattatcttttgtcttctcttcagttcttagcaagaaactctggaagacattccagtttccttggtctccatcttgcctgtgagctacttcatccctgctatactcatctccaggctcaagaatgatttttctgctctcctttttctttgaactagatctcttattctttcgcttgctgtattcagtgtgtgaatcatcactgtcctcagatgctacatcagaactcgtttgtgactcgctctctgatgagccatgcttttttgacgtcacattgatgttccttatgacaactacactgggtttcttcttgcctgatcgcttgccctttttatgcaacttgtggccatgagagctctctatctctgaaccactctggccactttcatcatccaatgtttctgagtccttgctatctgacgagtgcttccttgatactctcctctctgagtggtggtacctaggatcatccattggggggtagggtggagggtagtatgggttcaccccagggtagtaaggcatgccttgcatgggatatggtggatgaattgcccatggtggatatgctgattgatatggaccatggaggtattcgctgggagctcctgagtgctgagctgtcctctgatctgtcaagcacccaagtgatttctcagatacaagaaccttatctttgcaaaaatggttatgtagaaaccatttgtgctgtacaggttgacttaaaagcatatatgaattcgacatgtttgcacaatgataagtgaaagtaagcagaaaatatttgcaccacaattctgacttctgagtaacattggttagtgaaatcaataatcatgcacataacaatagaacatcaggaaactgttttatcaaccaggcagtaaatacaagataagagtgatttttagagctttctgaaagaaagtttagttatcacaccaagcataccagctttagcagcatcttcaccatttgcatctccattcgaaatagaaagcgtttccaggttttgcttcatgttgtctcccataaacataattccagaagcattaaagggaggaaattcagaccgtgcagacattgcctccggttcaacttcaatccattggccagtttcatgctttcttctccacaactcagtgaactgtgtgcatgccttcctattgattgacaaaacaccaaaggtgtgagaataaaggaccaatacagtactcaccaactgttccagtggtaattttgttttgctctttaatggaacatatccacacctctattctggtgtaatattccagcacagactacattatatcaataatgtatgaatcaagacaggtcagctgctgctatattgatatacccaattttatggtcgaagatatttgtatgttgcaacaactatcagcattataacatgttaatagcatatgttaatagcaccagaatagtataaaagaaaattgtagtgtagtaacatatagtgatatagattaggctcctgataaattagcagccatgtgaaaaaatgtacggggtattcaaaatgggaaatccaattcagcaagcaagacactaccttgggcatatcaaggtagtaacacttacatcaagcgtgaagcaccaaaacggtctgcgaatgtgatcaaaaatcccaggttgtcaatattaaacccagccgctacagcacgcgcaaaggccatagcctgctccttacgtaagacaattttgcgagtctccagaactctaagtaattgaactctgcaaattatgaaacatgtaaagaaatggttccatttgcgtctgagacacagactttgtccaaaacaaaatacagataaagaccttaaatgttacatgtgacatgtcacttcactatatgattattcaacctgcataaggaccttacatgctccacatactgttacttcattacatggacatgcaatgaacaggtgtgtttcttcattaagtaggagcatgtattgctacacgaaaattgtctaatttaagaattaagacattaaatgttccatgtaaaccggttttgttgccagatattagacaagtttaggcaacgtgcacggaaaaggggggatattaagcatagaaatactttgaattctcctcctgagttgcattatcattctgcacaggtggaggtggttgaatgcccggctgccatgacacagaatatcagaattatatggcacaattagaaaagaagaaagttttatccatgcaactttaccttgtacagaataagtgatttatccccatcaagatcgtaatttgtcttgctacctgtaaggtgcattcggcagcagagcaaaagataaaaaatattactccaaattatttgcagttcagatcaacccatcatgagaaaattcacacattatttcttgtaagttgtaacaaagaataaagctcttgtgcacatttaagtacaaaaaaaaacttagaaccaccttaaaaataaataggttacattatgcttggtaaaaggtgaaccaattagttttactagtgataattgcacaaacaatataaattgccatttcccctgtacattctattgcattttaatagttctattatgcacctaactcaacagttgtgtctgatgttacattacaccaactcctatagtgaatagtttagattctaaaacagcatggcctgcatcctacatgcatgttttgtggtcctagcaagtagcgatatacgcttaattttcggttctcaataagtagtgctgaataattaggtaaccaagagaaagcttcatagatgtgcagtctgttcgatgcatgacgatgaaaagaaagaatagcaagtgctatacctccaatgcattccgccaatttttcattataatcttctacctaacgaagcacaaagaagagcatgtcattaatcatatcatatttctaatattaagcagtagtacactacatgctatagcataaaattctatacttacagatctcaatccaagattgtcaccgccctggccagtgatggcatcctcgatctgcaatatctcagactctatagtcgttactcgttccaggacctctggtgtactgacgaaacggacaaacctgccagaaaccaaccatgcaaatgaccaccacctgacaatggcatgagctatcagcaaatacgatccaaccgaagcacagcaccaacctctccacggtgccccttgtaaaccatggtgcatcaatctctgggtctacctcaagtgtgatggagtaccctccctttgcaatctgttgttgggcaaccttgagatgtgcaacgaacgggttcagcaaaccagaggctatcttctccttccgtccatttgctatcacaactaaatcacacctacaaaggaggaggcgaaacaaaaaaaaattgactatgaagtgatgcggtcactgctggagctacagccacgaaggcagaagagtcactgtgcatagcagcaagcaagcagtaacagtagaggttgagtattaataagaatgatactgctccaaattaattagatctacaacagcagttgttttggcccaggtttgtcactcgggcatttgacatcagacgctatcttcccaggtggaaggaagatgtcaactttaccatgtccggcaatcaatattcccaatggaaggaccgaacttgtaatcgcgcaaagatgaaacctggattggatcagaccacggcaccaccaccagaagaagaagaagaagatccggactgctcaccttgtgcgggtgggggtgagctggaacaccgctgaatcaagccgcgtctccggcctcattgcagagcgattcttcccaatccctccttctcttcagatcttggagtatgattggatcatcagatgctatggaccagcggaggaaagaacaaagaaaggagagaattttggaacagagcaaatgcaggttgagacagactccctccctcccagtactgggattgattggattccttgttaccagtagaagaagggaacaacgacaatagaaacagagataataaataatatcaagggcaggaaagaaaaataaatactgctagtaaattagatagataaacggcgaggcatggaaccaagagagaggagagtggtgcagacagagagacacaaggattggcttttattatcggagatggtggttgttggattagaaatgaagaaactttctctataataatgagatgagaaatgaagaaaatgtttttaagaataacgagaaacgaagaaacttcttttttttagaataacgaaaaaaattatagaaaaaaaatgagaaatggagaaactacgctatctccaacatatgtgtattggcatgaagtatccgattcagttatggatgacttaatgatgtggtaatgatcttgattataatgatgatgatgaggtggttgcgtagttagttgcattgcatgtggtagatgagagagagagagagagagagaggagaggcggtaggcggttgttgtttcttcttcaggcaggtgagggtgagcctccgggtccgggcagggggatcatacatacatacatacatacatacatactggagtgagtactgtctactagtagtattagaaccataataatactgccttccatagtttccattccatatgagctgtcgagatgtgcatctaatttcgctcgctggaatgggtgaggtgatacgtctcatcatcatcgaccagtgggcatcaattacctaacgaactgacgctacaacactctcaatcggcatataattagtagtaggagttgctatttattagttagcgaataaatcacgccttgtaattctaattctaataattctaattagggagggagtcgcctagaatagatcacaagagctccgccgtcgattgatgcgtccatcccaaaattagctgctgcgccttcatatataaacgacgaatgaattgattgattgattgattggtgctctcttttatcgatctggaaactggaatatattatatatatagagagagagagagaggggcaaacaagaagaaaagaagaagaagatggtggtgatggtgaggcagcggcagcaaaggcagccggtgatggtggtggtgatggtgtgctgggcgctgctggcgacggcggcgcgcggaaactgccgcgacgagtgcctcgccgggtgccaaggttgggccatcatctgccacctctcctgcaacagcgcctgcctcggcgaagtcggcatctccgccatgagcaccgccacaccacagtccatcacggatcaggatcagcagcatccatcacagcagcagcaacaagcacaacaatcggtctccgtgctcaagggtctcgaccctgacaaaatctgaaacgaattgttttcttgctaccattcattttcaaatcccatatacatacactgcactacacacacacacacatggaataattcatgttttctcttcaaattccattgctctttctattaattattaatttacacagcacgttccacatagattagtattgtcaacatttttgccccaaccatgtacacctcacccctaaagtaaaaaaagtcattcatttgtctaaactagtataataacaaattacgggctaccttctgtaacgaagccaacgaatcaaaaataaacaacacaaactctatacgtacgcacgtctgggaagctatgcaagttaagattctggcagccgtcgcgctgaggccccttctcctcttcatctccaatccttcttcatttccacagtttcacggatctgtcatggctcgcagaagctatcatcccagtgaactgagagtgcgccaaagcagctataaggccttcatgtgcctggaccgtgtttctgtgattatctgacaagctccatagctccatcgtctgcacaaatgacaccaaagaccatcaatcagttgccattccgacggttaaaagtcttttggacacacaagacatattatcgaggaggagcaatttgtctaagaaattaatataggtagcactttcttaagacatgtaatatgtgctcggctatttacattgataccaccagggcggtcaatgctttgtgacttaatagcaagaggaaaatagtgtacttgtctttaggataagtgaagccatataatactcgtcagtgtactagaatatcacgttctctctctctctctctctcactcacccttccccttaatacccccactctcgctccaacacacagcctcctcccccccccccctccatgttatgataggagagaaaagaatgtgagaaaataaacaagtctctaggctcttatgaccatggcaaaaggtgttcctatctagcatgttggcaatcgcagaatgtcaaaaggcagttatatgtgtaaaggatttacctggtaaccaccaactatcagaacattcggatatcttggatgaaatatgcaagactggtattggtttccatgagatcttaactcatggatgcatgcgcctgatgctaccgaccaaaccttcacagtatcctgacttacagatgccacacgttcacccttttcatcccaacagatgcagtttacctcattggtatgaacctaactcaagcaaacaaaacaatgattgattaccttgcgttgcaaaagctgcataagatcaagcatcccatatgtattaccttaggcagtgagtgcaaacttgcctccttttcaacatcaacaatattcacaatgcttccagttgccacagctaggagctgtccaatttgaggctgaaacctgaccctaccagtaccaccctgtttcatctgtaatgacatcaagtaaatatcattgaattggcccaagtgtgaacggtttacaaatttcaaaggataaggaaccaaggaccaaccctggagatacgtgaaactttactttgaccaattttccagaaacaaatttctccattgtcgtcacaagagcatagaacctctgtagatttcgggtgaaaatctacagaggttacatgggaactatgcccatgaaaagtctgtacagcaccagttcgctggaaaaatcgagaacatgtttgacttaggttaccagcaaaacagtaaagtgtgatttgactgcctcatagtcaaccactagcatcatgaaatgaaacaaattaaaatcaaggcatttgttcacagtacatggattggcacagaactacagtgacgtcacatgcgcatttactatgcgtgagcgatagcttatggaatccatgacatgataagaaattccacgggaagtatcaaatgacagcttacagcagtactgtttcagattcttgcatatagttttgcatttagcaactagagatttctgcttcaatatcaactttcaaaactaacagtatccctgtaacaaatgaggcacgatttacatcatcaagttgggttatgcacaagagaaggtgttcatgtgcagcatgaaagatacgatagtactctgacagacctcaagtgcttcacaatgttgtataaatatctagataaaatcacctacagcaaatcttgggtcataacaactactacgtaactcccatgtgggccatcggttaagattcagatagatcaatatagagagatgtggcagtaactaaaagagcctgttcttttttaaaaatctgatttggcagcttatgcgatgagtgccacaatagcacccatagaaaggtttgtgatagaaaattccccaaaaaattccttgtttgcaagagcgagcttaaaaacagtaatatacatagtaggtgatataggtttgcggtgctctcttgccacagccagaaaataaaagtttacgatgcaatgtcaatagtcagctctgaaatgaaccaaaaaggaaagtataacttacctaagtaagaaaattactatagaggagaaaaatagatagataaaagactaaaaagaaattacttcgattgcattccatagtcgaacagttccatcagaagatgatgtagctaactgagttgaattcggtttgaatcttatatctgtaataaagttcgtatgttcttctattttagtatccatgttaagattgtccatattccagaggaaga

SEQ ID NO: 63570 - DNA, 11915 bp, Oryza sativa
ttcctgcagcccaccactcaccgacgagctccagccgccgctcctcgccgctccagccactgccaagccgcgccccgccaccgtcggcttcgctgcatcgcgtggtaccccggccgctcttccaccttcgttggagaccgccgaatcaccgccgtcgtcttcgccccgtggagtgctgccgcctccctctgctcgagccccatcagcggcctccttcgccgccatgcccctcggtgggctccgccgcctccctcttcgcctcctccactcgttttcgccgctccccggccgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgttcggcccgtctggtcgggttggtcggcgagccaacccacccctccgtcttgcacctctaccgtggactcggtccacagtgggctagatccttttgcccgctgacgcgtggggcccgctcatttggtggacccggtccaagcccgcacctcctttacccgctgacgtgttggcccgcctgtcggcgccggcgccccttgctgacgtcagcgaatgccatttcctttgagaaaatatttaataattgcgcaataaatcgagtttaattatagaaatcaatttaaatggctcaaaacttctaaaattcatatctaattcattctaactccgaattgggccattcaacttgcaaaattcatctaaaattgagctctacatgtttgtttacttttcatgtactgtttttttggtttttattagagtttttcctcattttgcgtgctagcgtgtagaatccgtcgtttcggaagatcgcggtcgcaaggataagagtttggaagattgtttgaagaagcaaggcaagtcacacatttccccttgagcatgttgatcccaaattataaatgttttagtatttgcaactaaatatgcatcgttttgctaattacatgggaccagggtttacctatctgcttgcttgtgccatattatttgatatatgtccttcgtcaaccgtgggtgataattcgactagcttgtgtcacttatgttgatctagctagaactttatgcttagccatgcttaattaccactatctcagttgatgggataattgcagtattagacatgttagtatcatgatgagctgcgtgctcgagacatctggccatgtttcatggtcgtaattatccaactaaaatacgactgaatggtgggctgtgggtgaatggttttgctggtcgcacccatggcgattaaggaccggttcgcgggatgcactagaagacatacagcgcttgccacaagcgggaatgggtaactgcctgacttaaagcatagcttttctctggctgacgcatccaggcaagggtgggcgtgatggagcggggcgggccctgcgacggcctctgtcgcttccggattcacctaggcacgagaggggactgcccgctgcctgctgggggcgggggtgaaacctgaggtgtggtgtgcttggttagagcgagtcatatgaagggtcttgtcacaatcactcgacatggtgacgtgtccggccgggcacggtaacatgccggtggattgtgtcttgtgggtacagttgtgcacctctggccagagtaaaactattcgaatagccgtgcccgcggttatgggcgatctaccagaatcactgtgattagtctcacacttaataaatcgacccaatgcaccgtagttcaggtgggttggttgggcctgttcaacgtggtgtagcgttgatcagtggagatttaatattactttaattactcaatagttttaccgttttgctcaataaaatgttttacaatcgcctttatgcaaatagccacaagccatccttgtatcccattgcacgtctgcatcgttggtgtggcttgctgagtacggtggttgtactcagccttgctattattccccctttttcagaagtgtagtgcttctgagttgaagacgaagttataagaccaaggctcagaccccagttgtgttttgcctgtggagtagagctgaagccccgctaggatcgcctttttccgctgctgtcgttctctttcggtgtgaggactaagtgcctcttttgtaagtatttacgctttatttacgtttggaactgtatattacttgtcgttttgtgtgccctggctggtcctggacagggatttaatacacaaaatagtctggaaatttgggctaaatttctgggcgtgacagtgacccgtgccgccgcagacctcacacgtaatgtgccagtccaaggccttgacggtgccttgtggccttttgttgtggtcatccaatcgcttcatgaggtctagcttggcagcaagcaaatccgtctccttgatggtatgcatgcctcgctgacgggtttggagtcgttccacgctccaacccatgttggagaccatcttctctattagatcaacggctccttgaaccttttttagagaagaaagttcctccagctgccgcgtccaggtgatcgtgggacaccggggtgagtccattgtaaaagttctgcaggatcagctagtcgtccatcccatgatgaggacaggcggccacgtacttctgcagtcgttcccaggcttccggaatagactcgtcccttgtctgctgaaaacttcaaatccttccacgaagggcattggttttgcccatcgggaagaatttcgagaggaatgccatagagcatttgtcccaggtattgacagcagcacggttggcatcgaaccactactttgctctcccgagaagggagaacggaaacagccacagtctgacggcgtcgggattgacgcccttgatggtgtacgtgctacagatctccaggaactgttacagatgagcatcggcatcctcattaggcttgccacagaacgggctagcctgcgccatcgtgatgaggctagacttcaagtcgaaatccacgtcttccatgttgatctgcggcccaatggccacattgtcagtagagggagcagcgaactcgcggagagtcttgttagccatagtcttgaaggtcggtggcgctggtatggctggtttctctgtcggtagagttttttgcagagcagcgattcgcggcatgacgctttggaagaaagcttctagattttctttgaagtttttcggcaagttgaaaccagtcatgcactaccctgttttcacaacaaaagtgaaaacaaccaaggttagcctgcaaaggaaaatgattatacagagataaatataaagtattagttcaggtaatctccattatgaatcttccctggcaacggcgccagaaatgcttgttggtattttcttaacgacattactagaaatataattcccagcaatggcgcagaaatacccatggaatattatggttacagagtttatccgcaagcgcacgaatataccattgtagcatttcaccgagagtattctaaggatatcgtatttattttatcccgtgggaagatcatgtagagagaactagactaataatttatatattacttgtgataatcatattctaagcaagggttaagataatccaagggtatagtgacacacaagtattagctactcattctcataatatattatctaagctaagtgggaagaaaagagaaagaaaatatattcctatacttctaatatacatagtatacatacattccagttatccgatatactaggtaataccctctatccgatgccctcctggtacttcgagaagccacccctgactaccgagttccttacgacagtccgtcatgaccatacaaccggggctaaatacggaggaatgccctccctagggaattaacttaggattatatacaggcacggaggaatacccgtactatgctgtcaccatcagcggcccacctctcatccgtagcatataaccccaaataatgatatcccataatctagacatcacgcctaaactaccagatactactctaatatcatcgtcatgacatagagtaattgcatatgcaaacattatacccgcaccaaagcatctcccagataagctagcagtatattcagtataacatgaatataatgtaaagtaggtatttatatactcggaaagtatttcaataccataaatgtataaagaagaatattctaataatagtacaaagcttacaaaagaggaaaggaaagctactagagccatacccgaactcttccgaaggcttccggactcctgatttctactctattcctattccactaacttaagaacattaaactaacttgagagaatatgagagaattcttgcttgaggggtgtgtgtgtgaagtgaagtgagtgagctccttttataggcaggtatgacggttgtaattgctgtgaaatgtctgaagtaactcgcaaccgccatcaggagaagatctggagcgtccctaccaaactccacatccaacggtggaaagggaggttcggccgaaccaggggccggcccaaccagcccacaatttggctggtggcctcccggacttctcttctccgcagtcttttgaattttggcccagttggttgtgtcatttctgagtttctagcctattcatacataagtctgttcctcgacatcgtctgattaatttatcgtctgagttgatgtcgattctccttcactttatgattattctttgcaaaaggttagtaaacctaatactagtggaatattattattctaacatatatatatatatatatatatatatatatatatatatatatatatatatatatatgcattgtaagcatcactagttctcctctattttggtaatattgacggtcaaaactgatcgataacgaccgtcaacaaacattagtatagatttttcaagaacaagtaacaaattttatctgtgatttttattctaatggatgcagaggtgagaaactccctgttcaaagaaccagtcctgcatgacaccaataaggttggtgtgaactttaggaagcaaaagctattgcaaatggcagaataaaataatgccccaggagagccagaagtggtgatagttgaagatgctgaagtggtgattgagcctgtgccaaaaaagaagtgcactggcaacaagggattcactatccctccaggagttgaagtcattcatataccctccacccctcaggcataattataatacgataaattgtccacatctcaataattttaggatattgcccctaatgaatgtgcaccaatatcataactagtgtgagtggccacttccatttcaataatttattgtgctatgtatcttcttcctttgagatatcaatctaattttcttccatttcaaatctacttttcagcctaacttgcaatgattactgtaattcataactaagagatcaacgcattgagctgtctttgcttcatgtagatgaaagatgtttgatgatttgtattttttccagggatgatggcttgtactagtagtgactgatacagactttactagctaaatatgttttcatcctcaaccttaaagtttaatgtgttgtgataatgatttttgacaagcaagcttgggatgcgttcgattcccctgattgggaactcattccctccacatggaaaacagagcggtccattagtacgtgattaattaagtattagctatttttttaaaaaaaaatagatcaatctgattttttaaaataactttcgtatataaactttttattaaaaaacacatcgtttagtagtttgaaaagcagccttggtagttttcttgataacttttgttgctacctgtacctgtggtgaccactgaccagccttcgtgaggaactcccaagtatttaagctgttaatggaaaaaaaaggcattattgaaaatctataagtttctttgatataactaattgtcactctacttagttccgctggttatttgtgagtaacaattgatagtgcaatgcatatgagtaaatcatgtgtacatgtatttctttgtgacctatatttgcttccatatcataggcatagtatgatatgcgcacgaggcataaattaccattcatagatgagagttgtgtgcgtggtttagcttaggcatgttccggtggttgtgttttgcttgcatacttgaaatttactaactaacgtaacttaaacaaattttgattgattatgtattttctttaataatgttgacgtgccttacacgtgcatgctcactagtgaaaataaatatacgagttttctttttttaaaaaaaagacagcagaattatagcaacagggactctgtaccgcacggcagtattgctcatcgatctgcatcaactccggactcggactgtgtcacaattgccgttagatcatttgtctcggaagtcgtaactccgggcctccgggcataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaatagcacatggcacctactgtactgaacgcgtggtttattaaaaaaaaaaaggaataggtgaccattgaccagcgaccatgcagctaccacaaccacaaccacaccctcttgttagtattaaactgttgatctataaataaaaacaaagaaaaatgtagcttcttcgttgacgcatgtactatagctgtgttcggtttcacgggatacgaactaatccctcccgcacataaagcggagcgatccattaatacgtgattaattaagtatgtcctattttaaaaaaaataaattaatttgattttttaagcaactttcgtatagaattttattttaaaaaacgcaccgtttagcagtttgaaaagcgtgcgtgtaagagagatgggttgggaaaagagggtgccgaacacaccctatgggtagtttggatacatagactaaactttagtgtctgtttagatcgcacccaaaattttacatcctgtcacatggaacgtttgaacacttgcatgaagtattaaatatatgctagaaaataactaatggcacatattgcgactaatttgcgaaacaaatcttttaagtctaattgctccataatttgacaatgtgatgctatggtaaacatgtgctaacgacggattatttaggcttaataaattcgtctcgtggtttactgacagattctataattagttttttctattagtgcacgaacacccccatacgacaccctatataatacctgatgtgatacgccaacactttacacccctgatctaaacaccccttagtccctgtcacatcagatgtttgaacactaatttagagtattaaacatagactagttaaaaaactaattacacatatggaggctaatttgcgagacgaatctattaagtctaattaatccatgattatcacatatttactgtagaactacattgtcaaatcatggactaattagtattaatagatttgtctcgtaaattaacctccatctatttaattagttttataattagtctatatttaatacttatgtttagttcacgctaaaattgaaagtttggttgaaattagaacgatgtgacgaaaaagttgaaagtttgtgtgtaggaaaattttgatgtgatggaaaagttaaaagttcgaagaaaaagttcggaactaaactcggcctcaaattagtgtcaaacttctcttgtatggctttgtttataattccaaactttttctttaaacttttaacttttttatcacatcaaaacttttttacacacctaaacttcctactacttttaaccctgtcaagtgtcgactggacaagagaaaacctaccccctacgccgctagctacacccgagcctatggcggccaaggaaaaaggatatactagtagtagtaataaaatagtagtatttaaacactgcaagcatcttcacacgggaaacacgacgagaactggttcgtttcggccaccattattccacatcatttccacggcccctattgtccgcttgctctcgcgtcgctcccgtcccgtgccgtgcgctgcggccgccatgggctcctccgactcccaggcgccgctgctgctcccgagggggagccaccgcaaggaggaggaggaggaggaatacgcggcggcggggaaggtgcggggctgctgcggcggcgatggggaaggagggtggtggcgggaggcgactgcggaggccgggaggctggcgtcgctggccgcgccgatgatcgcggtcgcgctgctgcagctgatgatgcagctcatctccaccgtcatggtggggcacctcggcgaggtcgcgctcgccggcgccgctatcgccaactccctcaccaacgtctccggcttcagcgtcctcgtgagtgcccttttcccttcgatcatctttttttacccttctgtgcgtgagaccacgccttctagggatagaatgggattcacttcgtgccctgtggctgtggccgtgtggtggttggcatctcgcgcagccgccagcgaggtgcttgtggaaatgccccgcacgacaatccgccatgtggttttgcaccgctggtcaaatactcgaaacatactaatcaacgcaccaaaagttggtagaacgcgagctggatcagtaattgcgtacgcgaatccaaatccatgtgctcttttctcaaatggtcgactcaccttcgttgcactgatttgtgttaattgctgttttgggttttgattattggagctgactgttttcactttacgatgctactcctacttgactatatgctattctcagttcctcacatatgaggctaaggatttggaagcttcagttcaggttcaccgtgcgcattggaaaggcttttctgtctttccaaacatttcgtcgttgtatattgattataagctaagcgccagctctttgatttgagattgcttccatatgcatgtttcgtcctttaggttgtggaccagtgcttcatctttcgtataacaatgaaatatagtacccgactaccgtgccgtggccgtgtatgtgcttagggctctaggacaccctttacggaataattaattatttgccactcttacggatggtgataaaatgtcccactctttactgcagtaatcaagttcttttttttggttttacattatgtacttctgtttggcaatgtattgtccacagctttggaatagttgcatgctatagaaacagagtaaaggattgcggactttgtaaataaatgacaaatacacatctatattcctttaaaagcctctagtggtggcagtgaatctgcccacccccactattgcttttgcagttttttacaaattgtccccctgatattttctaatattgtggaatagtccaacattcagttcaaacaagtgaataccagataatcataaaagcaaacaagtgatactaagatatttgataaacaaatatttttctatgacatattatgattatttttcttctgcccatagcaaagcttgggcattttgctagttattaataatatacacaaattcgaacatttagagaaaatggatgtcacctttagttatctaaatgtacaacaaattacacttttaacttttaaaattttctactccttttgttccaaaatataagcacttatggagtttttcaccgcgattaaggagagagaggtgaaatcaaatgacggattgttgtgattggttgagatgaggagatagatggagaatattaaatgagagatggctgtagttggttgagatgggactaggtgcataagttactacattttgcgacaaaatttaaataccagaagtagctatattttgggacggagggggggggttgttaacagccatatcttgtaaaagtaggtcaaagcacaccttaaaaggggcatagccaagggtcccaacctctatatagtgaagacgagacaagcaatggattgaacatggagtggacaagtcacttgtgtttattacttcagaaaaaaaaactttgtagaggtagcattactcttacataagaaggcttgagtgatgttaggagctcgtctagtacaaaggtttgaggcaattggacaagcacttctaggaagacgatgtgacatggaaggattcaatattggtgttgacaattgatggtacttgttatgcagacaccgagatcctcctccatgtcacagcctcaccagtcacactgtgtttctagaagtacttgctgaatttcttaaggctttggactgaaggagctctgagcatcgtgatcaggagcatcttcttctacattggctacctctaatgagtttcacctattgtaactgctgctgaatatataagcacatattgatttaatttattccataaataaatcatgacattgcaaattaaaactagcatcatcatatcatacgatctacacatgtaaactagatagtagcgaatgcgtaccgagggttctagaagttcggctacacaacatgaaggactcgtggtactgggcattgacgacggcacgcagcacccgagcgaagaggaaggcgagccgttgtggatgaatagcaagcagtcgcgtgaagcgcttcccaaaattcccgccttctcccagtgtaggacatcaaaggcgaaggttccggagacctgctctcccgatcgtcggtgcacaccgacgagcgggatggagtagactacgagtgacaacgcagaactgaggaggagacaaaccctagattgatttcgcgtgtgttgcaaggaggcgacggctcgatttatataaagatatcaggacacctgcacgatctccacaccacgtaaccgaaccgaataagtcgcgcgtaactcatccggagtccactcctctccacgcaccggattattcggtgtgtttccaaaaacaaaaccgaaatttgcagcaaagcaaaattgcaaaaggaagctgcatctcgcctggccatgcgaggcgagcgagcgcgcgcgtgtgttcttctagttttctccaccacacatgcctcaagtggctaggagagcaacctcccttgtaagaaggtctccctcctctagaataggcaaggtggtactaaacttcccatgtatgccatcccatgaggtgggcttttgtgattttccgaataattaatcttcatatgggccttagcctacataccaattccaacaattgccactagatgatgagttcggctacctcccatgagtttcctctgtcataaccaacatgaatgaaattttcgccactttcaatctgtattttttttctcaacttcattttgacccaatagataaatcaaatagatgctttcaaagttgagggtgtattttggacctgtgcgacagttagaagttctaaaatggacttattcctataaaagaaagagctcccttctagctattactataaatagactgcatag

SEQ ID NO: 63571 - DNA, 16034 bp, Oryza sativa
agctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctacatgggcgcgacatggcttgaacaggaggacaacacagcagcatgccgacggcgtgatgattcgatgatggcacgcatgggcgtcacaggacacagcttaggaagaagaaatggtgtgtgccgtctcaggtcatcatggagtagtacatgatgtttgctttgctaggggtatttgagaagagtgtgttttcttgtcttgaactgttgatgttgggggagaaactgtatttgtcggatctgctacagtactagtactcctactcttactccgtaggccggtacatttctgttgggtggaaatgggaggaagacttccggacccatcatttcgcttattcgcggaataagccaagcggcacatttgcaagcgaaaaataatttgtgaataaaatttttatatttgtagctatgcttatctctgaagtcgatatccggcgtcttgtcttggcgcatgttggcttgtatgttgatattgtatcttgatctattgtttcatgtcccctctcctcctagggggccttatatttatactcataggtatccccttgttcaagtagaactagggaaaccaatatggatacaatccgagtagtccttgtcgtttccatgtagaactctattcatccttccttatgcggaactcctcctatatccgaaggttgtttccgtataagacatggtatgtggtgggtcctgccaagatttagtcaactactataaggtatgtggtatccataacattgacaatgtgttcttagcgatccaaaagaaaatgctgaaaaataagcttcgatgaaaaaaaaaacctcaaaatcagctccaaatgtaacattgaaaattcaaatttggctgataagcataagcataagtaaaaatatgaggcccttcctctctgttctcataaaaaccggtactcggtaggagggatgcagcggttgataagaaaagtaaaatgtgtttgaaactcacaacgcgggaaaagatgtagtgcaaactacatatatagtggaaacatgaaaactaccattagaacgtaaaatggatgttcaatattcgtccacgtatgagtaaaatttttactcctgataatgtggacgaatatcagacgttcatttgatccaacgatagttttcagattcccactacatatgtagtttccaccctatattttccccttactacgcagcaaacatgtgacatagaggaaatccaaaatcagaaaatggaaatgctaacgcatttagaaatgattagactcatttcttagacacgcaaacaataataagagagtaaagcacgagagctgtcttgtttgtttgtgtaggccgaaattcaggcccacccatttgtatgccagaattgggcccatcaagacgaggccaaggttagctagtgggttgggctggtgtgggatgcttccaggtgatatttataaggcaataagttcatattgattcccttaactagtaattgaatctgattcgtatcctataccggatatctcgatcctcaactattaaaacggctacaatttgaccccatcgataattttagagggtggttttgccaacgtggctcctacgtagtgattttgatctagtcttcgtggtgcatggtggtggtttttttttcctttcctagctaatgcctattaagaatcaccgcaccatctggtgttagtcgtcgtaaaaaaaaaaaccggtagattctcgttagcgaacttgtaccagaactgctccgtccgtgtgaagcgcaggtcgggggcgtcaaagaagaatcggcatgagctcgatctcaaagcagaaaaatcgccatgcctgcgccgtctccacgcactcgaacgtcaccgacgaccccggcagccgatccacgaatggccgccagaggcaccacgtacgagtcgtacgacaacacacccttcgaagctcccccaggaggacgaacacaattagaagtataatagtataatagtgagttataagcctactataagtttacgtggatgagagaggtaacaaaaaaaatcaagagtgtaatggctctcatgcaagagctagcttaacacaaactccaagacaatacattaaatgtataagtgagagatagagagaggaaaagaaaaattgtagccgaccttataactaatctattatatatgttggctttaaaatggactaatagtatgaagtgagctctactaccatctttgctcttagctgcaccgggttcctggaaggacctgatcacggagttgatggaaggacctcttgttggttcttttctccaacaagagagagttggatgaagattaagatttttgtggcacgcttttcaaactgataaacggtacgtttcgttctatatgaaagttgctctaaaatatcatattaatttattttttaagtttgtaataattaaaactcaatcaatcatacgctaataccacctcgttttgcgtaaaaaacttaatattcatcttcatcttcagaagaaaagaacaccactatatatactatatgtgtcggttcttaatctaaaaccatcacctatattttaagaataggtgataataatttagaaaaaaccagtatctatacggagagaaatatagctgtcggttccagccccaaaccaacatctataatatattataggtgttatttttcttaaaaaacagcacctatacgaaaccgagccgagccaagccaaggagagggatcattttccacccgcccccgcagctcgaccctatcgttttatccgcatcttagcgctctctctcccttcccttttttcagagagtagcatagcgctgtccctttccgtccttctcttctccttcttctcttctggcaaggtgtccacggcggtggccaagggcaaggatagcagcggcgggtgggacgaggagtcctccacgtggtggtggtggccaaggacattggcggtggccaagggtggtggcggcaacagtggtggtggtggaggtggccctctctctgcattcgtcttcccccttctcctcctccagatctgccagccgacagcagtggcgatggtggtggaggtggcccttcttctgcatccgcctccccccttctcctccaaatccagtgacggtggtggagaaagctggcgcagagagtgaggtggcagccggaagcctaaaaggaggtggtggtggaggccgtcacactcctccccccctcgccaagcacttcgttgttggctccattgggccttttttttattatctcattgaatactatacatgttggttgtggggtaagaactaatacctataatttctgtatgtactggtttcagaactcctaggtatagatgccaataaattagtgtcggcttgaaaactgacacttactggcttttaaccagtacctatgttggtttctgtcgtagtggcggccatgccctcgatcttgtggaggagtctcgtgctcgccggccactgtgctggtggaagatcgagcagagaaaagcagcaaagcagcactgaattcctccttgcgtgacgccattagcgccatagttgcaaaataacccacgcagccgttgcaaagattaacccgtgctgagctcccccccccccccaaaaaaaaaaaaaatctttctcttgagcttgttggtgctagcatctgaatggagcctcgctgaagaatgagccggtggaactcattggtgcaggcagagctcaagctagtgctcgggtccgttgtgctgcacggctcatcgtacgctctggaatctggatgcctcgcacagggcagacagagagggagcgaagagaagcagaaggaaagaggaagaagaaggccctgaaaagctggctctccattactttatttttttttctaaccaggcataccaagtagacgaaaaccacgcaaatgctttgcgccgagcgtccgatgcaagaagctatcgtcggacgcgcgcggcttcgttacatatctacatagatatatgtttgatgatgtcacagtatacaacatgcaaagaaatagctacaaacttgattttcaaacaacattttctcccgtactatttattcgatttacgatttgattgcaccgttatattcgttacaattaaatctctataacaagatctcacatgatcatattccgatgaaatatatatatatatatatatgtttcaatcgttataattatatgtttcacgtatgagaaataaatgttccaattaggatttcactttgttgcaatttttaaattttctattgcaaccgatctttatttaatgtcaccgatagtattgttaagatgtttcaacatgtatttttcaatgtttcactattgcattcataaatattacctacaatgcatttgtcgagacatgcaagaaacacctcgtgcaacattcacaaatgaaataatgaaacatcacaaaatacctatttgaaacatcctgtgtgtgcaacactaaaaaacaccattgttaaaaagacatgaaaaatatacaacattgtcgagttccagctgaaacatttgttactcattcatgaaacattgaattataatgctggaaacatatatttttttaatcaaaatataatcatttgagatgttattgtaaagatttaattataaagatttaattataataaatgacatgaaaagtaagtcacctaaaaggtttctaaatgctaatataatactaatcaatacatgttagacttgttacaggatttgctgcatatagtgcacacgctgacacgcatgttgcatgctacagagttacaatcacaggcgcacggcaggatggcatgcatatgtcagcactcagcagcaagcaaaccaggcatccgatattaggaaaaatatcggacgtccgatgcggagtcgcctcccgaaaaccactctaatttggtaaaaactatcttagaagtgtaaattaaactgtattgatagttgagagcgtacgatatcaggttttaaatttaaagggtgtgatttagacaaacgtgatagtttgggatgtaaaatgggcttatcccttatcgctcaccttcaagagtcttgatgacattacgattcattctcatttagaaccctagctactttccaccccaaaatcttccttggtgccaccgcgcatcccctcctttcctcctcctccgaccactgtgcctcccctcctccttcggccaccgcacctcccctcctccttttctggccaccgcatctcccctcatcctccaaagctctggtggcgtggattgatgtttggttttgcaaatcgagcttggtagcgtgaatcgatctccgagggcgctagtcagacgctagcggatgatcgagctcgggtggtgtgaatcgatctccggccatgcaaatcgagcaccggtggtggatctagaccaagcggtgtggcaggtcgatcatgggcggagcagagaagtggacgatggcgagctcctctgcgcggcggtgtagtttgggggacggcgagctccctcccaggtctccatgatgagctccctcaccggccaccaagatgagctccctctcttccctctctccctttccttgcagtgcgggtcacaaactataggctagaactgacgaatcctagcacatcccaacgaggaacttgtgcccaaactaggatccgcgtacttcgcagagtaacgagggacgcagacgtggcatagaatctttgacatagctcgttgggggtagaatgacacctaatcacactgtgaaaagccctaacaagtgaaatatcacttgtccttataaacaccgtgctgttacggtggagttgtggatagatgtcttcactcactaagttcaaatcctgatgcttaaacatattatgcacacaaaggtgagctttaactaaaattttagcgagttgaaagatgtgccgctagactccatttctttaagtttatgtgagaagacaaatttgtgagtgtatacgtacgatgctacgtgtgtaatagtgtgtgtgcatgtgcgtatgacatgtaagtggaagaaactttacttgtccttggagtgccctgttattctttgtccttccccattcctcacctcaaacttaaacatccgcacggtcaccaaaaggacaacacgggaggaaaatgactgaatcccaaatcttgcttccctatgtttaaattgtagttttaaatttattgccaacaaatcttgcttaccgatataacctattatctccattttgaaatataaatgcttctaacatttaaaattagtactagatataaacacctctagcactattaggagtgcgtactatttgtctcgttaatcacgtctaatttattttttctaccttatgtccaatcacctttcgacttccaaccaaaccaactatctcttattaatattttttttctcattctgcatttatgctgaaaaatcttattcaataacatgtattaatatttatttttcacgttcttaatctatgctgaccaatctagagataagaactgaaaaattgatagctcctgatgagaataaaagattcatgtgtgatgcagacagtcatacatctcgacataaggaatactttatctgtcccatgaaaaatcaatctagtaattgtataagattcttcttagtaaaataaataaggaatactttatctgtcccatgaaaaatcaatctagtaattgtataagattcttcttagtaaaataaatgtggatagactcatatctaaattcattatagcagaaaatatctcatttaatactaagtttggtttttgtcgggtgagtaccggagtagaacgcagacagctctccttcccgcacctttcggtggtcggccaacccagccgtacggcactgtggcgaccgccggatgtgccgtgagttcgcaatcaacgagtcctcctgcgtaataattcacgatgtaattggacagaacaagcaaagctgcacgtactccattcgtcccgtataaatcaaatctactaggacagtacagcactccctccgtcctaaaataaatataattttacattgttcatatttatatatgtttgactatttgttttatttgataatcttttataattaatatttttattgttattagataataaaacatgaatggtactttatgcgtgactactttttctaatttttcaaataagatgaacggtcaaacgttggacacagataccaacggctgcacttattttgggacagaggtagtactaagagcaagtttaatagtatatctaacaaccggctccaaatcatttgtagtcaattttataggcaattcatacaatagttacctataaacatatactgtacaattaataagtctcacctgtcatacacacatgcatcttagagtccatgctaaagttggctataaatctgtagccctctactcttttctctccttttttacctcctcaaaatatgtttataactggcttataagctgctaccgtcagcagcgcgacatgcacaataaaacatgtattgtggtgcacggtgaatggcaattaattaagccgatgactgctgccgtaccccccaccctcccgactaaaaaacctaaactagaatttggatggatgataatctaatacaacgaattcgacatgtataatccaaatccaaatcctaggttagttttttttaatggagttttttttaattggacatctagctagggatgaaaacggtcggaaacgatacattattttattatttttttcgaaaacggacgaaaacggtcgggaaattttcatacttatgaattcatctatttagtgtcaatttcaatgccacgctgacagaaattaaaaacactaaattttgaaaacgataaccatcgctaaaaatattattattattatatagttttacggaaacggtgtatatacggtccgaaaatttttataccgttttcaccctgcagccttgatgttaccagtcacttgacttaatggctggcaggcaggcttatcacttgagtcgacgtacagccccatgatcaacagttcaaccttagtactccaaagaagtttattttgacttctttatgtaaatctaaaataatttttatttttatcaattattacatgagagtttgtaaaaataaaaaataaatatattgagagtagataaagtagaaaataattatattgagatttatccaatttaatataatcattataactaaatactctatgtcctattaaaaaacaacttccggggatgaacctggataagcatttatccagatccatccctacaagttttttttcattttttttcttggacggagggtgtaactcagaggattatattttgctcaaagaaatatgcatgtttcaatagcaaaatttcggttactaaaaatcaaaattcggttttttgcaatcatggaggttggagacttaaaaaaaaccctgtaaaacaaggcaactaagagagattttgctttaatttaagctcgcaacaagcagccaaagaataatggcactagcaggtacctctcctaggccaaaataagttgatttgtatattagttaaagtttatctagctcaattggttgtttgtcagatttcttgtggtgaaaccagtccaaatagatgcaagacctaaacttgataagagtgttcgttaattagttttttcagtagtcactattacataacatctaataagggacatctcatatatgacttataggtgtcagttgggagacataaccgacatcaatgttacttaagaggcccgcatataaaaatctattttcgcaaatagacctctaaatacacctgtatacaaaaacaagcctattttcgtagacggaacttttaagcagccacatgagaaaatgcattttcacatgcaggcctctcaaagccccacctacaagtctgacctttgtcctctcttccctctccactctcagcgccttcaaaatgtttaagtctcatccttatctcctcaccttctctccctcacctttaatttttccgtagtcttatttcctctctctctctctctctgtcacactccaatccggcaccgccgtacaacggcacctgacaggagcgtgtcgtaggaaaaacggcgcgaaccgcttcctacgaaaccgcaattatagtaccagtcccaggacatagtgctggtacccacggtgacaaatatgaatcattgcaatccttaaaataaataaaggacttatttaccttaacttatgttgtagcttagaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagctagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggcaaggaatcagggtagtacaatctacaggaattagtgcgactactgggtaggtccgtcggtttggcacgcaaaccgaggccaagcaaattaagtgtgtgattctaataatgcaagttacaaacaaaataataatgattttccaattatatgagcaattggtcaaagggtgacttgccttgctcaagatcttcacgaagcttcatgaatctacgagaaatccctgatcgacgaaaatccggtaaccgcggctatacgcaaacagtcaaaacctaaatgaaagactaaaagaaagaccctatttagactaattaatagtgccattaaatagatctcaattttacaggagtactggaagttgacggagtcaatcggagctacggattgagagatatgaattttggaagctcgaatgggattttctggactaggaaatgatttatctgaattttctggaatgaaaggaatggtttatggaatttatagaaataatattctcaagaatattattgacagtcactgacgtgcggggccaagggaaatgatttatggagcaaaggaaaaaggaattgatttatgaaaaagggaaaaaggatttattaaatcctttttggaaaagaaaagaaggatggatgtgatttagacttgggccgagcgaagggggcggggcccaggacatttgcggcgcggctgaggaaagtgggccggcgcacgggtgaggcggtccaaggccgggcgcggcccgcgtgagagggagccgaccgggcggaccgcggtccaccacgcgggatccggggcgggcccgcttgtcagcggctcggctcaccgatggcggggtgcatgcgagcgggacgctagggttagggggaggggcgcggtgcgcggtggacgcgggtgcggcgggcccacgcgcagcctctcggctcgcggtggaccgcgcgcgcgcgagcgggagtggagggaggcggctgaccggggtcagcccgacccaatccacgccgaggtggcgccaacgtggcgccttcgtggctgccatgcgggccggcgagaggaggaagacgaggccggccggaaaatggacggcgggcggcggccgacttcaccggaagcactacgcggcgattcgatcgagagggagtttaccgtacaagggggagcacggcaggggatgagccaacggctcggattcttcgaaaaggggccggcgacgacgaatcgcggcggcgcacgccggcggcaagaaaagggggaaacggcggaggggcgatgaggattcaattcaaggaggtgggagcatctccggggttcaaggagcccatttccggcgtcggatggggtggaagagcaccgaggagggccagcgacgagcggcggcctccgggagcgggcggcaacggcggcgaggccatgccgggcggcggcggggctaggggcagcgtctacgtgcgttcgagagtctagctgagctaccacgcgagccaaggaggggcgagggcgagcgagaaaaaggaacgggaggaaggcactaccgagccgggcgggcagtgatgggcggtcgacggcgcgtggcgagctctccagccttggacctgggaaggggaagaagaggtgcctggagtcctcgtctcgcgtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcaaggacggatttgacattctcggaatccggagaagtattggcaaggaattcaaggacaggattgaattccggtgtttgatttcggaagttgaatcggaattggaatcttcaggtggaggattttgatggcgatgagagggaacaacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcatactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgttta

SEQ ID NO: 63572 - DNA, 26709 bp, Oryza sativa
  unsure (1)..(26709): unsure at all n locations
aaatctccacgagctccctctatatctgtgaaaaataagacaattgctagagaaataagggatggggatcctggaggtaaatcacctcccactttagaagttacagatggaaagaaagctgtgtagaagtctccaggataagcaacagtgatgataatgtggtggttgagaagactgttgtgattcttgaaaatgaggtggtttcaacacctcctctcattctacctcctggaagaacatcagagaatgaaacttctagcaatgacagaacacagaagcccagtatggaattggagtacactgccatcagggctccaccttctccagctgttcttcctgaagctgagaaccccaccatccatagacacaatgaccagggtaattacgaggtatgatgcttatcttcttctcagttgtttacttaaggcttccgcttatcttcttctcagttgtttacttaaggcttccgcttatcttctcagttgtttacttaaggcttccctaaaaggttatctgttttttttctgtttctttgcacaaataaggtgtttatgaagacttcaactagaatgcaacagttacttttgttctattaaattccacaagttgaagtgataaaagaatgcttgtgatgactaggtgatgacggagcatctgaaggatgagactgaggaattgaccttgtctgctgtggagaaaccctaccaggccccttttgctagggtgacatcgttggagaatgattcagccaccattcatgcttacccccatgcactaccagttgaatctgaaacacctgtgcatgccgagagcattagggctcgagtactagacccagtatcgacagtttcagtggaggagacccctgaagcaaatgaaaaacctcgtaataaggaatcaaaaggcttcaggaaacttttgaagtttggtaggaagagccacacatcaggtacaatggattctgatgcatcatctgttgacggagccttagccggagacggtatgatactcgccccttaacaatccattacttatgagtaaatttcataataccagattttaagccatatatggtacacaaaacaccaggttttattaacaaggacaccaggttttattaattttcacataacactagctacatgcgcgcaagtaacataagtatataacacaaaacaccgggttttaacttttttcacataatgctggtacatttgcacatacaagtatataacacaatacaccacatatttttagcctacaactctcagcagataaggtggagccacataggctggaccatcaatcaggctagcaatcctgatttgtgctcctctggtgccccaccactttgacaaaatgctgcaccgctcaccatcttgcgctgtcttccatctccaaatcatcagtggacctccctcaacctctgctgcctcctctctgttcactgcactgcctcagcagccgcggcacggtgccccatcgtccacccccagctgccacgctgggcaagatgggcttagtgacacactatctaccctctaaccatgctcacaactgctactaaaaatgcttctgcatcgtgtgacatccaggcatgtgtgcctgcacgatggcacaacactgtgtcttcacattcagcaattgcctagctaaggagaagaattggagatctcctagttacagcaagcaaccgtcaatggaattgctctttgctgatagactgaaatccctactagtcttcaatggagttatgtgattactgatgcaagtataccacctactgtatatccggaaaattaaagtatccatcaattagccacgaccgggtacatgaaagcgaagaagctagcacaattaattcctcctatgttcccttgaataatattttccctcttcttaatgaaatgaaacgcattgcgttttcaaaaaaagcacacgcaagtaaagaagctgctagtctttaatggagttgtagcacctaataatgcaagttgcacatcggtcttatctcgtgccatttttgcttgcctttctggccgtctccaatggctgtaactgatcggtcatgggcaaacctccccgacagcctcatctaggacatcatccgctgcttcctgtgcaaggttgaatgcctccacgtgggtggcatctgccactcttggtggcgtgtggcgcacacaaacactgccccgtccccacccctgctcccgtggctcgtcctcctgaaaaccgatgagcacgggcttaccttatcatttgtccccagcgactgccgtacccattcttcctcccgcagactgcgctccccatgctactttggttcgtaagatggcgcttggctcttcctcgacttgaaaagccgagacaaagcttaaggtaactctgttgcacccgtcaactgaactaggatgcatcgttgctggtgtcattgatctcctccccccccccctaattgttttgtagtgcatgggtgatcgggtggtcccacagtcagagcaatttgagggggtgtggccagaaacggaggacatcctatatgaggatggattatttaagagaacatgaggggaattaatcatgctggaaaagagcagcttcttcgcttgtgtgtatgagtatcctatcgtggttaattgacggatactttaatttcctagatatataataggtggtatacttacatcagtaatcatacacatgcatggttgcctattttataggctttacaactccattgaagactatcagtctatcggtgaagagcaactccattgatggtatagggttacatggacctctaaatctagacttttgtgaaatttactaattatttaagttagtttgtttacggaaggtcatcatgtaagtagtaatggcatcctattaaaatcgagataaagatagaaaaatttaggacctatctattggtagtcacgtttgtttccaaaaaagaggaaattgcaattcactcaatgtttgtgggtttaacacttgttgctggtgcttaatgtttcagggtcaatgctgaaaaccctcatttcgcgagatgactctggttcttcatctaaaggttagaagttagaaacgcgctctcaattaatattggttgccttcaacctatttggtcaaatgcatttatgcatcggttgaataatttagtggcaggatttgttatgtgaaactagaaacctagctagtatctatattctatctggttttcacttttgtccttctttttagccccttagcgagagattttggcaagaacagcagtgcattctatgagttggttccaaaagttttcgtttggtaaaaatggatgctaattgtgttttgctataatgtggcctgcagcttctcggtcgttctccctactgtcaccgttccgcaggcagaaggtgattgtactgtgaccgtgagttggctgatcctgatctgtcatgttaatgcagcttgtgcattaactaatttgtttcttagtagtacatacacatacagacatgttagtagtacatacatactattgcctacatctgtgtacgttgcttgtaagctgtgtattttgagtgcgcgtttatgtgactttctgtatatgtagtacttggtatgcatatgtatattatgttacacacaagcacaaaacacattcgtttgatcgatcgattccatttgcatatatattgatgatgtctcgatcccgcaatgaagctgcgaattagccatgctaataccgttatatctgtcaattgtggaacatcgaatttgcagtgcacgacgagagcgagacttactgctaattaattttggatgtttcagaacaataataaagcgggtttgacgggagaaattgaaagaaattaagaaaggaaaggaaggaagaaagagcagatcgattacctctgtaaagaaattgtagtttagtacatgatataacaatactgatgaatgcatgaatcaactttgtaaaatggaaatggtgctttatgcccaccggtatcaaagcaatcgatcgatccgagcaaatctgaaattaattaaattaaagagaaggcaaaactgccgaagatccaagatcccaccaacagatactgtatgtgcataactaattataaattcagtgtatatgtattccttcacgaataagcaaagaggatttgattcttctcagcttcttcccaataacttttgaaacggaaaccataaagaaaatggacatgtgaaatggatggagcgttttgcatccagctagcagtatgatcatatatagtgtcgtactatggtaataggaataatatataggggcaattaattgctcctatccaacaggcaccttactgtccggtaccaaatctgagccatccaatcagctcaatcagatggtgaaaaatctgtggtacctccagatacaaatttgctcccatccagcgggtaccatcggtactagaatatttggagtggtggaagggtaattttgtcttttcgcgtagaagtgtccaggggagggaaatagggttttctaccaaatctttgccattcgatccgtgagaggagtaggcggcgagcaaatctccccttcccatccgatccgatccgtgagaggagtaggcggcgtcggcgacttgcttcgtcggcctggacttgatccgcgggaggcggcgggatccgtgggaggcagcggcaacttgcttcgtgggaggaagcggcggcgtcggcgagttgcttccgtcggccggagcgtggatgcggggcgggcagatttggggcgagcctgcgtgtggctcaggtgggcttcgcacgggcggggctgcgctcgccgaggggaggaaaaaaaagagattagatgagaaagcggtgccgcacggagggaggaaacgagaaagagcgaaaaggagaagagggggcgcgactactttctctgtttttcaatcgtacccttctaacatggacggatggatttatctctgtaccttccggtactagtacctaccggtacaagttgctggatgggagcaacgctcttgataatataatatctattgaagtactagtaatttctaactttttcggtaaaaagaactacagatcaaaatttgaggataaacggttcgaatgtcaattattaaatacaaaattactaaacctcgaaaggaaaatagagacaaaatcttgtaaatttctaatcttcagatctactttgcgattcgtactccaatgggcctctcctccaactctgatgactttgatgaacttcggcgactgatggtgacaacctcgaccaattagggccccggatggtggcggtgggagatgggagacagtgagatgccaaagccataggaataggggagactggtgggctagcattgacggtaggggcaaagcgaggcctctgattaggagtcgacggccaatggtgaaaaatctgacagcggagagctgccgaagatgtggaatacggtgggacaggggcacctcgctgtcgctagcttgaggaggagaagaggggtggaagggagagggagagaatcggaggaggggatggttctcaccggtgccgctcgtgcctttgggctttggcagctagcgagcgaggccgggcggtgtaggatgctggtggagcgagtgaggagaattttataatttgtaaaagatttttgaaattgtttttgtctatcaaatgccagtccctagagaaggtatcctatatatatatacatcatcaatcgatcattcaattggactcagctgcatcatatatatcgttctagctagctaggttagctaggttcattccatttccatttcaatattgttagcaacaatggctgcaggcagcggcagcggcagcaatcctaaggactaccaggatcctcctcccgcgccgctagtggacaccggcgagctaggtaagtggtcactgtatcgcgccgccattgcggagttcacagccacgctgctgttggtgtgcatcagtgtgagcaccgtgatcggtgagaagcggcagtcgggcgagggcggcgccggcgtgcttggcattgcctgggcctttggtggcctcatcttcgtgctggtgtactgcaccgctggcatctccggggggcacatgaacccagccgtgaccttcgccatggtgctcgcgcgaagggtgtcgctgccgcgagcggcgctgtacacgatggcgcagtgcgtgggcgccgtgtgcggcgcagggctcgccagggcgatgcacggtggcgggcagtacgcgcggcacggcggaggtgccaacgagctggcggcgggctactcggcgggggcaggggtcgtggcggagatggtgggcacgttcgtgctggtgtacacggtgttctcggcgacggacccgaagcggaaggccagggactctcacgtgccggtgctggcgccgcttcccatcgggttggcggtgctggttgtgcaccttgccaccatccccatcaccggcactggcatcaaccccgcccgcagccttggccccgccctcgtcctcggcctcggcaccaccaaggcctggtcccacctctggatcttctgggtgggccccttcgccggcgccgccgccgcaatgatctaccatcactacatcctcaggggcgctgccgccaaggccttcgcctcctcctcctaccgatcaccccatttttaatcccatgcacccttgcaatatattttattattcttcgatctactgttttaatttgttttttataattatatccgtaattcatctgtactgtctgtacgtaatctagctacatacatatatgtatggttgatttttcatatttgcaattcaattattctatattttcctacttcatcttcaaaaattgttgtactgtctccattgtagccacatgcatgtatactcttatatacaggaatgcgctaaagcgcatctgggttattatgccataattaaaacgcactcttcacggatgcacccccacccccatcccctgacaccacccacctcacttttcaaaatgcagtacaataaaatgatcactaagatcttgcttctggcatagtacattaattataagtaaattatctacagtactatacatagaaattggacgatgtatccatctacaccttttaagtagggagtaaattatttgcttgaagtgtaatcctaccatgcccctgtagtcctgcactgcaggtttcactcaacattaattaaaatcattttccgtttgttagatttttactacatgtagtattagaaaacctcacgtacgtataggattaaaacccatgatcttcacaagtgggcctatagctttcagtattttttttttacaattacttgaagacatgtgtattggaatcatccgatcatgaagggagtaaaataaaatattgacgtgtactggagtcatccgatcatagagggattaaaaaaaatagtgatcaagtccataggccgcaaatatttgaaaaaaatgaaattatactgttgaagttttttttaggagaatgacgacagaagatctgccggaatttaattaaggggtcaaaaaccacccaggaagacctagggaagagttacagcaaaaggagaaattaaggtggcctgaaagccactttgcgcaaatctatatcttgttttacccgatatgctactgacaattctgagctagctaaattttggaaaattctactatttctctctagctaaatgtttcaccaagttgtcaggagagcaccgcgagcgagcgttttttgaccttctctttctgcacctttaagctcatcccaccaggttgagatgcgggacggaagggaattgagagctaggggcaaattttgccacatacatactgtagtccatacttgtttaacaaacggacaatccgcgaacagatgattggtgtcttcgaaggcggaggtacacaaacagtaaatccaattacaagaccaatatcttctgagcaaattttgagccattaaagttctttggtggaggacaagccaaccaaaacatttcatttttggctcagcctgggctttacagagcgtggtaaaatcaattgcagtgtatgaaccagcaaactgatatatatatataagcactcttggttgtatatgttccagattcagtccagttccaaactatgtcatcaacattctgagtgagttgagcaaacctcccaattgcactagctcatgtatctcctcaactgaggtaatttgtctgaaagatgataaccaattgttgttcatcaactcgaattgaacccttctattctttcttctattctttctttttgctaaagagaaacagaggggagctaaatctttttttttctcagaaatatatgagatacgaacggttctacacaaataggcctgatcgtcacgcaggagagaagcgacgactatacttaggcggtattacagtggagtaaagcgaccgttgtcgcgcaggagagcagcgacgattttgacggtaacatggtggagtaaagcaaagtggtggacatcgcagttcggcagcgcgaacttgtgacgaaatcgtaagaccaagtgacgactgggacgttttcaaaaatgctcacacttagatgaccggcggggtggagaaaaatcggacgatgtctgccactgcagcatgttgcatgcaaagaatcttttcttttcttctttcttcaaaagatttttttatcgtaaactatttatctaatctacgatctgattgcaccactgaattcgttacaattaaatctttacaacaagaccacacatgattatatttcaacaaaaaaatattttaatttttttattgatttttttaatgttgcatgtggtctcttttgatgtttcaaccagtagttttacaatgtttcagctagtgtactcatgatgtttcactgtgtacggatcaaatgtgtacggatcaaatgttgcagtggaacgcgccgttgcaataaatcacccacatattttggaaaccctctattaagagaatttggtttgtttttttgttccacaaaaaatgtttcacctagtgcactcacaatgttccactatgtatagatctaatgttgcagtgaactgaaatatttcattacaacaaaaaacccacatattttggaaacctcctattaagaaaatttgtttcattttttgtttcaccgaaaaatgttccacctagtgtacttataatgtttcactatgtatacatctaatgttgcagtaaactgaaacattctttcgctatttgctgaaacattgtttttatataaagtgaaacaacaccagatttaaacgagtgaaacattttcgatctacttagtgaaacaattccgatatacctggtgaaacaccgtgcaacatttaaaaataattcaataataagctttttttttcatcggaatatatccatgttttgaagatttaattgcaacgaatttaatggtgtaatcggatcatgatttggataagtaatttaagataaaaatcagtttaaaagtagttttgcacgtaaatcggcgctgacgtcagcgtccgattttttcctaaagcatcggacgtccgacgggtagccctctccggacgttttcgaatgacaagagagcaatacgtatgtcggtggccgtagtgccacatcgcgggccctgccgcagtctcgtagcttaataccatgagaaacttaattaattaattgattagtgctcttaattgtcgctcgattgtctgtccacaaggccgtcgatgggcatgtgccaaataggcacccgcacagggccctcgttttttgggggccccatataaacatgaaggaccacttcagctatagtaatgcaacacaatatcagctaataggcaatagcccaatgggtagatcaataatggtaggcctgacccaaattcaagagaatgttgtgcgatcgttgatttcgccttctgttggttgctgagcgatctaattccgtgtggcgccgatttcagagatcgagacgacgagacgtcgatcccaattccattcacggcgattgaggcggcggcggcgatacaacttgctccttgcgattccaacgctccaagcggcagcggcgatggctttgccttgctaccttgtctcgtctcctagctcctgcctttctcctcctcgtccgctcatcatcgtcgactcgaccctcaacagctcgacctcggaggcttagacgggtaagattagatagtgattgagtagattatagatcgtaaattcgtaatattagaacacatattgcatctatataattaagtgaaaatatattttatttatattagatatgattttttaaattataggtcccactctgcatttcaccccgaggccccaaattcctatagacggccctgtctgtccagcaattaacatggatggctgagggagaatgattaccaccgaggggctcagatccagtggagctagcaacggcctccagaggcaccctcactgctctggcgtcgcccttgccttcgcctaggctagctgcgtacaagggacagggtgacgacgagctaggaataggatggcaacgcgggaacgccggtgaaaacggattcaggacgtcgcatcctccatacagctcgacaccgcttccgcttccgcttcctgacgtttctcaactcaattatctcaagagcaatcaaatccaatttaatctcatgaaaaaaaataccaaacagattggataagaagaagtagaggatacaagcttctagattccggaagcttcgcagtgtagaggaacaagagagagtgtggaaggaatagagattgacgaggttcagccgaaccaagcccgccgatgcctgttcttctgagttcttccccctccaggctccagccagtgcagcggcagctggttttgttacccccaattgggcttgatttgggcctctccttgaagagtagttgtcctgcgaaataagttcagtttgactcccttattaagttgccgaagctgattcgtatcctgaacaataatacggaatatatatctcgacccctcaaccattaaaatcggagcaatttgactccctctcgatggttttggatgatgattttactgacgtggtgcctacgtggcaatattggcttgatctttattcgacgtggcgttaacgtggcacttaggtgacattagaattagaaagtatgtgtgggacccatttatcattcacgtaaaaataaaatttgtgggacccactgtggggccttctctctttctcccgcggcgggcggcgaggggcaggagcggcggcgggcaagcggatacatcgataggagatggatgtcaagtaaaactaataggcgtgagactacatacgaataggagagagtacgtatcgtatacatcgaaatcctgggttcattaaatcgcagcagctggtacgtagccaaggccaatgtctcgtttcatagggaaattaaggtgctatgagatgacgcacgcgtttgggttctcgtcgctgaagagctgcggcggcggcggtggcggtcggtccagcatgacgtagctgctgtagtacacaggaggaggaggtggtggtggtggtggtggtggaggcacccacgagtgaagatttgcacaggggtgagcatgaccgccctggtggtggtggtggtggtggtagtaactcgtgtaaccgtgcccgtacgtcgnccagtacaagtgcatccncttcatcatctcctccgncnnnaacccntccaccaccaccgaaccatcctcctgctgctgcttattattcgcaatcgctgctgccttctcctcctcgggcgcctcctcctctgctgctgctgctgcttccttgttggcgttgccctctgcttcattctgcagcttgctgctgccgtcttccgccgccggcttattttcctcatctttcttgtcagcttcggctgcaggaggaggaggaggcttgtcgtcgttggtcttctcctcctcctcctccttgggctttgggggcgggggcacgacgaccgtggcgagcttgcctgtgcggcggtggatgtactcggcgagcttgtcgcctgagacggtaccggtcaccgtcagcttgccggtgctcaagttggtgtcagcggtttggacccctgcgcaggacacgagtacacgagcagctaattattaagttgctagtcaattactataatatatcgatcgatccatctcaaggctcaagcagacggtacctcacctctcatcttgagaatctttttgtgcagttgctgggcgcaggcctcgcagtgcatgttcaccaggagctccaccgtcgtcacatcgctcacctgcgaatggacgagcggcggccgcggggatggctggtgctggtcttggtcctcggtactagttgggggcggcggcggggagatgacggtggcgttgcgcaaggtcttgtggcggaggcgagcgcagagggcttgagggtctacgatgcccgtgacggtgagctggttgccgcccatgtccacctccacgccctgcacgcccttgctccgcaggatgcaccgcctcatcctcctggcgcaaccggtgcaatgaagctccacgcccaggatcaccggtgccggtggcggcggcacctgctcttcttccttgctccctgcatctgctgctgctgcagcttcctccttcttctctgccgccggtgctacttcttccacctgcttcgaattcttctccttgccgccctcctcctgcataattcactccaccgctcaatactcaatataattatctgcagactactggctgcatatatataataaatgtacacatgcttcgatcgctagcctagctaccttgtcgtcgttgagcttaacttgctcgcccatggcgatcgaattagaaggagtagctcagatcttcttcttcttctcagacgagctagctagctagcttcgaacgtacagaccagtccagatgactgatcgatactcagctagctagccatgtgatattgtgatatgtagtactgcacaatgcggcgacttatatatatgccccacctcagctagctagctagctcaaaatgctgcattgatttttctttttcccggagaatctctactgcctcatgccaaagcttctaataagccgcagccaaatatctatgtcaagcatatgcttagagctccatcgttttgtgttttgcttatctgtcaaaccaaaatctaaattttagaaatcaactttagcgttgattttgattttccttttaagtttatttttccagtattgacttttaatttactatcaatacatatataaaatgtttatcgataaattattttcatttctaataagtgttatggcttataatcaactatatatagacaatacaatgaagcaactaatctagggtaaatttgatccatccatttactacaaatttactatattagaaaaatctttattatccgcgatattggttgggtgccattagaattttttaaaattagaaccatgccatcaccatcacgtcttctgtcatcatatagaccaaaatacccatacacgtgagacccacatatctatttcttcttctctctccactcctttcgtttcccttctttgtcttcccctcaatctttctctctctcgcgcgcgcttgctcaagcaacaatgctcggcacagggccacaggtggcctagcggagcgggactggatagcaatagctggaggctggtgtgcggcaaggttgggcgcaagccattggatgtgtgaccatcacaatacagccatttgtggcctgtttttttctctctcttatccaacttagcataaatctgatacccatctgcaattttgtaatatacctcatctccggcaaaacatatatcggcgtaaatactctacctatatcattatttttctaattttacatgtgtaaaattaattacgaaattcttagcagtatgtaggcattttcatgccaatctatatgtcaattcctgccaatttcacacattatattaaatcttaaaataataatttggcatataatagagagttaaggacgatgttgaaggctagctaattagtaaggctgcgtataggtgttacatattattataaggccaatcaatataacggaacgacgactaaccttctcgatcatatcagtcattgatcatctaagacacattagataacgacacagaaagacataatttttattaacgaagtttattcgaagcctacatctctagggatgggatgggcatttggtctgaccgaaattttcggtctcggtcttcggtctttcaggcatttcggtctttgaaaagtgaagatcgaatttcaacgcagaaatgtcaggaccgacaaattcggtcttggtctcgatcctgactgaaattcagcaacattttcatatgtgcaaagaaataatggaaatttccaacacaaaaatcacaaaaaaaatcataagcacgtatgagtaaaaactcttattaggttgcatgcctagaagaagtagggatgtgaaaattagagtttgatcctattgaacttagtggattgtagattgcatttagacatttttttgttaatttagtctatttggttaaccgaggagactaaccgaattgaccgaacaaaattcggtctttcactacttaggaacgaaatgatgaccaaatttctcggtctcggtctcggtctttttctgcacacccctatccaggtatctgattatgggcgctcctccccaatcagtatagtacctagccattacaagttcatggccaccctgtcatcatctccttacgtgtctatgctacattgtagtcgtcatagttacattgtggtgcccctctctttatttaagagagtttctaagttacagatgttagggttatggataccacatacctaatagtagtcgactacatcttggcaggacccaccatataccatgtcctatacggaaacaacctagagttccgcataaggaaagataaccagagttctacatggaaatgacaaggactacccggattgtatccatattggtttccctagttctacttggacaaggggacacctatggatataaatacaagcccccctaggaggacagggggacacccaccatgagacaatcaacacccaacacaatcgacatagaagccacaacatagaagcctacatacgccaagacacgccgccgaatatcgacttcagggataagcacagctagtaccctacggtgtctccggataggagagacgaaagcgctatctctgatctcaccgggcacggattcgaggaggaaggctaccctgttgtcgactacgagtcagatcgtcagaccgacatgtcgacaatagttagataggctaccccaacattgtactggtgtggttatcatgaataagagcaataccggcttcggccaacaggatgtagggttattacctgaccgttcaggggcccgaacgtgtataaaaatccctgtctccgtctcttttacctcagtctcgcgtataccctagcaccgacgatccccatactgtccaaataccgtagtcgcgacatcaaatgtcgacaacagagtctgactctaacttcaccccttatcacatattacaactccaagtccaactcctaatagaactagtatattcgacacctattccaactccaaatccaaactgtaaccaaatagaaatagtatattcgacacctattctaaaaaacttcaccttgagaaatatacgtcactcaaaagtagtagaatcaccatgtctatccattggtcctccaaacctgggttgtcttctttgcagcttcactgtaagctgcccgatgagtctacatcaaacccgctgccttagaaagactccgctagccatataacttcttcctctagactccacttgcaacagtctagctccaccttctctcctatcatcacttgtcttgtcaagcaaaattggactcctacttagcggtcacatcatagactccagtttgttaaagagaacattttcttccttgtcttatgacccgagctaaaaaattcaatatacacgctttccaaaatccatgcgtgtttatgctatattgtagtcgtcatagttatattatagtgtcccctctttatttaagagagttgttgggttactagattcgactttaacttcacccccaaccactggcctattacaatttcaagtccaactcttaatagaactagcatattcgatacctattataactctaaattcatagaacttgtttatttgttatttgacacctattctaaccgttatccctcgaaaaagagtggagtagatcagtaattagcttaatagttgccttaattagcttgcaatgaggagaaggaatggtatagtactatgccgagatcgagggcacctcgatcgatcgccggggccggatcggaatagtgtggcaacttaattaattaattggtgttcgcgcgtcatctcttgtgattataaagctactccctccatatcataatataagagattttagataaatataacacatcttagtatatctagatttattatactagaatatatatatatatatatatatatatatatcatatctaccttatattatgaaacagacgagtagctaactggagacatggagtatataggtcgccgggcatttatgtacgatcacttaatatattaactaattattatagtggagtagagatatagcaaaggtacctcgataactgtaacgtcccgtcccgccttcccccaggaagggcccgcttaggtcacagactgccctcacagatagtggagtagagatatagcaaaggtacctcgataactgtaacgtcccgccttcccccaggaaaggcccgcttacatctgatagctttcataggtcacagactgccctcacaaaccaacacatgtcttttctgcacactttgtcctcactcgtgtgcacccgggaagaatttccgggtcggtcacccatcccaaattgctccaggccaagcacgcttaaccctggagttctttggagattggcttccggaaaagaagttgcaacttgttgatatgagtattctattaatcctattaagccctaggccgggatgttacaccctcacccccttaagagtgatcgacgcccccgtcgatcaaccccaggccaggaacgtcctctcttggccacgtccatgtgtccagtgccagcgtatgtgccatgctgtgtaaccactcccggtctacatcagccatgcgcactatgcctgcgcaactgtgacacacgcgcccgtgaaaccgcgagagtcggctctaataccattttgtaacgtcccgccttcccccagcgcatgtgccatgctgtgtaaccactcccggtttacaccagccatgcgcaccatgtctgcgcaactgcgacacacgcgcccgtgaaagcgcgagagtcggctctgataccattttgtaacgtcccgccttcccccaggccgagcccgccttcccccaggccgagcccgcttacatctgatagctttcataggtcatagactcacacgcgcccatgaaagcgcgagagtcggctctgatactattttgtaacgtcccgccttcccctaggccgagcccgcttacatctgatagctttcataggtcataagactgccctcacagaccaatctacaccagccatgcgcaccatgcctgcgcaactgcgacacacgcgcccgtgaaaccgcgagagtcggctctgataccattttgtaacgtcccgccttctcccaggccgggcccgcttacatctgatagctttcataggtcatagactcctcacagggcaacacatgtcccgccttcccccaggccgggcccgcttacatctgatagttttcataggtcatagactcctcacagggcaacacatgtcttttctgcacactttgtcctcactcgtgtgcacccgggaagaatttcccggtcggtcacccatcccaaattgctccaggccaagcacgcttaaccctcccaaattgctccaggccaagcacgcttaaccctggagttctttggagattgacttctggaaaagaagttgcaacttgttgatatgagtattctattaatcctattaaactctaggccgggatgttacaataacaggccagccagctgcgttcatgtatcctcgatcatgcatgttcaagggtatgtataacagctgattagttcgattttacctcaccccaagccatgccacaaagagatcactgctttaaaaaaattgaaacggtaattaactttaacaattaatccccctatatttttataggattagttaaatcccattcgaataaatatcaaggacaaaattaatgttgcgaattctcttatatttcaacccccagaacccattatgtttatttgtagacaaatgcaagcatcaggcgcaaatgtatagagctaacgcagccgacaatttaatttgcctcattagactcttgttttccatatataaaattattcagcgtaattagagtttgaagaaacaaagtatctatgtattatatataatatattaagagaggtcgtgaaaaataacgagctagccagtttgtttgcattgcagttatagaaattaccatattaattagagaaaaacatatttacacgcattaggctagctctggtgcaaagttcaattttacgcgtatgtgctagagttaattttgaacatacataataatcttataacaagcagaacgatagctagggttgtatacaaataaattcaatttctacttttaaaatctgttatatataaaactttgaatctatttaagcataagttaaaatctgtatatcgagtcctattccgtctaaaaaaatctagctacataagccatcacgtttgagaaaaagagagattaatttgttgtactattagattattattatgggtccaaataatatagaactttggtatagatttttataaatatatacttgtatatgaaatgcaatgtatttatggaaacttgtataacaaattcaattatacttttgaaatatactatatatatgtaaattataattaaatttaagaaaataaaaggtaagagttatgtataaaagcaacctgtaaatttaaaaacgcactgcacaaatttgggcgataaattttctagtaaattattgtaataaagaagttttgatcggagaaaattgaaatggaaggctaggccggtagctatacactgtttggcacatctccataaatctatatctgatctgcgattacgtttataaaaaatgatagattattttgttatcattttaaagaaaatataaaattttaaattactataacttaacaaataaattttaaattcaacgtggatgaaagatttaaagctgtgtcaaacatgatttaattaactagaggagatcatgcatgatggatgatgagagagagacgctgcacatgggttgtgtgggtgttggtcggctttaattcttttcttccatctgaagtgttgggaatcctgaatccgccacttcatgatgagtcatcaccgtcacaccgtccgtcctcatgcatatgtattttggacagcactggaactggaatatagtcccaatgcagagtgatcgatctagatacttttctgttttccacgtaacttcataaactaattcaggccaatcatgtactccgatcgtcctacgcacttataatttacaattctagaatatacatgaaaatatttggattctcgtgcattatattggtgtccagaaatacttatgtcacgtaaaagtttgaatattcaagatgcttatatttaagagtatatattttctattattagacatatagtagctcaatactaattaattgtatataaaccgtaggtgtatgaaccagatcgaccgactcataatcctcccacttactaaggacaatgctaatgtagatctatcagttttcatacttatcatgccatatggatatcatgtatagaaactatatattttatataatagatgatttatccaatcacctatcttctctttatttaactacataatttttaaacttggttttgcctagaactaatatcttgcatgagaatggtctatcatctttttcatctccttttcccctcttctcattaactctcttgtcattttttttcttacgtgacaatatatttaatactatagagactagctgaagcgaaggatttggtctgccgtaaattatgatgcaactagatgaatagattgtattgattggctttaacacacccaaaaaaaaatcgatcagtagcctaggattagttgggtagatagcttgcgatcgtgtgtgcatgattagtagtagttagttagttgttgccaccatgcttgatggatcaaattaatacacgcagctaggtagcttatttgacacctgtgctagattgctcaatcgatttgcttaatttatgtggtagggatctcctctgattagggagaacaaactaacacaacaatggaataaagctagatcacctaccctattaaacaacaaagatcattatagtaattaattattggagcactactccagtttgtaaaggaagaagaaagtgtgccttttcagctcagggacaaaggaatatggattcagaaaagttagcctttttcccattcatgcatggatcctgctccctgcttgcttccacagctgcacgcatgcatcccactcttgggaggtataaattgtttgagcagtttgcctattattatccatcctgtctaactattacctccgttaatttattaagtcctactaatatgatctttcgatatttatagcactggaatatatgtcattcgataataggttattacattttagaataaagatagtattaagtaatcggcatgttgagaatttagaaaaatcggatttagttcactctactaagttcaatttagatgcatggtttatagttttatgatgtaaattaatttcaccaccagcaacacatttttttgctttcttggtatactccattattactagctagtagtacaatcttgttgcaaaattaaattaaattggtgcacatgagcgagcagaagcaaagcaatggtgagcgcatcatgcataggtattgtttgaggagcttatggcagctgcaacatcttctataaactttagtttctcaaactatatattttaagggtcaagcaatctagatttcaagagtaaaatccaaaatcttcagtatttccaaacagtccagatttcgaagagtcaagcaatctacattctaagcttgtcataattttgctaatcattttgttactaatttggacaatcgaacacatcacctaattaaaggtaaaatctatcccatgcgcgtgcaatgtttagtgttatccagcgaacctttcataaaccatctcatcagctaatgatggttgagatacgaacacgcaaaatttccatactgttttcataccttatttccaatggtatcgctagtcggggtacatccatgcaaagtgcttcttttgctatttttagaagctgaaaaggagggtttacacttgggatgaagtggtcgccgtgtagacgtgtccctaatcaaaatatacataatcaataaagggactatacataggaatccaccgaaagtaaagaggaggctggccaagaggaaaattaagagaaggtcgtcgtggaggtgagtcagctttggtaccaactgaagctgaaagaaggcacgcagatttgagacttggggcatgacagatgagactacacgcacagttaagcgtgcaggaaacaacaggaaaatccaatccaatccatccaaatgcatggcagcatggagtactatactagtaagctaggatggagatgatggtgcccccaggtccaaatggcggtagagatgccacttgtggtatctctggtgtgatggcagcagcggtcgcaggcgaggcgcggcggtgcagccctcaccgcagcatcctctcagctcctccacgcatcgcccgcagcacctaattaataggataatcacttcacttcagttcatcactcgttcgttcgttttatacacattactgctaatatctactgtaagaatgaaagaaagaaagaaagaaaaaattgctggcattagcagagacgacgaacgaacatacaggtaaagccggttgcagtcgatgtttgcgcagttccggtgcctcaactcaaccacctctgacccacatgcatagcatctccccagctctgaactgcttctgtttctcccctcctcctcctcctcatcatcatcatcacctgctccaggcttgtacgttgccggtggcagggagagccgtccatcaaacacgaacaaattccccacccatcctgcagacccctcctccttcagataattggacactcctcccttcaatgtatacaggttccggaagcccttcttcctgggaacatagtgtacgggaatgaaacagactcgaaagaaagtcttattagaacgccagatgcatactatttccattccacaaagtgagaatgtcgatatctgcttacctaagaattgttgaatacacatcacatcttatgccaccagtgcagtacattaatatatctgtattttctttgtctataccatttagaggatctgaagaatccatctgcatacacacacagttacacactcagtaccaagtaggagtgtccagccgaaactagtccaataactaacaaactctactgtggcatacatcacagtagctagtcttacctcctgctctgactctgagagcccaaaggatgtgctcctgaagcagtccacattaggtcgctgagctccttgaaaatgtccaatatcccattcataatctgacaagaaatttttttaaaaaaagggaagtagaaaaacataaattccagtccaaaatcaaaagagtgacccgatagaacaggcagatccatcgagcttgtgatatatgaaaaacaaacctacattatgtttgtagttgaaaataggaaaaaaattacgaatatacttatttttacaataatttatatttatatacctgtatgtggagaatttgcgtaaatatacccgtccaaaacgcgggatcggcagtcccgcgggacggttggatgcatgcagatgcatgcagctgatccgtgaccgatccatgcagcggtcacgcgcggctggctggcggtaccgctggcgcggtaccttgcgtcagcccgcatgccacacgataccgctctttcgggctgcgagagcgagacggtgccgcatggctgggctacgggaccgccggtcccgcggaatggtagtgcgggaccgtctcggtcccgcgaaaccacactgtgaaagatgtatatttgtgcagattttcgccacataggtatataaacgcaaaataatgaaaaaagaggtatatttttaaatttaattcgttgaaaatatagttatattttctgtacagctcctatatttattcttaaaatacagttttttcttataaatttgtataagaaaacacacccttttctctaaaagggaattatatcaactctacatatatacggtcaatctacactataatctagacatacttccgacattggaaatttttctctcaatagtctccgactctctctagccatggtaaatatacaccacagatcataacagcaccactctaccaattacaaggatttatggttttgcctcctgttatgcaaacccttttttttctattaacacaacagcactaatagctattttcagccgtaaaaatatgcttatctctattcatcacttgttgatttggcagtacttaggaaacagctgctaaactatacaagtttgtattaaataaaaatatactttaccattcctgacatcgaggagcaaaagcctccttccagagctatctccagctgcttcactcgatgacacatcaaggcattttctagcttcaagtctttccctccactctgatggagtcaatggtgtagcacgcatgctagggtccaccaaaggaagatgtgaacaacctccttccaactgggagtttttatttgaaataagatgtctagagacttcatatagtaaattggattattttctaacaaactgtaatgtcctagtacagtatagataaaaagttcagatcttttcagttcgcacctccaccaaacagaccgagataaatacaaactgaagagacttaaatgatggaacaactacatgaatggaccttgcgctgtcaccaaaaagaaaacttgaaacactgcatttgaaaaacatgtattggtgtatactgcactttcgaaatgttgaaaagagctagggtaattgctctagaatatgctaagacatcaacttgtaaaagctccaaatttccaggcagtggacaattgattaataatatttacaccgcagatcagagtttagttgaaggggtgcacaaaggcaagtctcatgggcagcagaatgtgaggggtctcctgatcttcatggaagatgcagtcgtggagttgggaagatttactttggactcctgcctagtaatggaactggaacagaagttggggtagctactcactccgttactgaggaaagacaggatgccatttccataaatagactcttcttaccaaatccttatcctgcgctccactcaaaatccaaaagaattgtttccagctttgttataccaagagaattattgtttttagataatggaaatgaattacattcccaggttctgccgttaggcacccagccagcccaaagaatataagaaacccagttaaggttcacagcaaaataaacatctcttccagagcaggaatcagtacgatagacaagttattttttcattcaaatgtaacagcagcaaaaggagctcggaggcataaggttgccaccatatagcatcaggagaaggtctaggccattttaaaatatatcaatgtatatccaggagaagctctagaaactcgcacgtctgattatttgctcagtatctagacccttgaaagaaacagtttcattattttttttatacacattgtatttccaatcatgtaaaaaaaatcatctacattcagttagatttagaagtttagcaggttagtagaagaatattttttcctgtatgacaatcttcagttcattgagacacttgagaaattcaatatagaaagcagatcagcgtatccaggtaagctattagcttctgtttcccctgtgcagtagaatgaaagcatggcttacctgaacaagcgatggtttgtaccgcagtttcaagcgaggaaaagcatggccacataacgatggtgaagtttggacaagtagatcacgaaatcgatggtcttttctaagccagtctgcatatgctaccgcatctttatgtggaccactgtactgtgacaagaggaagaaattagagtagaaattgatataaaaacaatcatattatgtaataatttgtacatgtaatgcagggctcagcacattcatattatggctagccatgctaaaaaataaacattttaaagattttcaggttttcttcttcatacatgttaatttattcattgctgcttaaaagagaaaatgcaaggtaaaaggcagtgatattattgtagaaacatatgtacatcttcacagttgtggttgactttgttgttaatctactttttagcttattcacctggttattgaaacatattatttgctccacgcttctaaaaatctaaaagtaatgtttattaaaaaatttcttctacggcattgcttataccagttattttaaggtattagttaagtttattttataaaatatttaatttatcactatactcgagtagagagtccacggcaataatctaaatcaagccggaccttaagcaacacatgtgcttgttactaaacacaatcatcattcattcatgttaccatgtcaccagtctcagtcaagttgtcatataatgataaaagacatggtaaataccgtagtactccatgttggtggaagcactagagcgatataagaaaagaaagaaagaaatgaaacagaagcttgttttacctgggcattgattccctgctcgttcatgtaaatgcggccatgtatgtcgcggccctgagagagagagagacgagtacatataaattcttggtacaatcaaatcgagccttgttagctgcaacaatttcacatagaggagaagagggaagaggaagagggagagaaggaataggaacctggaggaagtggaggtgcctggacacctcggcgcgggggtcgtcgatggagacgaacttatagaaggtgacgacgacgaactcttggggttgtgcaactgcaactgtggcggcgcatacgggggacgaggaacaacatcggacgagggaaggaggaatgtgatgggggcgaggcgatagttgtcgaggcggaggcgtgggcgtcgacggggcgggaaatacgccaaggaagcggtggacggcggccgccatggccatggccacaaccactcctctcgtctctcctcctccccttctattctatcctcttcttcttcttcttcttcttttctttttatatcaaatcaacaagcaatctgtacatcaaaaaatggtaggtgggccgg

SEQ ID NO: 63573 - DNA, 622 bp, Oryza sativa
ggatcccctttttgggttgaaaccacatacctcttgtcactgcactatcaaatgcatatcagagcactgcagcatgatcactaaactccctctccccctaacgactgcaaggcgccgcgtcctccaacccacagtgtgggtgatcgcccttcacattccagagcgccctctccccccctataaataccccactgccagcctcatcttcctccacagcatccatcgcaaaatccacctcagctagctacccaagcgcacgcgccaccgcccgcgcgcgagctgagctagcgatcaacaccggtcgaacacctagcgagcatcaccaccatcatcaccatgcaggcgtacatggcggtcgccgccgctccggcgccaccggcctcgctgacgctgctgccgcgcaccaccaccgtcatcagggacagggagcgcttcgacgcggccgtcccggtggcgccgctcgtgctgaggcatggcgccggcgtcaagcacaaggccgtcgtggtgatgggcgccacgggcaccgggaagtcacgcctcgccgtcgacctcgccctgcggttcggcggcgaggtcatcaactccgataagatgcagatacattccgggttggatgtggtga

SEQ ID NO: 63574 - DNA, 1998 bp, Oryza sativa
  unsure (1)..(1998): unsure at all n locations
gagcccattggattcactggacctttanaacctgacataccctggnaaagncgaattgcagaagaggaagcaacagaggtgaatgaggcaaggagtcaggtagttccgatagttggaaatcatgttgatgatgataatgaaatggcagatggatcaatggggggaggtggagaaaagcgtacaacggatgctcaattagcatccttggtgcggttctgttttcgagacaaaatatatactcggagggagtgtgaggagactttgttgatgaatggattgagtgttgatttgttgcaccaacattcaaaggagtatgatgacacacatgaagaggagggatatgaagtttagtatgccgtaaactcagatgacgatcatctagtagccaaaatgtctcaagaagaaagggaggtgtttgagaaattagttggaccccattcagacgttgttcacttcgaggatgttagcgattatgagctaccagctgttgatggaggagttacatacaatggcatcatcgatgcaatgggtgaagacccaaaaaatggtttggaatttaaatctcttgagctattacagatattgctgcagagttactcgatcagggtgcatccgtccattccatgtgaagcactccaacgcttctaaaaagtacacggtggcttgcatcgaagaatcatgcgaatggcaggttcgtgcatggaagactaatgatgggaggtggagagttaccggtgtaggcaaagagcacacatgttgtagtgctgaggcttctggcaatcacttgcaactaacttctaagttcatcggtaataggttgcaaccatttgtccgagctgagccgacattgactcatgttgctatagttgaggctgtggaggccatatggcactatcgtccttcgtacggtaaagcttggcgtgcaaagcaggtggccatgaagaacatatggggagattgggatgaggcatatgttcggctcccaacgcttctaaatgctattaaggctaagaaccccacaatgcattatgttgttgagcctcacccagagaggtcgaggccagtggatggggtaatgagacgtgtatttgggcgtgccgcatggatctttcggccggcatggactctagctggcatagctacagatcccgaggatgttgaggagatgaacgagtatgacacccacactcgagcaagagcgacggtcaagtacgggcctatacgtgaccgagtggtgagtattaaggctcagagttgttcatttcacattacacctacatgttctcacaatattaaatccacttgcagacacgtgagctgatgaggtccgtgaacgacgtgggtgttgcccttggcacacccgctgggtcagagaatgaagttgggatacttcggagcgcacttcaagtaattaaccaattagttcaatccatgaatcatttcacttgcctctaactaatttgttttgttcttgcagaggctaaaacaacgaagtcggatgttagcggcaagacttggttgtaggtccacagacgcagttgacccacaaccaagactaatgtggacacaggccggagaaacaagtcaacaaagagctgaagaggaaggggaggaagaatatgatgaaagggaaagagaagatggacagagtgacgaataggaagaggaacaacccgaagaaatcgggtcatctcagcttgcaggtgccccgcagccatcgcaaccttcccagggtcgcccgcaaagaaagagggccccggtggaccggtacacacctttcactagtgcccgaagaggtcggcactagtggattactttgtacttaacactctaggcagcgttagacttatatccaactctagatcatggttgatggatgtccctgaactctatattttgtgatgggtgatggatgtgaataactcctaatacaatgatggtttgagggatgttcttgttgctttgaagtggtaaatattgggtggctggcaaattttg

SEQ ID NO: 63575 - DNA, 15819 bp, Oryza sativa
  unsure (1)..(15819): unsure at all n locations
ctctctcatcaacttacaactaaattttggagacaaaaaaagtgtgcaaaacatagctccaaatgtaatatggcaaaaaaaaacattagaggatgaagttgcaaaccttttaggcaccttcgatttgtatgtaatcaccaaaataaattcactagaaattttggcatgacctctcctcttttttgaagaaattttgaagcttgcttgggcagctagaggaggaagaagacatatatataggggtgggactttagtcccgggtggtaacaccaaccgggactaaatatcccggggggcctgacaggccctgacagcatttgaaccgggactaaagatgatctttagttccggttggtgttgatcaaatatgcccgttaccctttttaaccgggactaaagatcatctttagccccggtttttattgcatccgggactattgtggaattcagccgaccgacaaaagatggtttctccatcagtgaagacacaatgtgtgtatgataggtgggaccatatattaatagtatagtaagcaactattactctctccggttccatattaattgacgttttagacaaggttgatgtcaaatttttataacttagactatcaataactttaaaaatatttagtttaaaggaactagaacaacatatatatatatatagatttgtcttttaaagtactataacaaaagtaaacatgcatttatttattatatattataatagaaaaataaggtcaaatatgtatcttgtagaccgtgtcattgtccaaaacgtcaattaaaatgaaaccggagggagtatgtgaattggctataaatgaattggagctagtagtggactatactattaacctggctcaaatgccaaaattggcctgttcagtttcctcgtagctaaactcttggggtcaaaaaaaaaaaagtcctgttcctgatgagagagtgagacgtacaagcaaaatcaagggagaaattatattagcttgcatgccgtccctttgtggctgatccgacattcgaggggggcgcctcttccaggatccgccttctccggctacgcgcctctcccaacgaacgccaacccagacaggctgcctgttcgtcccccaccacccattccgattccaccgcgcgcgcacgccatgagcgagccggccaccaccacccccacccccacccccgccggagaccacgacgcagccgccaccgcatgcaagcctgcggagacgaccacggccctgatcacctgcaggagcagcagctgcagcgcccagcagcagcagcagcagcagcagcagcaggaggagccgctcggcgacgaccagctgggtgagctgcgggagatcttccgctccttcgaccgcaacggcgacggcagcctgacgcagctggagctcgggtccctcctccgctccctcggcctcaagcccagcaccgacgagctggactccctcatccagcgcgccgacaccaactccaacggcctcatcgagttctccgagttcgtcgccctcgtcgcgcccgagctcctctacgaccgcgccccctactccgaggaccagatccgccgcctcttcaacatcttcgaccgcgacggcaacggcttcatcaccgccgccgagctcgcccactccatggccaagctcggccacgcgctcaccgtcaaggagctcaccggcatgatcaaggaagccgacaccgacggcgacggccgcatcagcttccaggaattctcccgcgccatcaccgccgccgcatttgacaacatcttctcctgagaatatagcatcagtggcattcacatgcatcgatcgcggctgttcatcagccgatcgcttcgtcagatgtttgggggagatcagatcagatcagaattcagaatcagatcagtggggtaaatttaggtcaggtgttcttcttcatatgtgatcgagctcttgtgaataacgaataaatctttgtaaaacaaacagaagtaaaacatacgaatttcagtttagaaatgaactattcgtgcattatctttcttctcatgttggtctgttctgcaatggtcgtcctcaagcaaggtcattagtgattgtagttgtaggaaggatatcaccaagaaaaacaaactcaagcttgtataataatagtataatactcccccctctcttttatattataagacgctttgactttaaactgttttaaatctgactaagtttatagacaaatatagtaatatttataatactaaattagtttcattaaatcaataattgaatatattttcataataaatttgtcttgggttaaaaatgttagtattactttttttctataaacttggttaaatttaaaacagtttaactttgatcaaagttaaagcgtattataacctgaaagagaggtagtaatgttcatcctccctgtgttgttggagttggacgttggtctcaatcatctgatggtgaggtgctggatccattgctggatcgatcgttgattcagtgcattgctgatccgtcaatcttcgtactcccaaatataaaattcagcgcattgctggcaaattattgagttttccctctgtcttcaactttaagtttattggtattctagaattaataagtgctggacaactgatataggcaatcatgcatactcgcctttcatgaactcggtcttaatagccggaaatattggatgagaatttgtcttgtcagatctgtccagctaaaattccagaacatttttttttcatttttggatgaggccaatagttcctcactacgaatagtttggaacatttcagatctgtccagctaatagttgctcactaagaatctattatctattatatatatatatggtaaataaaagttcattaaaaatcctatagacgctcttaagcctgatgttgcattctataaactcctaaaccgccacgtgacagcggcggcggcgcccccttctccttgtagcggcagcggccccttctcccgaaagcagcggcggctacaaggaggcagcggcggaggcccccttctccttgcagcggcaacggccccttctcccggcagtggcggcagcccccttcgccggtagcggcggtggtcccctcatacagatccggggaggaagcgagaggaggcggtgctatgcgcgggtaatttttcctcctgtggttgaatcggtgatgaatgtcgtgtgagattgatatgatcgggaggggaggagaagcgaagcgagcgctcaggaggaggggcgttgcggcgctagcttttttccgcatctgattattttcgttcttttttttttcgcatccgcttttttccgccgtaacagatggacatagagatagtgatagagaagagaagtagcaactctgtgtagttgctttgcacggcccaataactgctgctcggcagctataggcctctagcgcttgctcaagcgcgccagctcgggctcgggccggagagaacggaatgcttcatctcaacaaggcccgcgggcgcatgacctagatcgaacgtcccacacttctccacaccttacgcgaccccgaacctaaaccctctgcgaaacgctcctcctccggacctccgcccaccctcccccaaaacctgacctcgccgacaacacccggcggcggcggcggaggcggagatgatcaagcggcggtacttccgacaggaccacggcgacaagagcggttcctcatcgtcctcttcctcctcctcctcgggttcggactcggacagggaacctgcggaggaagcggcccccactgaggaagtagaggaacagcaggaagaacaagaagatgagcagcatgtgggggaggaggattcgggagaagagcaggaagaggagctagagccagtggtcgaacaagagagtgggttcctataatttgtgagtttacattttctcgtatttgcgcaactgggatttccgaagtgaccacgtgagttttgctttgtttcctcatgccaaccaggttcagggtaccaaagtgagtacagctccggtaacgatgttgatgaaccttctgcaggtattctgcgttcctgctgataaatctcagctttttgtgtggacttctctcattcgatttggcgtatgagagatctggatgccatcgttattgttatttcttttgagatttgcaggagttttgtaagaacgtgaattgtggtttagattaagttgcattttcttgctcttctaaggacctctattatgttagatttcgtatgtttggctgtttatagcatatggaggctacttgcctcttgcatttatattctgcatacaaaatattgggcattgcgtaatttaacatcgctatctctgttcttttattccttttcattataattttgtagaagtatgatcatgcagtgttatgtgtaactagcatttcttttacatagtctctctatatatcggtgaaccaccactgttagtttgtgtttccttcagtgtttgtggtgatttatgacacaaaaattaagtgcctagctaatgtggatgtagttgtcttaagctcagggatctcattttggtactccatggtttagctttttcaaaagtgtactgtggctagtattaattacctgcccccagcgtccttgtgcttcatttagttcaatctgggatctgatcactttttatctttctgatggtcatgtggtacacttcttatcattttggtatcaatagttcctgcctggctgcctatcataccaatttcagtatttgcatggaataatgagttaatgactgttagcaaagattcatatctcatttctcaatgaaagctcattaatcacttggcctgaagcattctataccaaatcatcctatggaatgtgtttgtaagaataatcccgtgttatgaatttattctgaaatgttgccgcaagataagtctctaaaatgaattgtttactgatggctttgctttcagatagtgatgagcatatcatcctaagacatgaagaagatcctgagataaattcgtctgttaagagagcctcaagtggtaaagctgattcaaccaaagatgcatctgacacggatgatgctcttgaggttgatttcaataactacattctgaagtgcaaatctgtgtacaagtgcaagctttgtcctagaatcatctgcttaaatgaggagatggtcagggtacatcttaaatcaaaggtgtgtaattcaggtggaagnaatataaatgatgggacttatctggtgagaaatacctttgtctcatgtcttaattttggtttggttcttgtagagacatgctcgatcaaagaaattgttaggagaaggtaggcttaagttgatgcttaatagtgatggtgagttggaggaagagcaagagacacatgctgaacgacatgctcgaactgtagctcttgctcaggtgtttgcccaaatcattttataagttttgatttcttatgtgcaaaatgttttcgtaaattaaatttgtacttgttatggcatctaattctgatcatgctgctaaatgtttcagcaagtacaaaaatcaaagaaggattctggcaggcagcgccaaaaccgaaggaggaagaaggtaaagtcacacccttttgcctatgcttttgttgcaaagcacatatcgaaggctttttaggcttcatatagaaaagcctattgagctcaaagcttgtgcaatatcatacttatcgtttctctagatcataatgatctccagcagtaccaacaccgtggagatcatactaggatgatgaacatgcttcaacaacaattcagtttctattttgtggtatttgcatcagtaccctcaatgtggatgctttcctcacagttatctgcttttttttttcagagatctcagaatcatgttgagaagaaacagaagccactaacatctgacaagaaaaaacgcaaaattgaaaagtaaagtggatggtcagaaatgttacaagtttttccccctttctcaattcgcatatgctaacttttagaggtaaaatcatgtgatgtttctcgagcctttgctggctgttttttggtggtcgcatatgccatcttttagaggtgaaatcatgtgatgtttctcgagccatttctggctgtgtctgtgtaagatttgttagcgacaatttgctgatactatgagatcacgttgaatgggaaattaattgtctcgcttttttcactttcatgttacaagaatcctatttatggtgaaaaaaggttctataacgtttgtcagaaacacactcaaaaagcaatgaataaaataccacgaatgcataataaatttccaagtttaatttttattctcttgttacgttttctggaggaagaaaagtaggtttgaaagagatgatactggcggtcataaccagggccgtttgcgggcgaagaggaggtcgaagagtgcgcttgaaaacacaaaaatgaaaatggtgagcattgcaatgggtcgataccaccgtaaattggctgagtgtaacctatcgcatgatttttttttttaaccaacagctttttatcgggagttttcatttttatgtgaccaggtaggaacacagttattttagagtgcgagcaggaactctttttatagtagtagaaaaaaaataatgtaatcgatcaacattacgggagatcaacgagcgattgatctctacgcgccttcgagatactattttcattctaaaatataataatttttagctatatatatggccataccttcttcggagagaaggtagacacatcaattatttcgcgtgttcttatgagttacgagaactaacccaaatgtgaagttaaaaaaaatataagtaaggaaaaaaaataaatttccaggttatttttaataatgtttattaagctgtaacagctattgaatttttgaacttggttatataattgattcgaagtttatttcctcattcttcgttggttgccttctcttccatatccatactgctaaaagccaaaagtagaagtgtaaacgtctcaatctaaaactaatttttattgcaatgatcacgtttcttcagcttgtaaaccttcggccttgtttgtttttgcttttttattcttacaattctgcttctttacagtgattttcagaggttgaattattaaaagctaattctgatttgcctcttgataagaaagaaacgtagaatttatatgatactcctagggacagttttagaacattactcaaaatccacaaaagcagctccatatcagcttttcgatgttagtaaaacaacatactgccaactactgactctaaaacttctatagccaatctaatagcccatttatacaatagttaactataaaaatatactacaccattaatacccggtcccacctctcatacacacataatatcttggagtccgtgttgcagccggctataaatctgtagcccgctttattatttctcttctattttcttttctcgatatatggttatagccggcttattacttattgtacctgctctaagaatcaagctgtttgtttttgtcctttaagcaaaagaaacatggcctagccagacccggataaataccttccaagttccaagcaagaccaagaaaacaatgctaagtctggcttaatgcctcgattgtagtgttgctgtggtcatttttcaaacaacagccaaatacccatgtgttacaatggattttcaaaaaatgcattcataagttttaaacttgaaaagttttgtatctgaatcctagaagagaacacttagctcgcgaataaacatgaatccacaaataacattattaaaatccaaacgcacaaattcctatcagggtgtctgttaattagaggtatggaggtgtccatcacttatcagttttatttataaagtacaggttattttaggaatggtttgtgatagtaaagtattttgtaagataactgttgagtggtagtaccacgtggcttcctttaaatttcaaaaacatacacaaggctgaaaactatttttttttaaatgttgcttcaaataattctagaaaatcttgaaagtattgagaaactataaaaatcgcctatagtaataaaacttatttgtcacataaaaaacaattttagttctagaaactattttatgtgacaattatatttgattttgtcggtgcataatttgtactagttaaactactctctgcatttttaaaacactacctttagttttaatatgacacattaggaagctatgatatatgggccctatgaaaattttaagtcaaattttgctacaggacactgctatagtgtggttttagccgtgggacactacccaaactcacttttgagggaaaacacttcataaacgtgataatttgtcaatggacatcacgccgattaaaataacgatttccggttgaggaggagagagaaatcacgtgaaatgtcaaaaatgcccttggggccacatgttagctctccatctctcttcctccctttcttttccttctcccttcttcttcttcctcccaccgcagccttcttcttcttcctcccaccgcaggtgagcagcggcgtaacgcacagtcggcgcgacagctcgagccggggcggctcggcgcgcggccagggaagcggcggcgcaacgcaggggacccaccaccaacgatgacgaggcgcagtggccacccggcgcacgacgcgacggcaagcggtggcaccgagcacacgagcacggcggcggcacaatgtcgttaaaattgggcacaaccggctacttctacacgatctagggttcatagggatgtcaatttcacgataatataacctatgttgcattgggattacgtttacccacagggagcacaacggtggcacaatggcgaccgggccgacatggctacggaggcgcctgcccgaaatcaagggggccaccggcttctaggtcactaggtgaggctcgcgacgtgcgacgtggtgcggggcggtgcagaggcgaaacggcgtcggcgcccgattcttggcatctgggatgcgacattgggagcaagattccagcggtggcgatggcgagggcggtgcggcggagcaaggccgggtcgagctcgaggccgacgaggaaaaggaagaacgttggcgtcgtcgaggactccgacggcgtcgtcgaggactccgacagcggcgtcagcgaagtacgccgtcaggtgtggaggatgaggtcctctcgcggccaccggtgccgactaggccgcgcgcactccaggcatcgccgccgtcaccgagcaagccgcgaccaggataagagagaaagaaaagaaagagaggaagagagatggagagctaacatgtgggcccaagggcatttttaatatttcacgtgatttttctctcctcaaccggaaatcattattttaatcagcgcggtgtccattggtaaattaccacgtttatgaagtgtttttccccaaaagtgagtttgggccgtgtccgacggctaaaaccacacaatagcagtgtcctgtagcaaaatttgccaaatttgaattgggaaaggatgtcaaacacgtggttttagagttgagagacttctacttttagccattactaatgcaaattcgaggttcacaaaactagtacggggttgtgtccttgtgggcctttttttccagtagagtgtaactacttgcaactttcaagttgtgcccgtgtgggtcttttcttccgatggagtgtaactatttacaactttaagagtccctttgaatcacaggaacgagaaaaaaaatagagaaataggagaaaacacatgattctgataggactctgatatgttatggggggtcgaatggactttattccttctattttagccattactagtgcaaattctcatgttcgaggttcaaaaaaactagtatggggttgtgccctcgtgaaccttttcttctggtggagtgtaactatttgcaactttgagcgtccctttgaatcgttggaatgaaaacaaacagataaatagtaaaaacacaatattctgataggaatgcaaatgcaaaataaaggattacaaaacaaaggaataaccatttgattcaaccgaaataaaaccgtaagaattggatgagagacatagactcaaagcaaaatttccaagaggtagaagctcttgctaagttttctccaaaatctctataggattgttcattccataagaatttcaaatgattggatagaattcaatcttttgtttcaaaggtcttttataggattttttaataggattgaaatcctctaaaattcgtatagtattccttcaaatcaaagaggcccttaaaaatagataatctctaaatgccatttttaaagttgattctatgtgttttgccatggaagtgtggtaactagtttttttctacttccgccaacctggcatggcacattgaggtgctaacatggaccactaatgcataaagtccagcttgccccttctggagcccaccaataagagaaggacacagacacatcacttagaacctgatacactcacagctgtagggtgacctgtactttcgatgagttgaagataacaaaagttgtcgacctgactacaacctatcatatgttgttatgttgcgccttagcgatcaatacatctttctatgggttattgatctggccggtgcatatcaaccttattcttgcaagtaaataaaagaaacaagcaagaacaaggaaaaacaatataaattgcaaacagtaaataaagctcatgacaagggaggtttcaaagatgagtaactagacggccctgccaacacgcgcaattacgaggtaaagtaacactggttaaactttaaaataacaaaactctgaaaccctgaagaggtatctagatatttaagaggtgggaggacgactaaggcatccctagggtcgtggtccactaggttggggagaactctacatggggccgcacttgggttaggccctagatgaagttacaagtacatagaggccattatagatgacgcaacaccttattcctagagtgccgctaactgagattgaaatttgaggcgatgctgaatccgtaggaaataaggatctgagggctttccatcaagtacttatggacctaaaatgaagctcgtatgcacatttggcggtcattcgaagtcagtgatgttataggtggccaaattggatttcaaaacttgtgtagctgatctcaatgtctttcagtgaacctattatgtgagcaataggttgtatccatagtagttaaggtcttgtaacatcattaattattttagcaaatacaactattctaggatgtgagggcacacaacaaagcataaggataccacgttgctcgccttgcttagagcatccctaggagatacgctacccgatcctccatctgtaatatggtgtataagagcggaaaacccacctctagcagatgcaccatccagtcatccaaaagtggcggatgttccaaacacggagagagaaaagccaaaaatagcgtgtctctctcctcatgccaaatcacaaccaacgcgtatggatcaacctcccacccccatctagacttccgcgacctcctctccatcgccgtcatcaccggctagcaaaggtgagtattctgtgccagtttttgttttattttcagcggagggaggagagggagggtgtagccatggagtgagagtggagagggagaggcgtaccagatctagaaggagggtgttccttctctgcgccctcgtccagttgtccaccaccgaccctcggccgcacgcccgccgccgtccctcgccagcttgcctgccgcccctcacctgcccgaccaccgccgacactcggtcgcccgcccgctgccgtccctcgccagctcgcccactgccccttgcccacctggccaccgtcgaccctcggctccacgcccgccgtcgcccctcgacagctcacctgccgtcatgcctgctagctgcatacgtgaccgactgctccatccctctgcagagaagggtagtagtagaaaagaatcggttcatttgaggagagaaaagatagtagtacgttacttgcattgcttttatgtttattgagcagagaaaagcaatagaagtagagtacaaactagatttatgttgctatatttttgctgtgcttttatgttcattttatttatgttgctacttttttcttcctaggtgaattcatggacagctatgttaatttgttgggttcaaacattaatgtagaaacttgggatcctagtcaaaattctcccccaactggacagtagccacaacacagtcctatggttagtgaacaaccaagtgctgaagttggtgggatcctctagacccaacaataagagatcaaaaaaatttagcattgcggaagatcaaatgttggtgttagcttggctgaatacaactttagatgaaatcacaggtgatgagcaacatcgtgactcttattaggcaaggattcatcaatacttccatgaaaacaaaaaattcccctcagatcgtaaccaaaattcacttaacaaccattggggtaccattcaagaacaaattaacaagttttgtgggtattatgagcagattcttaatagacctcaaagtggaatgactgttcaaaattatgtaagcatctaattgagctagcatctttctttcttaaagaatgttgttttttcttcttattgaccttgccaattaatgcagataactcaggcttctactttgtacaaatcataacagaagaagacattttttaaatgcattgtcgggagattttgcatcatcatccaaagtggaatgataggttgtcccagaaaaagccgaaggctcacatcgatcctttggtgagaccatatgcaagcacaaactttagtgaatttctttgcagccccgacattaatatctctcatcctttggtgagaccatccgggaaggtggaaaaggcataatgcacacgaggtaatacttcttcatgctcaagtgagagtagtcttgtagttattgcattaaataacatgtggtcagagaaaaaggatatgagtgcacaatctagggaggaaagaaatgactggttggctgaagttatttcacttgagaaagagaggttgaaagtagagaaacgaaagttagatttataaacctatgaaagagaaaaaagaattatgaatatggatcttagtgctatgtatgggccaagaaaagcatattacttgcgtttgcagcaggagataatatcgcgtcatatggatttagttcatgatgtatggatatgtactatttattaccatttcttaatgggttgcgaacttttatgttgtacgccgtgtaggctttgatgaattatgtactattgcttgtaagagctttatgggttgtgaatttttatgttgtatgtcgtgtaggctttgatgtattacgtaatggttattgttagaatttaatggtttgtgacctttatgttgtatgaaaaaaatgctatgattaattgtgagcacaaacaagttgcatacataattagaattgcatacataattgaggattgcatacataattgaggttgcatacacaattgtgttgcatacataattgatggattgcttacataaatgaggttgtatacacaattgaagttgctcactacataactgggaggttgtatactacactagttactaccatgaaattgccatagatgctcaactagatcttcttgaagctgagagcgagtctgtctatttctaatgttatgatgattctgaataaagtcatgcagttcagctataggggtatgcaaaggtgtgactcgctctccctcatcattatagttgtagcaaagatcttcttcatccctctcatcttctactattatatcgtgtaaaataatacatgctgtcatgatttcacttaatatgtctgaataacaaaatctagatggcccacgcacaattgcaaaacgagcttgtagaactccaatcgcacgctcaaaatctttgcgatctgcttcctgttgttgggcaaagtgttttttcttatttccttgcggttctgatattgtcttcacaaaagtggcccatgagggataaatacgatttgcaaggtaataaccaattgtgtagttgtggctattgatttcataattcacttgtggtgcctatccttttgctagccttgcaaagagagggaaggatgaagaacattaatatcattgtgaaatcccagcaaatcgaagaatgcatgccaaatccaaagatctcttgaagcaacatcttccaaaacaatagtaggcatacttgattttcctttatactccctccatccctaaataaaagggattttggtaggatgtgacacatcttagtataataaatctggacataagcatgtcttgacataatgaatctggacgaagagagtacatgccttgccatgctgaagggcaatttttccactcccaatgcatgcaatctatggatcctagcattccagaaaaacctctctgctctcgaagtgcaagtaatctaaaagtgtcagcactagttggataacgcaagtactcgtcttcaaaaatctcaacaatagctctcacaaaccttttcaaactctctatagtggtattttctgcaatttgcagatattcatcttgagtagcggctgcgactccattggttatcattctaagtgctgcggtaatcttttgcaatggtgatagacccaaagcactggcaatatttcgttttttcacaaaataattataatgggctaccacatcattaactatgcgcaagaaaagaggacgactaattctaaacctgcgcaacaaaatgtgaattaatagaagtagtgaacaaaatgggatcaaccaaaatatgtaaattaattgcaaacctttgccggaataagactaggccatatgtaggatgctccgagaagtagtcgtggtgcaacctatcatggccggctcgatgattacgacaaacaacctaatgaccaggaacataaccaccttgtcgtggagcattcgactgctcatattcatcttgcgcgactattgctgcagtaacgatgatttcatcgccggatgacgataattcatccaacagaacatgtctcaaaatgaatctcattgagtgatggaagaactatgcacaataatgtggatggagcaaaaagatagcaagtaatgtagcggtatgtatagagctgaactttacatgttgcatgtgctagccgttggataatttgaatgagctagctagccgttggaaatgtagccgttcgaaatgttgccgttgcacacataaaaaaatgcttcactcaattcaaatatatcaattaaaaaattacccattaaaaatatatccgttaaaatttactcattttgaaatattatcgcgataaataacaccgtcaaaatttagtcgttcaaaatatatcccttaaaagtacaaatgtaaggttagttggagaatattaccccaatataggatggtgtgatatgaatgatctgttggagtgaaagggatatgaatgaggaatcttttatcttttttggatgataatccatatgggcatttggaggatcaaatatggatgagctcctgggtatgctcttagaagctaagttctcgcatggtgcagttgtattggtgcatggtaacaatattaagcgatttggttgctttcttcttccgaaccaacgtgactatttaaatcaaaacaacacaaactcaagataacattattagttgatatgtcccaaactact

SEQ ID NO: 63576 - DNA, 1664 bp, Oryza sativa
gggggatccaaggggtgtgggtggcgctcgtgtgacctttcgaaatgcggtgcgggcttatttgtagtggggtgggtgagaggcctccgtggctaggtgcacccgagggggagaacggattttttttttcaactctgagcatgagcaggaccctatcccgtcgaagtcacgtgactttgtcactgacatgtggtgtggccctgatgaagacaccatgcatttgactgcaaaggatctcaagtcatgtcagctacgttcggtgttaaggtaactttgggcctattcggctgccctagctgcggctgcggcgcagccggcacgaacagtttcgcactcactgtacgcagctgcagccgcagcagttggcctaccgaacaggccctttgttacttttagatttcaacgtttaactgcctactactccatataaaaaaagttgattatcatatctaagagcggaaaatagttacatgttccttcgacatcagcggagcgagagaaacactattgtttaccgtgcaggtgtttcctaagcctgctaaacggtgtgttataagttgtttttaaaaattatattgatccatttttcacatttaaaatagttaatactaaattaatcatacgctaatgactaatctcattttgtgtatcttctcttttcctctcctctcaaacacatctatgtttggttactgctataatttgccaaacatttcaggttttttagagcttaggttctgacaatgcatggtttgtaactctgaatatcacatggcttactccttctttttccaaacctagtagtaagaacttgtggacacacctgaccttagctgaacatctgatgtgttggcgattggtgttgcgaaatgtagtattgaacccaatttaagctaaataatacttaagtgggttgttagttgttacttgttagttatacacatctacccatttaaccaaacattgctgaacaattttgagtccattgctggttgccacatttttttgacatggcacaaccttcccacaattcacctaatcttttgcaaaattgtaccttacgataaattattggccatgtcttaatcaaggtttggcaaagacttacatgatagtatttgatagtgagagatttaagaccgaccgagactcaagggagctagatggtagctatacacatccatagattttataaactaagttaggatcaataatatgatgtatgcacacagttacactgtaaagttgcaaccgccgcacatgacatttttttttatagaagggtttttttttaccgctcacatatgtataggcaataaaataattgtgatcttttatgttgtgtgagtttttcttagtttgtgtgtgcttttatttattcaggtgtgagtttttgttgaattggtgttataattggatgtagctatttgagcaaaggccgggattatattccattattaaaaaaatatgtataggcagtaaaatgtgaagttgatgttgaaaatgagaatgataaaatctgaactattggttctaaattctggtcttacatttctttgttagtattgaggtagtcgcaatttggcagtattataaacaaaattagtttattctactttcatatcttattttcagtttatgacgataatctacacatggcacta

SEQ ID NO: 63577 - DNA, 5157 bp, Oryza sativa
  unsure (1)..(5157): unsure at all n locations
cccccagttgagcgcctgtgaagatggagccgtaggcccgctagtccgctgctgtttatttttattgtcaggcctgaggcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagcatgcggcagcggcgcaagacggcggccgacggcgaccgaccggcggcggagagcggcggcgtcgcggcgaagcggcagctacgcggctaagcggcggcgcgacggctaaacagtgcgggagagagagagaaagaggaggagagacctcaccgacaacgatcgacgacggcgagcgacggagaacgatggcgacggtgggacgagctccggaacctcctaacgaacaaaaggagaggggttagagggagagaggagagtgcgagagggcgagggcgccggcgcacgacggggatggggctccggcggcgaacattgacggaggaggggtggacgaggtggacctcggccgcgcgaacccaacggcggcgacggcgcggtgcggcggcgagtgtaacggcggctagaggcggccggagtagcgggagaggcggcggcggatgggcgcacggcgcgggagcaatggagggcacgggagagagcggtggaaaaagaaaaaaggtggaggggagtgcgggcatgctttataggggctcgggagagacggacgtggccgaggcgagcccgatttcgccggcaacgtgggaggttggaggtgggggagagagagaaagagcggcgggattcaaaatttgaatcccggccatctcggttgagggcgcggcaagagaaaaagggggagtgggtgcggaaggcncggcgcacgcacgggcatggccgacgtggaccggaggaggcggggtgcggcggtttcagcggcgatggcgacgtgggcgggcggccggaggttggggaagggcccgacaggtgggccccacctgtcggcgaccccggggagaggagggaggcggccggcctggctgggcctcggcctgcggccggcccagcagggaggaaggggaggaaggagagaatgggccggcggcccattcgaaaaaaggaggaaaaaagggaggaaaaagaaaaagaaaaaggaaaaaggattttccctggaattaaaatattgcttgctcaattttaaatggttaaaattatttctagagctctgaaaattccactaaaaatcctgttaatgaatttcgacatgtagaactcaagaaaaattccacatgtcaaatccgattattatttgcattactttcttagggttttctcttgattgcacctgcattttcttggggtcgtttataaattaaattttaggcttgggaggagaacttcggggtgtgacagccgggccccacaacaatcgcgaaagatcccgtgcgtagccgatagaactagcaccgggcttctccttcccctccggacagcgcgtggcccatctccgggttgactgcgcgcgcatgtcgacgttcggccgccgatcatgctttcctcttccgtggtcacctggtctgtggctcctctccactccgctcaaccttcgcgattgattcttggatttctcaatcggtccgtggaggtcatgcccgatccctatcaattcggagaacaactcgcggtttcctttttggcgtaaatctagtcgaagtcagcctctgatttgtttgaattggacgacgacgtgaggtgcctcgctgagtagtggtcatcgatcgctgctgcagctgcgagcacgagcagtgccgttgctgccgcggagagcgccatgagcaccacctcccaatgtgctccctcggccaggtccgagcaagtcagcctcctcaggatctacacatagaacaaacaaaatgcaagtgccttggcaagcttggcgttggaaagcttttgtgtgtcacagactgggaagaaaatttggtaagactgaagtcttacgctcctgcaaaagacttaatcccttgtgcaacacgtgtcccgtcacaatctcaaagcacagaactccctcaaaccctcttaactatgcatcctgacgtcgttagcacgtgagaagacgaacggacgcggcgcacgttgctgtggggagatggacgagcgcggcgcaggagatgaaccggtgctcctgcgtgaggtgcggcaagtgggcgaatcaaaccctgaagccggcgaagcaagccaaggtgagaagatgcttgtttttactatccatctgctgttgattcttccatatggctaatagattgatgacttaaacacgatttttgtttcaatttgattccatctagtgttggtagtaaccggttttatgttcaactctattggccatcatgctatgggtgaaagctcggattgcaatcttgagggtcataatgtagagttcagatcagattgtgagaaatttgaacaatttgctcaatcaaatataaaggtaagatgctctttttataacaaattgaccacatccgtgtagaagtcatctataaactcattcaagaaaatattcgatttaatatatgcttccattgtacttataggctaccaatcagaatgctccttgcgagcaagtgccaaaggttggcatgacctttcaatctgaggatgatgcatacaatttctacaattcatatgctagaagagtgggctttagtgtaagaaagtgccattgggctttagtgtaagaaagtgccatgttaactacagagcagatggtactttatcatccaagtacatggtttgtagtaatgaaggtcacaagaacagtaatccaacacaccagcctaagaaagaacgtgcttgtacaagaatagattgcaaggttcgtgttcagttctttatttcccgggaaggtatttggaaggtgcagaaagttgaattggcacacaatcacccttttgtaagtcctgacaaggcacacatgcttagatcacaacggcgtatgtcaaatgccgatgaacatataattagcatgatgcaacaagcaggagttaagccagctgagatatttgaattttttcaacggtggtcagatggagatgaaaatgtgccattcttacaaatggattgcaataactttattggttgagagcgcaaaaaatatttggaaacacaagatgcacaaacattattggagtacttggataacaaacaagcagaagacccttctttcttttattctttgcaattggacaaagaggatggtcgaatttgtagtttcttctggacagatggtcaggccattgtagattatgcttgttttggggatgttctctccattgacacaacatttcaaacaaacaattctaaaatgccatttgctcctattattggaacaattcatcacaggcaaactattctttttggagctacattattattcgatgaaagtgctgattcatttgtttggctatttagaaactttctgaaagcaatgtctggaaagcaacctgaaacaattttcacagatcagtgtgctgcaatggcaaaggcgattaggattgtattcctaagctcaagtcaccgtctttgcctatggcatatcactacagaaaagtaatctttagttaccgtatattttgttaccaacgaatttggtagctacatgtgtatcaatagttaccagtatctaattccctggtgactaaaagatctacaggaattcacaccaacttgtccttcacaaaattgataaacgtgataaccatgggccttctagggccttttgtcaccgaggctaaggccttttctcttcagacctaaacctagcaagcacaaaaaaacccgaggtggaggaggcggctgcgncggccgcgcgaggtggtggcggcggctgcggtgcgtgcgcgaggtgaagaaggcggctccggcggccgcgcgaggtgaaggcggcggctccggcggccccgcgaggtgtaggagacggctccgtcggccacgcgaggtgtaggagacggctccggtggcccatccggctgcatcaggaccagcatcgtgagtccagtgagatccattggtagtggttgcggctagttcggagatccatctgcagcggctgcagcaagctcaggcaaggagaagcatcctgtttcacagctacatcgacgggttcacgatcccttttctaggtttgtgattcaaattacatacattaattttattattaactgaactgattttgagcaccatagaaatgctttgaactgatatttgaatggttgttttactcttgcacgtttgatttcctaagtactatggttttgtggattgattttgttgtaatcatgttgaagaaattggtgctgctatgtctaatgagagccttgaactacaatagtttggcaaatgcctcagtttaggtgctcacttgccccaatttttggtttgggtgtgatatgattgaatttgttgtgtgatgagtggttactgattattggcccactactcaccatacgcctaacagtaataattagtggtgacaaatttctagtccgaatttaattaaagccattcactgcttccatgccctgttttgatttggttgtgagaaatgttttcctagtagatgacactagaataagagaatatactacagaccaatatagacctatatatggtcttgcaatatttaatacttgtgttagttcagctatgtataacataagaaaattgcttggtctacttacaaatatatattaattagtgacatatatatgatattatatttcagtccacaaattaatgatagctagggtgcttgtgcaggactttaggatatggataagagttggatgaatttgcctgataggttctcacaaggttatatagccggtgtgaatgcatttaccgaattttcctgtcagcaaaatagagacaaggatgcactgctttgtccttgcgaaaggtgtatgaatataagccaaaaacctatcaatgaagtccgaactcatctagtattatatggcatacaagtttcatacaagcattgggtttttcatggtgaacaagtggacctagatattgatccagttgatgagcctatcaatgatgaagatgatgaggatt

SEQ ID NO: 63578 - DNA, 1437 bp, Oryza sativa
gcggaaggaggcgatgcgaaagcgggaggaggaccggggcgacgacggcggcggaccgaagcttggcggcgacggcggagagagaggacgacggcgcgagctcgattccgacggggagagcgagcggcgaacggcggaaacggaggagggaggcacggggagcgattatatagtgttgggagtgagagagggcggccggaggggaaggaaaccggcgcggcgatctcgggctccatcaatgacgctggcgaagtttgcgggagtgattccaaacgaatccgagggagagagagagggaaaaatagggggaaagggagaggggatcacggggaataattccccccactttaatgcgcgcggggacggcgggaggtggcgggattcgcggcggcggcggcgctagggcacgggcgaggcagcgggagcggcgggaggacagggatgacaggtgggccccacccgtcagcgagggtggcaggcgggcccgcccgtcagcggcgcgcgcgcggggagaaggccgatgggccgcgggggagaggagagggagggagggagctgggccgagtcggcccaagagggggaaggggggaaaaaggactttttagggcttttctttttataaaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttggaaaatgatttttaattcgggatgaatttatcaggacgtgacacatgcgcgccgcgccgtcgcgcgccatggccgccgggccggtttgcgccgtgcccgcgcgcaccggccgcgagctcccgccgccgtccgatctacccttgggtagatcggggccatcggttcggccgtcgcgtggccgccgcgtggtgcgccgctcctccccggtccgtggacccgatccgccgtggaccgccctccccgagtcactgccatgcgggtcccgcttgccggcgccgcgccccgccttgatgacgtcagccctggaatatattgcgcaataaatgatttaaggtttttcttgtatagtaataaacacagtgaatcttctaaaattcataactaattcatccgagctccgtttaagcccattcaagtctcagtaaatctagaaaaatgtgtagaatccattaaaaatggttttgttctctgtttcagtagtcttatagcctttttgcaatgtttgccttgtatgtcgctagattccggttcctccgacgctccggtgtacttcgaaatagtcgtcaaggttcctccagcagcagagcaaggcaagtcatgcttgtcacttgaacatgttgat

SEQ ID NO: 63579 - DNA, 12509 bp, Oryza sativa
  unsure (1)..(12509): unsure at all n locations
aaaactgctactagaaaattgcaaaaatatcactagaactgtcattcgagtggcatccttgtaatattgaaaaaaccgatggaaaatttgcaaatgccccttttcctaaagttcatgtttagggtttggtccctgccgaactacctggtggcgatcccatcagcttctatctgaatattttgccgcctgattggttggagaagaaacaaggtcaaggaagtcttacctggttttgttgtttggtacatgtgtatgcctcctcttttgttcgtgtgtgaaagcacgggtggattagattctaagtgctttggtatatcgtcatcatattttctgaattaatttgataactgttttatttggtaccgtaaaagagagggataaattagggtactcgctgttgggtactcatcattagtcatgatactactcccccgtctcaaaatataagaacctaggaccggatgagacatatcctaggttcttatattttttgatggagggagtactttctagcttgctatttttatccacaactataggaggtcctaaatctaaacacatgtaaactttgtgcaccaaatatattcctctatcattatatttgccaaatatatgacatatagtattagttgatctagcaaacaatttctccttcaaattaccaaactctcaaaagtcatcaaactgagcatggcttagagtatttaaagacaacagttgaaattcttcattctcgctagaaatgatcacataaaagaataactataggaatatcttgtccattcacaagttgtggcttaaatatatgtgaagtattatcacacaactcaacaaggaaatcttgatgtggctataactaccatagatacaaccattattcgaatcataaatcaaccataagatatcgagataaagccgcagaagttctgtaatccaactcggccacctacaacagtgttgacttcaaacagccgccaaatatgtatacgagctccattttgagtccatgagtacttgatggaaagctctcggagtgcgctttccaatcggatatatacagcctcatctccaaattgcatcttagttggctacaatcatagaaaaaagatgttgtgtcacctatattgggtctatgggcttgtagaatggcataataaattcgatttgagcaagattataataaggtagctcatacgcttcatacagagaaaccgtcatatctttttggtgatgaaggtgttgatgtcgagcatgctatctcatatcccgttgtgtgtgcaagaaaaaacatacacaaaaatatacacgctcctatcaactactaggtagtgtaggctcaacaacaccggatttggtggtgatcagggcagaaagaagtgggaaagtggcagcggcctccttctcaaatgtacagggcgccgtcaccacccaaatgtacagggcgccgtcaccacccagaaacattaggcgaattagtccgagaataatttatctactctaatctaatccgatgtcgtttgcttaaaatgggatggaagtgttacgtatcaagaaaaatcagtggcctgtgctgtgcttttggtcaaaagcggaaaaatcgtatgctactacctctgccccaaaatgtgtatccgtgggtatccatatcaaacgtttgaccgttcgtcttatttgaaaattttatgaaaaaattaaaaagaattagtcacacacaaagtacttgctcatgttttatcatctaataacaacaaaaatactaatcataaaaagaattttaaacaagatgaaccgtcaaacgttggatatgaggggtattttttttggactgtctatgtgacatgcggcttaaaatttttgttttgtcaaccgtttttttttccgctggccgtgcgatcggcgcacggacgatccatgcgcgcagaaagaaagtagcatgatttttttttcttttttttaggccacagcccatttctgtttttttaggccactgcccacatcctcttttctttaaagaaacaaaaagcccgtcacaatttgtgcagaaaaaaaaggaaaaagtacaccgcaggtccctcaacttgtcatcgagttacagaatcatcccctaaccacaaaaccagatatatagcatccctcaacttataaaaccattcattttaggtccctcggtggttttaaacctggttttgtcctatgtggcggctgagtcagcgtgggacccacgtgagtcccacatgttagcgtcgctacgtcatcaccctctctcttcccctcctttctctctctctcactcttttcttttcttctcggctgaggcggaggccgccgggggagaggaggaggcggcaggcgacgaggcggcagcaacgccggagaaggcgagggcggaggccggtcgcgaatggcgtcgacgacgctacgtcgccgccggcggcgaagcggccccgcgcgggcgggcgccgcggcgttgggtgcggaggcggaggtggggccgggcaccacgacggtgggcacggaggtggaggcggggctaccgggcgcccgcagcggtggacttggcggactcggagccccgtggaggtggaggcccccgcctcccttctcaagcggcggcgacggcaacgacatgggaggcggcggtgacaacgatgtagagataccgctctgctcccctgatcaccacgacacagtcgcccgtgcgcacgtagcacgacgagccggcgctgtggaggctcgactcgagtactcgacgcgcagaaggctggccaatgtcgccgccggcgaggccgtggcacgcatcctccacgccttcctcggcaccaagggagatggtccagtgccctgatggcgaagccaccattagtaaccacctgctaacctcctctcctgtcttccctgtttggcttacttcctgttgttgggtgggttgcttccaggggatctggagttctggacatttcaacggtatgctttgaagcttagtgcctttccttagatcaacatgcttgtttgattcttgatttcactggaatgttctgtacgaggtgcaagtgtagcccgtcgtttctgcagttgggttaattgctgcactagtgagggaatgtgcaccctaaagattaaagatctgtttgatggatcagttcttgtcatacatgtgtcgatttgggggtctgggtttatggttttagcagttgatcgtggggttatgcatgtatgttacttatctgaatcagtcccctgaccaccacgccacggtcgcccgtgcgcacgtagcatgacgagccggcgctccggcagcggaggcgacggtgggggtggagtcggcgacgagcacggctgtgagggatggcttggcggagagctggagccgctgattcatctatctctcctgccctcctctcacccacctccggcgggagcacgagcgcgccgccttcctcgtagtcggcgttcgcgtcggcctcggcctcggcctcggcaatgctctcgggattcgagtgtgacgaggcagacaagtacagtggcgttggcaccaggatggtggtctccatcacagccggcacgccgagatgacgagcacagggggctccgggcgcggcgacacggacgcggactaccgaaagagagagagagaggaggaagggagagaagaggtgaaagaggagatgatgacgtggtcaccttgacgtgtggggcccacgtgggtcccgtgctgactcatctaccacgtcagataaaactggagtcaaaaccgccgaggatgcttgcactggttttgtaagttggggatgcgttgtatccggttttgcggttagggatgattttgtaactcgagaagaagttgagggaccttcggtgtacttttttcccagaaaaaatacaaacaaaaaaaagcccactagttcacatggcccacatcccacagcccatgatgggattaaaaagcatcatgacgatttatctttgttaataaaagcccacacttgcaaggaggagagaaagcaagaaagaaaagaccatatacacgtgttttgtccccataaaaaaagcacaggaaaaagaaagatacacatatcacgcctctcatatgccagcgtcacccacaatcatcacccgtccaccaccttgcgatccaagaaagaaaaaaaaaagaaaacaaggggtcagctcaatcgggaaggagtgaatattgtgtgcaacgaaaaaatctccatggatgcatcgttgaagatgaagagagatgagaagagaggcgattcaatgctgaatattggggaagccctaggtatgtgcagaaatagatgaaaaactctaggttcaagtacttacctccctgattctgagtttgaaacccatgaacttgtttttctatttgactatcagatctggaatttttcaaatcactctgtgttgctttcatttgtggtggttcaccttgtcttgatgcatgaaccatgtttgataaaacacacttggttcagaataaaaactgaaaaatattcagaaaactgccagtagataaagttgcatcatgcaacttttgattacaaaaagttgcattacccatagtacagagatcaagacacaaactagttcttagagcccctgatatgttcaattctcaatgaaaacaactgaaaattgcaaactatataattccattagttgtctggagagcagagtgtcacatgagttggattgttctttctataggtcatgttagttttagattttcagtagcttaatagggacaaagacaaagacaaaacatatggttcttgaggtttttttttttttgctaccgtatcagatcacaaaacaaagctatggtaggtataagttaggtttaatctgaactagaaagcagttctcaaaaaaaaaaactagaaagcaaaaaaaaaaaacaaaactgtatacaactagtagaactgtactaactaaaaatgtgctgccattttttctggagatatatgaatggtagcgttttctacaatcttgagtcaattcgttgaacgctaattacagcagaaccgaaagtgtgtagaactctagattctactagaaatggtcaggcatatcggaaactgaaagatccagtctgaacagaaacagaacagaaacagtttgaacagcagtcttgcctctgtagtttgcacaatgtgaagtagcacataggaattgctcactttggcacatttggaattgcttgggtctccagataggcatcgtcagccatggcccctaggctcctcttgctctgaactcctacagagaaaaataatagaaatatgtagctaaatcttataaaagttgataaagacaaagacaaaaccaacctagtgccaagaccaacctattgccaagacgcatgttgcaaatataaaaatctaacaaagacaaatacaaatacaaagacaaagaaaaaaaagacaaagacgcatgacgcatgaaaatataaaaatctaacaaagacaaatacaaatacaaagacaaagaaaaaaaataaaaaaacaaactcagagagtgtgcacaaagctgacacgatataacttcacaaattacaaaaaatcacaaatattacatgttgtgtttttcaggttgggtgaaagactcacataaagaagattatgtaatggcggatatgtatgatcaacagtccttaacgagacatcagcaggtaaaaatggttcttcattgcattctccctattgtacctgacaaatattaatgaaaaatatcatctcttgtcaggttcaaaataaattgtgattagagtttacatcaatttgcactggcagaacatgaaaagtttacatcaattcagctatctcagtacatgtatctacaaaactgcagctaaactgtctattgataaatatccatgtatccagtgagaaataaatatgcatcttgggggcgaacttgcttgcctcgtgttctgctgttggaaacacgtccttgccaaccaaaacagaagaaaccatcgaacccttggcaactgatacgccaagctcaagggccccatccgtagcaggaattgcctacaagtttttcatgagtgacatataggggaagtcccaaaaatgtatactacaaaaatccaaaagatacaccacaaaagcatgacaaagttataatttcaggatgatcatgccacaaaacactcacatataacaacaaattatggtcacgcgtgctgttcaatgcaaatagtgtcagcatcccatagtctagttgagaaacatgagataattaaattgagcgatcaaatcatcgaaagccttcgtttacctaacaatgttgataatacaatgggaccaaaaaatggaacataccaaatttcatgcagccaccaaattgcaaactgaacatcaacaagccttcattcggttgcagcgcgcgtcaagtactcaagtcgatctgatattcagttttagcgtctctcttgcactgtcattttttagagattttgcatgataaatagcgcgcacttacactgtaggggcgacaggagtgcacagccatgcagttgttccaacaaaacagatatggattggacatagcggataatagaagaagaaatacgctaccaccagacaccagtgcgagggtgacatactgatgaatagcatacaggccaccatgtactgaagtatactgaaagtaacttccacacgtgcaagggtagaaaaaaaactttgcatatggtataaacaaaaactgaaatgcttaccactccaggatgtcatagtagatgtttagttttttttctcagacaacactaagcacaaatcaaatacaattttgcacggggaatcaaatatgagtttgcacggggcgatcgagattagatggccacattaacagatctgactcacagatgaacgtttccaaaaacaaataacaaaaaactaacacaaattacaaaacaaacgaaacctgtgtagccttgaannnnnnnnnnnnnnnnnnnnnnnnnnnnnnttggaggtcgatttgcccccatggctgactgagagttcatggcaggggcggatccaatgggtaggcttcatcaggctcgagcctaccctccgatttttgtaaaaaaattttaattatatagcatctatcccatgggaggagttggagaaggcagggagaagagaagaggcgaacaactgtctctggcggcacgaggaagaaaaataggagcgatggaggtagctgaaccggtacgcagtatgttgcttcttttacttaacatttatttatttctaccatttatgtattactaattttcttcatttatatattcaggtggctgctcactttaatctttgctaaggccaaaaaaattagcatcttaagtcaaggactcaaggtattcttttataagtatgtttttctatttaatcatgtaagtgttacatttgaattgataatggcatatgcttcattttaacattattaacttagatttagacttatagtccaacctatcctcaattttgtcctggattcgccactggttcatggatcagagatccaactgcgagatccaccaaatggttggtcccctcacccgcctgagagagatggttggtcgcctggcccaccggagagagaaccaccatggccaaatcagtgccacgcgcgaagtattccgtcgggggctcgctgacagacgtggctacctcgcggcggagcagcggcgacgcggcggagttgcggcgatagcgccgagaactccgcctctgcctgtcctctcgaacgagcggatgagaacgaaggagaaaaagaagcgaattgttttttgaaacagtgcacgggcgcgtgtgtagctgccgcaatgacatgcgtcatgggttgggctgggtatactgtgctgcatgggccacgggaacagcccacagagaaagagacagatgggtcgggccaaaatgtgctgcgtgggacacgtgaatagagaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttataaaatataaaacacattttaaaaaatctcagatctacatttcaaacgatattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattccgtgaatagatgggttcgttgcacgcatcttgagcagaaatccaacgggcaagaattcggctgagaatgaaaaaaatttcagcaggcagccgtctagtaattcccatttttttttagcgggttgttttgtgtgccgtagatggaattttgtcttccctaatcggacggctactcgcgtcgggtagggttgtgagtttgtgacgtcgtcccctgcaaaaccacaattctccacacgcagccgccggcgcccgtcgaaatgctggccaggcctgggcggctcgccgcttccacccttcccaacgattccgccgccgccgccgcatccaccgtcctctccatactccgcggcgaggaccccgccagcctccccgcggccggcatcgacccgtgccccgccgtgttccagcaactccgcccgtcgctgcccaccgtcccggactccgcgctcccggcgctggcccgatgggcgggcgaagccaccgccgtctccctcctgacgtcccgcggcctctttgctgccgcctggcgcctcctcctggccccttcccccacgcctcctcccctcgccgccttcgccccgctcgtccgacgctacgcccgcctcggccgcgcccccgccgccctccgcgccttccagttcctccgccgccaccccgaccgctacatggccggcggcgacatccctgccgcggcgtccctgctaaacatggcggtcgacgcgctctgcaaggagggccacccgcgcgcggccgtggagctcttcgagcggtggcgccgcgaggagcccgactcgccaccagatgagcgggcttacaatatccttctccacggctggagccgcgccggcaggctcgacaaggtggggaaactctgggccgagatgcgcctcgccggggtgcgcccgacggtggtcacgtatgggactctcatcgaggggctctgcgtgaagcgcaggccagaccaggcgattgcgcttcttgacgagatgcgggaagaagggatcgaggccaatctgcttacttgcaaccccattgtgtacgctcttgcgcaggccggccgattccaggacgcccacaaggtgctcgagaaatttcctctgtacggtgtcgcgcccaacatttccaccttcaactcgctcgtgatgggctattgcaagcatggggaccttgctggggctagcagtgtgctcaaggtgatgacagaacggggcatttcgccgaccacaaggacatacaattatttcttcatgacctttgccaagaacagcgatgttgagtcagggatgaatttttatagcaaaatgatcggtaatggctattcaccagatcagcttacttatgtcctcttggtcaagatgttgtccagggcgaaccggcttgaacttgtggtgcaaatgatacaggagatgagaactcatggttttgagccagatttggcgacgagtaccatgctgatacatttgctttgccggcgtcatcaatttgaggaggcatgtgctgagtttgaggatatgtttaagagaggaattgtgccccagtacatcacttaccagaagcttatgagagagctcaagcgacttggtttggttcatctgatccaaaagttgacaaatttaatgcgctcagtgccacattctacaaagttaccaggcagctatagggataaggaaggggatgactccatggaaaagaggaaattgatattgcagaaagcacaggctgtttcagatgttttgaaggagtgtaaagatccaaaggagttgggcaagctcaaagaagatgaagagactgatgttgaggtcgcagataggttagtagccaacattagaagaagtgtatatgggggtgcctcaacgagctctgtaatggcacctctttcttgaatatggagttgcaaaaatgaaaatcataaagataagggacatgattgcatgtgaggggatttactgatagattgcattgttcatctcagaagttgaccacctaaatgattcgtgcacatgtttactgttgttgtttgggcccttcaagataaaagataacagagaagaggtagtgacatactactgtggttgtggtttactggatattgtcccatgaaggaattagctggttgatgtgtttcttgttttagggaaacattgatatggcagttatttactgatggtaaatttctaacatgagatgtcttttcttgatgtctaaaaatttcatacctgaacatttttgtgataaatgtatcttattgattgcagtgctcatctgcagatgtcttggattgctatgagacctgtgtatgcctcatgcagtgatattgcattgaatcaggcaactcaggaaaagatgatgcctcattcgaagtctaaccagtgaacatagaattggtaggacattatttagcatgtggcagcccttgggtttggccgcttgtgcaactcatatacacaaaattttccattgtgtaaagaattttccgttgctttgttggtcggatacttcttcagatgctgttgttaaattgagatcatttagaaatcccatttcctgttaaacaaatacaattaaactttgactctccatttcctttatgttcagataatcttgaaataaattgctcttagaactactcaatattgctagcatggctagaaatggactcttgggatcttttcaagaattgagttcgctcacccttctcctttgccaagaattgtctcatttgcgtcagtttgttgttaaggaaaatcttggtgctcatttctaactacctttatcgcccattctgacaacttgctgatgatcaataggatagatggagttatacatgggggactgatgtttttttttttaatttgcatatgatgggatcgatgcaggttcctaagccctttttgtggacactgaaatccaattgtcttagtaagtggaaggtattctttaatttttctggctgctgcttaaagataggaaatactaaagatttattaaggctgaagaacatatagcgattgagagaacatgctttatactttgtcataaccaaatcaaagaaactgagacatttgtttttcacttcttacagttagagatgttggacagatggtctgccggtctggtttgaagtgctgtttgttgctagctgacatgattcacgatggaacaaatgctcaaaggaaataataaccatagcatatttgtctacgagacaatttagaaccatcgcaataaattaaggacttttttggcagtaaaagcctccatgcaagcctgcgttttggtctagtttttcttatagttaatctaagggtggttgtttttataaatcatggctgaatattttgcttttttttttctttacatccttctccttcaactcttcttgtaaataaatctcttttaaagaatttcagtagggatcttccctcctgtttacgtgaaaaaaaggccgaagaaattaacggcagatggctaattaaatgtggagttccaagtttgtttaacaagcctaatgtccaagaggatgagcttaattctttttagattgtttataccggatcattgaaacgaactattttctccatgcttcaaaaaagcaatttcttataaaaaattctttattatattgtttagaccacttattttaagttatttattaaatttgtttatcaaaacatttaatttatcctagatattcgccgtaacaatccgctcaatacattgtttcagatttcaagcctaatataagcacacctaacttgttactcgacacttttctatcatcatacttcctcatatcatggatcttcgctaacttcaaagttggagagggaaggggctagcaacttagggtatgtttagatccatttgaaatggcaaatggcaaaa

SEQ ID NO: 63580 - DNA, 619 bp, Oryza sativa
tgctgattgtataacatgttaaataaactagaaaggtagcccgcgcattcgcgcggggatgtattgtacacagggttaaacttttcggtttagcccatttgattgggcatcagtgcatctcccaaatacagaaatttctgaaattttgtaaacatagtttagttgaatttgaccaaatattaccacaattcataaaaagttaaaaaaattcggccaaaataatatcacatctgaggggtccaaaatgatagatatttctataatttccaacctttatttgtacatagcgtttgtatatatatatatatatatatatatatatatatatatatatatatatatatatatatatatatatatatataaacagaatatcaattggttgacacctcccatgtttaaaagtacttttttatttttttatttgaataagacacatcaggtgaggcctccgctgttcttcaatattttgctttgataatttttccaagatatttgttaggttctaaaatatatcaaatttgatacatctatataaataattatctacaatctctttattatatataaggaagttcgatttagtttgtttggaaaacgtgtctaacaaatcaactgt

SEQ ID NO: 63581 - DNA, 30028 bp, Oryza sativa
  unsure (1)..(30028): unsure at all n locations
attaagcaaaacgtgttttggaaggtattccagccaaccgccatttaagggggccaaaaacaagtttctccccacccccagttcagtgccaggggggcgaaattctatcccaaatattcccagattcccaccggcctcgaaggctccattcctttttattgaaaacacacttccctcccgcccaaaaccccaagaaaccccccatcgatccccttccatcatcaacctccggcgattcgcctgccatggcctcgccgtcgccgtcgccgtcgccatcgagcgccagcaatcagcgccgctccctgccgccctcaccagcggcggcctcctcggtgggatcctcgcccgcattcccaccccgcaagaggcgccggtcggggcgcccgcctcccttcctcgggttggcctgctacgacggcttctacccggccacggagccccacccttccgccgagcgcgccatcgccctcgctcgcaaggccgatttcgagtacggcttcgtgccgtgggtgccgaagaaggaggcctggggctggttccccctcgacgcccgcgacggccgcgtcctcatccagtccaagtacttccccgatgaccccgacggcggcgacttcccccgcccccgcttcatgaactacgccgtgtgcgatcccctgttcaagagatacgtgatgctcccacccgtacccgacgacctaaccgccaatgaggggagccttgttgatttcgggctctgccttgccccctcccaagaggatgaggcggatacatcgttcagggtgatatgcgtggcacggtacaacaccaatctggtcgcgttcgtcttctcttccgtcactaggcaatggggaatcggttcgtcttccacctggagttctttgggcacagaagagccccctaaccgccatggcctgagttgcttcgactgtgttgatggctgcttctactggacagtgccttcggcggacaagattcttgtgcttgatgccatcaagatggagttctctgttatcaactatgctcatcgtgtggaggacggctttcgggcttgcattgcagttgatacagaaggaacccctgggatgctgactgttggtgaatacttggggaatagagagtttcgcttctctcgcatcgcgaaacaaagtgaccgtgaatctcccaatgaacgcctgtcggagaatattatacaattgcccagcaactgcaataagtacttcaccttaggtgcagctgagggatttattttccttagaggcattccagaagaagagaaagtagaagactcttcatcagaggatctttacatggatcctgaagaaatagaatattattcgctcaatgtcaagactgttgaatttgagatggtctgcgcgatggacatggacaagtgctactttcatgtttgcccgtacttccgcttttcaccaccatcggcaaaaccatgtgtttgaagtggtaagcttgttgtcatagcagttatcaatgtggggttgttttatatttattttgtttatgctagcagtagtttgctgtctagtagttcaggtagaggtaagcttcttatttttgggcactcagtttatctcatcctcaatgttgcaatgtagcttgtatgctgccacctgtctgggaatttgtcagtgatatatgttatgtgtatttagatggtcttgtaggatctagctcttaatcatcctgttatgttctgaaggtagtgatggtttggttctgtctggcatagcatccagttgccatgcatgatcatgctctggcaaccaggcaaatagatgacaccaatttcgttttaggatatatcatttatccattctctgctgtgggataacttgcttccaactttaagaattaactagagaatgaatattgtgtatccagaaaatgcgtaagttatacctgtcattaatgttctgatggacctgaacccggatcttcatctgggaaactttgttcctgtcaagtagaacaaacagaaaacttcatcactgcttgctgttcagcacctgcctcttttataaatagactacaatgtactaggaaatttatcttaggtcgcaattccattccattcccaaacccccaaataatctcttcctttcagattatagcatgtacagccattttctacttatcccatttcattttggtgtatcttttgttgttgtttgttctatagaccttttaccttctatattttatgagcaccacattttgtccaattgatcccgtcctatggttatctcgatagaaaataattttattagaagtaatggcgcaagagatctgttggtttatttgtttaaagagttggtgtccatacttgtataggcttctatcttaccaatttcaagtttgttgtgactcatgctcatattctgcttattaccaattcttacttttcttactattgattagtggcgagcagaaaaacatgtcattccatggctcatattgagcattccaagtcaatcttcatcttacctcgagctgaagctcaggctgatatccttgctgatgatcctatcctactaaccccataacatttttgttcgaggggtcatcataattttgtgttgggactgttacgaggtttcctgtaaaaatttggcaacacattggaaaaatatataggacatgtatggtgtggtcgggtggaatatcaggcattaggtgaagatgtgaatatggtaaaaaaaaatccttttgcattcacagtaggtgtctgtaaaatctaattaaatttatctgcagggatgaagccgtgcttttgagcccatactcgtgccatgcatccgtactgcttggaagtgcaggaggttcaaaatggtgctgccattctgttgacccggatgttcttgagccttgggttatatttatcacaaagtagtcactaatgtagtttaatagaccgtattaagttaatgtaagcaagacttgctgctggcaaccttattctcgaacagtaatctgttagtggcttagtgccgtactgttattctgtgctggacttcatcaatgtgcaagactgtgcaacgctctgagatgggaatgtgctggagaattggaatgcagtgtggacggggtatagtatatatgcaatggtgagattcacagcttgctggtttccatcgagaagctagtgccggtggctgtccccgagcgatcgtcgtaatctttggaggaggaccatgcaaaactaggcaatttgccactacaaaactttgttcgtttgctgtgttcatgtagaaaattccttgaaacgccgttcgccaacatgggccacctagtccaagcaaacgggtcgatgggccctaactcagaaaggccccaagtacggccccctagtgctaccatgattacctttctgttcttttttaattaccatcatcactcacgcccaggtctgtctacaactgcgataccgcaattctcgtctgcttccaccaaaattcagcggtgctaaaccccaactcgtgtccaactccatttagaacattgaatcctctccgtatcaaaacaccaatattagaaacacacttgctacagtgttttgcccccgcgcacgcttttcaaactactacacggtgtacttttttgtaaaaagtttctatacaaaagttgcttaaaaaatcaaattaatccatttttttaaaaaaattagctaatacttaattaatcacgtgttaatgaaccgttccgttttccgtgttactgtagcgcgctgggaaaacgtccaaacgaacacagccttagaaacacacaggaacagaagagaactcggctgacgcctgcgaatcctactcgttcgtaccgaacacgatcatcgcggttgctgccagatataaaacgcaacccacacccgttttgccgagtcgagtcgagtcgactagtctcccgtcccgagcgcacgcacgcacgcacacgccttgcaaccaggcgagcgaagcgggcggccgcgcgagccaacgccagccatccaattccgcctgatctgtcctccttgaccgctcaaggttcgctcccctttttttcccctacttttttcccctaaatcccaaaaaactaacaccaataatataaaacaacaataatttagattcaatcgaattttagagataaaagatgagataaaaaataaaaaataattctgttattattcagtacagtagtagaaggacaagtcccagactatatctgtttttttctctctctctctttctttttcattgccctgtttggtttcgtatcgtatgcagctagactactactagaagcccccgacccctccctcttctctttcgcttcgcccccactcttcactcccctccccacccccacccatcaatttcttcgtccgtctcgtgttaagccgcccctccactggcgacaaccaaaccctaggccgccgccgccccgggaggccaccaggtaaagcgctcgttcgtccatcccctccggcgagggccgctctctttgcgcggcggcgggattagggttcggtttggtgttgtttttttgctttgtatgcggattggatttcggggcggcgatttatttgggtgtttggtgtttggtttggatcagggggaggaaaaaggaagaggaggagatcggaagtgggagagggatttatgtcccagcgaggggacaggggcgaggggcacgcgagaagacccggccggtccagcagcttaggcggcggccaccgcggaggcggaggagtcggcggcgcgggcaagggcggcgggggctcctccggccagcctcccctcgcaactaaccgcaggtaacgattgattgattgattgatggattggatgcccccccatgatttgatctggggacgagcgggctccgaggaaaagctagggttttttactggacttttggatccgattgcagctttaggaagtccgggaatggccatggcgggcaccagagggctgtgagccaacccgacacgcacggcttcaagcctgcacctgccccgaccggtctgcagacgccgccgttgcgcccgccggcacctcagaatgcgccggcgcatgtccctgttcccgcaccacgtcctcagcaccatggtgatttatcggcctgttcccttatgttggattacaaattagaacaatgtgaaaaaggcgtcttttgatgtattggttttggtgatcgcatgcatttcttgaatgagcagatccgtctggagcgcgagcacccaccctaccaccttccagcgagaacacggccaatgcgccaccactgaaaggtattcctcatgccgctccaagggcaccatcaaggatttcaagcacgtccacttcacaaggagcaccaaaaggtttggtcctcgtaggggggttgtttgcaccttgtaattgatatccatggtatactactttgttaactgcctgctgccactcttctttacaggtggagcatataatcttcagtttggcagtttcccaatgaatggtggaactggtggtagcacaatggtacgctcttcaaccctgttcttgcagcttgcagttcttatttcaatttggtctagtttctggttctttttttcaccttttttctaatttccaaatacttttgcatagcaattccctgccaggacaagctcagctcctcctaatttggatgagcaaaaacgcatgcaggtattttctccttcccttggcctttaccattattgtttctctgctttatgttagtttaatttggtggtattggctatgatttttagtgcgcttttgttagatatatcgataacagtatgttgtcaacaaatgcaccaaataatttatgctcctatgtataatatgctttcaggagatttgagcaagtcatgcctttttttgcttctattgttgatattgtattgataggtgttattaattttcaatattctaaaagaatgtattattgtgttatctttctttggtgtttaggccctccctgaaggtcataaggttgtaccttctgggcttgttccacaagctccaaaacatcagcagcaacagcagccgttgcagcagcagaagcaacagccgcagtcacagccaccactgcagcaaacaagaaaggatgttgttagttctaatcattcatcgaaacctatcaaccctcacattccttcccaagttaagagctctgtgcatgtctcaccatccgtgcccaatgttgcaccaccaagaccccctgttcagcagatacctgggatgcccatgtcaatgccatttcaccaccaggcacccttgcagtttggcggtcacaacccacaaattccaccacagggagttgtgcccagttcactacaaatgtctatgggattgcatggcgccaacgcaccccaggttgcacagcaaatgtacatccctaccattcagcaccatcatcaactgcaaccgccaacaatgatgcatcaagcagcaggtataccttatggtccagctgctcatcaactcactcagatgagtggtatgatgaatgtgggggtggcacctcagtttactccacaacagccaaataagtatgttacaggcccaactcggaagaccacagtcaaaattactcatccagatactcatgaagaattgaagctcgataagaggatggactcttctgggcaaaggggtttacctagtgtacaacaacaatcccagccggtcagtacttatggatctcctatgggcttctaccagcaaaattcgtataaccagtcaactatgttttaccccacaacctctggtgtcggtcaggtatccactgtatcacagggtcctaggtttgtatccacacaaacagtttcatacatcagcccatcgatgaacacaggtcctggcagtaacaaggacaacctagcagggtctacaacatctggacactcccaagtcacaggcaaaccacacccagctggtttgcacatggagaaatccggggtacaaacggtcacgataagtgcgccgcctggtaaatcagatgtgaacaagttaaaaccagctgaagatgttgtatcacatcgacaaaaggataatgaagctgtttctggggtccgtaaatcaggtgaaaatgagagcaaagcttcaccgatcacggagaagcatcccacaccagtgagccaacccttacaagctctagctgcaaatccagaaactacagcagctgcatcttttgttgtgaattctgttcctggagatgatggaaaaagcaaagaatctattcaaagaactggatcatttaaggatagcaataagaacgccactaaggacaccaggaatttatcacaagaaccacaggtagtcctgtaaaatattctatttttgcaattttctgttgttttgtacgttttgctcaacagcttatatattgtttcgttcagtcagcttcatctgctgaagatttaaaggtgcatacttctgtaaaggatgtatgttgtggtgttagtctcatggaatccaagggtgtgaataaagagtctgaacagaccaatgcagcttccgcttcaccgactgaaatgttaaaaggtatatgcattatgcactttgaaaatcaatgccaaaacagttgtattgtgttgctttgtttaacatgtttgctttggcagctgctgatgcttctagcattgataggagctctgcaagatcgacctctgagagcactgagaatgttcaagaagtaggaaaatctgatgttgctattggtgattctgagaaaagtggaataactaacaaagtttcaccagatcttacaaaggatgatatttcttctggttcaactgggaatgaatcacatgaagtttgcacgctagatttggcggagcaattacctgtgggagcttctaatcctgataatttagatactgcaacttctgtaactgaccagggacagcttctcaaagaacccagctcatcagtatctgatgagaatgttattatggacagatcgcatcagagtgctgaaaaaatgtcagatttggttgatgacactgttgcttctgttgccagttctgaaactttgccagaatctataattcaaaatgccaatgctaaaggtaacacaagtggtaatcaggaaacagggtctgctacatctagcaatattcttaatgtgttgccggtacctcattcagtggcatcagaggatccactgaaaccagaaagtatgttaaaggatcaatcgagtagtgcaccagcagcctctgctcgaccagtttcaagggaaaaacctagcgtggaaattaccagaacaaagtttacagctgtgaaaaagaagaaaagaagagaaatgctttcaaaagctgatgctgccgggagctcagatctttataatgcatacaagggacctgaggaaaaagtagatttcattggtgcctcagagagtcttgatagttcttcaattgctgatcatgagctaccagacgagtcctccgaaaaggaggttaatatgggtgaggacgagggaaagaaaaaggttgagcttgatgattgggaagacgctgcagaaatgtctactccaaagttggagaggtctgattccagcaatcaaacaaccgaagctaatgggaggaagagatattcacgcgattttttgctaactttagcacagagttgtactaatcttcctgttggtttccagatgattgagtacgccagcgttctgttccctaatttggccggaaagtcttatgttgttgatcacccaagtcctggaaggggagctgacaggccagcatctcgtggtgatcgccgtggtgttgtcattgaggatgatagatggggaaagtcgggccatctttttggttctggtcgtgatatgtccatggacaatggccctccaactatgaatcaccgtggtgctccaggagttatgaggaatccacgaggtgggcttattaatgtaggaccggttgcacctcaaatgtctcgaagtggctctgatgcagatagatggcagcagaagggtatattcccatctcctgttacacccatgcaagtaatgcacaaagcagagaaaaaatatgtcgttggcaaagtttctgacgaggaagaagctaagcagaggcaactgaaggcaatacttaacaaattgacgccacagaattttgaaaagctttttgaaaaagttaaagaggtgaacattgacaatgtggcaactcttactggggtcatttcacagatatttgacaaagctttgatggaaccaacattctgtgaaatgtacgctaatttttgtttccatttggctggtgcactgccagattttagtgaggataatgaaaaaattacattcaagagattgcttttgaacaaatgtcaggaggaatttgagaggggtgaaagagaagaagctgaagcagacaaaactgaggaggaaggtgagattaagcaaactaaagaggaaagggaagagaaaagaatccgtgctcgaaggcgcatgcttgggaacattaggttgattggggaattgtacaaaaagaggatgttgacagaacgcatcatgcatgaatgcattaaaaaattgctgggaaattatcagaaccctgatgaagagaacattgaagcactgtgcaaattgatgagcacaattggagagatgatagaccatgcaaaggctaaggagcatatggatgcgtactttgatataatgctgaagctttcaacaagtcagcaattatcttcccgtgttaggttcatgctgagagattcaattgatctcaggaaaaataaatggcagcaaaggcgtaaggtggaaggcccaaagaaaattgatgaggtgcacagggatgcagctcaggaacgacatgctcagtcgagtaggttagctcgtggctcagttgttggttctggtccaaggcgaggagctgcacctatggattatggtcctcgtggctcagcagcagcattggcttctccaagttctcagcaagttggccatagaggaatgccttcgcattcccgagggtttggtacccaagatatccggtttgaagaaaggagtcctttggaccatagaacaactgtccttcctccgcgtaaggatgaagccatcactcttgggccacaaggtggcctagcaaggggtatgtctataagagggcagccactgatatcaaatgctgagctttcttctgctgatagtcgcaggatggtatctggtcccaacgggtataattctgcttcaactgcaagagaggaacctggctcgagaattcctgatcgctctggaagaatagcaccaaatacacagtttgctggaccatcgaacaggcctgccagccaagagggccgttcagggaataaattatactctgaggatgatttaagagagaaatctatttccgccatccgggaatattacaggtaatattttgtagcctctgaattttcatacaaactatttcttcatttttttgccaataactattatgtttgttacaaattttgattataataatgacttactgtcttcttttggcaactgctagtttcttagggtgtgttctttaccaactcttcccaactagactctcattttctacgcgcacgctttctaaactgctaaacggtgtttttttttttttggaaaaaaaaactctacaggaaagttgttttaaaaaatcatattaatctatttttcgagtttattttagctaatgcttaattaattatgtgctaatggatcagtccgttttgcgtgcggggaggtgaagtttgcaatctccacctccgaacacaaccctgtttcgcaattattttaggcaactactagtgctttctagtttaaatttgtcacttctcattatgtggatttcaagtctgctgaggtacccttgtttctgacgttggagtactgggggtttatgaatgctggaattcaaacttaagacttaagggatagacaacattcttgtaacgttgagccagtcacaagattggagggcaattacaacttcttttccaattaattttaatcttgagatatctattactgtgtactttatttaggaagctagggtgttgttcttggatttcagtttttattgagtaacattttgttactattactaaaaaatttagaggaccacaagaacagtttattgtggtcctctaaattttttagtaatatatatgagtcctctgcattgtgtgctaacatatatacaactatttcggcagtgcaaaagatgagaaagaggttgctttgtgtattgaggagttgaatgctccaagtttctatccctctgtcgtatcactgtgggtaaatgattcttttgagaggaaagatatggaaagagagttgttgacaaagcttttcgttagtctttgcaacagtcgaaataatttattgagcaagtctcatctcactgcagggtaattgtttctcttcttttcactcctattgactctacttttgttttttacattttactgtatactgaacacatggttacttccagacttgcgactgtccttggttcattggaagatgctctaagtgatgctccaagagctgcagagtatcttggacggcttcttgcaaggtttgtggtagaaagcatattgtccttgcaggaggtgggtacattgattgaaaaaggtggagaagaacctggagagcttgtacatcatggcattggagctgatgtccttggtgcagttctagagtcgatcaaagtagaaaagggggattcattcttgaatgaggccaaggcaagctccaacctcaagttggaggattttagaccacagcatctcaagagatcgaagttggatgccttcatgaaagcataaagaagctttgttactaggtaagtcgggtgttctataatggctcatccatagtatgatttagatctatatgtcaatcagtgctttattgagattgtaaaatcctcaagttctaatatactgttttggctgaacagcttaccgattcatgggtgttggcaccatggagtttttggcatcagaccagccttttttttattgacaactggaaaggcccatcagatgctgcccctacttggcatgcacccattaattcttccaggagctcatgctgtgtgaattttcttcatcctgttcagagttggttctgatggtaaattatggaattgtcctcgatgtttgttgccaatagttagtcccatttcgagtcggccgtagcgagtatcagggttatttttttgtgatcacaggggggagaagtctttctaaccaatgtttgttgggagtagggagaattctaggttcacagcttgatgcctcccgtggcttctgaccaatatttcattgtgataagactttgtagttgcttataacttatcggcattttcctgatagccaaatgtttcacatgactcacctaccactgccttttgtttaaatcttgctgtacgtatttctgtcgctcttttacttggtatatatgtttgtgtgtatttcttggacctgacgtccatccgatcatcttgtctaacgttgtaacgggccctcgtttattatatggggtgtagaatggttgctgacccttggcaaattagaggtgatctctgtgtctcctttgcgtggatcgcactattttctgatgctccaacgcgaagggaacgggtgcttacacagtttgaggtattggtggaatcgtagattatttccgaaggatcgttgttgggtcatcttctcactctgtgtactcgtgaattggcatccttggaggtacttactccgttaacttattttgtgatgatgtatggctgagacttcatttctaaatccatgggggtatgataaggttttctgttttctccaattcttgtgatgttattatggtatgggtgtgtttagttcacgtcaaaattgaaagtttggttgaaattggaacgatgtgatagaaaagttggaagtttatgtgtgtaaagttttgatgtgatggaaaagttagaagtttgaagaaaaagtttgtatctaaacacggtctggtctatataaatacgactatataggtgcatcttgtagacttttatggttgctttagccccatgtaccgcctcgatcactctcccacctaataagacatggctaaatttaacacggtctaaaattaatatatgtgactttaaattttttatacactataatattgatataaagtcataatcatacaaaagaaatccaagtgttaatctaatgatgtactcccttcatctatttttgatagtaatatttctaaatctgaaaattttatttttgatagacatattttaatccaacaacttatcatcttaatgactttctcggatttaatgcgtgactcttcattctttcacataaaattggctacatgagcattgaggattataaatattaatgaatcgcttgtttacgagaaatgactagtagcatgtttaaatggatgataaatagacttacttatccttggtctgtgtgccaagatgaaatatgactatcaaaagtagatggagggagtagttgtcatctaataaaatttaatttatcacaaaacaattattgattaataaacattaaagctcccatcggatggcctattcagccaaagaaaaagccaaaatttgaattttcaaacttaattttgacattgattttgagatattttcaacgtagtttctttttcagcattggcttttaaatcaccgagaacacatatatattacctccgtcccaaaataagtgcagccgtagatatccgtgcccaacgtttgaccgtccgtcttatttgaaaaatttgtgaaaaatttgaaaatatttagtcacacataaagtactattcatgttttatcatctaatagcaataaaaatactaatcataaaaaattttcaaataagacgaacggtcaaacgttgaacgtgaatagtgcaaaactgcacttattttgggacggagggagtaaaagttttacctaaaaattcatttttattctctaataagccgttttggcttattaaaaaaaagccaaacgatgaggccctaggaccttactcaatggaatacaccctccgtccctaaatactccctcttcttttgatagtaatattttatcttgacacaatgatcaacaataagtaattctacttatcatccatttaaatatgctactagttattcctcgtaaataagcaattcattaatatttacatttctcatgtagccaatcttgtgtggaagaatagaaagtcacgtattaaatctgagaaagtcattaagaagataggtggttgaattaaaatatgcctatcaaaagtaaattttttagatttgaaaatatgactattaaaaataaatggagtagatggagggagtataagggattttggttagattcacatactagtattgtatttagggcccgagggagtattataagttgttttaacttttttttttaagttgggggctttatctgggtttatctgggtcatattaactactccgtacatcacttgcccatccgcctcactcctgcccagtccccctactgctctcgccgccccgaccaccggcggccgccgacacgatgtcctcgccggagcaggagccgatctacgacctacctcaactcgccgacgagctcctcgaggagatcttcctccgcatcgcctcgcccgccgacctcgcacgggcctccgccgcctcgtcaccggccgctccttcctccgccgctaccgctccctccacaagccggctcccctcctgggactactcggccacgacggcttccaccccgccgagccgccccaccccttcgccgccgccgccgcccgagccctcgctcaggccgccgacttcaccttctcgttcctcccgtccccctgccgctggattcaacaggattgccgggatggccgcgtcctcctcgaacgcagcctatccgacaacgacgacgccggtgaaggggaactcgtcccgttcgacaccaggaacatggcggatctcgccgtctgtgaccccgtatccaggcgttacgtcatcctccccccaatccccgacgacctgatcacctccggtgagcaggagggcctcctcgttttcgagaccttcctcgctcccgccgccaaggaggaggaggagatggtgggcacgacgtcattcagagtggtggcgagggcgaactacgaaagcaaggtggtcatcttcgtcttctcttcactcaccgaggaatggcacagctccagatctgtcagttggtctctcttgaccgccgatccctggttgtcgtcgacagctcaggcgcatctatggtttttcccgcgttactacgcgcacttcgtctactgggtgatgcatctggtggatatgttgctcgtgcttgacacatccaagatggcgttcttcaccatcaacttccagtgggatcgagactttgctattctggagacagaggaagacatgattggagcattctgcctgaagggagacttatccggaagaactcacctctgttatgggactaggcgaatcgatgctgattttgccgatagtccaccgttgaacttagacaagacaatccccttgcccttgcccttggatcattgctatcacattataaatgcaacccaggatacttgctcttgcaagggcggcgactacactcgtccagacgcactacggaggaggatgatacagatatgctatatttcacattggagcccaaaacaatgcttctcgagaaggtttgcggaatgagtagaccaaatgtcactgcaaagatatataccagtttcccaccatccttgtcactgccaagtctgaatactgaatatggtaagctttttattatagcatcagtaacatcttgccaagtctggccttggggatcagctcttgtgatgtggattcaatgttgataaagtgtttaccttcctggttgttcccggattgctggtttttgctgtgccaaaatgacctcatatgtgcttgtgcattcttaaccattgtcaccattttgattgtatattgtttgacaatttcctagagttgcaggctcaccgaaactattatctgttgtttgaaaggttttttaaattgaagaaataagaaatgtgatcattgaaacttcagaaagcacatttaactcttatctaaggctctgagctacatgcaattttttccccgttttatagtcgttctgacataaatggaacctattcgtgcagtgtggttactctgggcatatccaaattagctcatccctagatctccacaattgccccaattcatttcttctgccccttagccatttattatagttgtgtcttcatccgagttgtttcgtggtggtgcttgaatggctagtcatacttgggagtagggaatgcagccgtgatgatttgcagtgttgctctacaaattagcagcaaacttagttttgcacaaaatggtttctggtatggaacagcactggcactattagattgcagaccattgctacctacatggcagatatgtataaaaagatatgaatgtgatatatcatatgaatataatttaatgattacccatagcctcacatatatgaaccaatagtgggttcagttatactggaaccaatataactgacttttaccattttgttagcttcgatgcttcttgtcatacacaagcacaacctaggtcaaggaacaagcaatcaacaagatagaccaggaatgggaacattggacttacttttaggtctgtggctttgcttaccagatttatagtctatgtcatgttttatctgaaaatacattcaaagtgatttttttcaaaatgaattggccatcatggtttttgtatctggttttgcatgtaccatgtacacccttggtcccaaaaaaaaaaaaaaccaatcctagctagaattggttttttatgggaaggagggagtagctatcatttatagagtataatcacgttatcctccggcatgatgaatatctggtttttttctgtatgactgtatgtaggcttgtttggttcaatgagaaggagtgctcaggagccaggaaggaatatcttggtagacatgaagctacaactgacggtggtggcatctatcagtattagtttgttcaaacgttgtctagtttgtttaggtagtcctattccacttttagcccttgtgatgtatttttgtatttggttgcaagtcaagtcaggcagatcgtggcttttggagcttttcaggtttgtccaatagaatcctgtgaaattaaggtggatggaatctattaaatgtttggaaccatgttttgtctgtcatcttgagcataaacttctttctaaccttatgcaattgctcggataaattctgttgagttctttaacccactggcaaattcttaattgtcatattgtgatattgtttctgaacattgatagtgtgaactgaagtgtactttggggcgtgaggtctcacatttagaatatgattcactgatatttgatgtggtagcttgctataaagctgtatgcagggaaactaaagttcactgtgtttcaagatcgagctgatttaaggcgatttacctagcggtaaacgcaaaacgaggtgttctgcaaaacgccaaaaatagggggctgtttacaaaaatcccactacacggccacaaattgaccggtgaggattgtatgcgctactgtgcagtagcggacattgacgggccggcccggcacctccttgggccgtgcttgggctgaggccttggcacgtgggccggaacggcacggcccgctacagttaccaccagcgggcccgtgccgtgctgggccgggccgcccatttggcctgctataggccatgaattcaccgctctccagtctccagtgctctcgagtctcgacgctcgcctctgatcccctcccccttcgatcgagccgtcgatctcgccgccgccgccgccgccgccgccgcctccgatgtcctcgccggagcagccggtcgaccctacctcgctctatacggagaatattttgccacccgacgagctcctggaggagatcctcctccgcgtcggctcgcccgccgacctcgcgcgggtctccaccgcctgcgccgccttccgccgcatcgtcaccagccgctccttcctccgctgattccgctccttccaccacccgcctcccctgctggggctactctgcgacgacttctacccggccgaccccgccgccgccgcccgagccctcgcccatgccgccgacttcaccttctcgttcctccctacccctgaccactggtggcgctggatgcccctggactggcgggacggccgagtcctcgccgccctcgtccccatgaccaagatcatcacccacgaaggcgacgaaggggagttcgttccgttccccaggagggacgacgtcacggacctcgccgtctgcgaccccatatccaggcgttacgtcatcatccccgcgatccccggcgacctaataacctccggtgagcagcgagattgcctgttcgatttcaacgccttcctcgctcccgccaccgaagaggagatggcggattcgtcgttcagggtggtggctacagcgcagtgcaaaagcaagttgtttgtgttcgtcttctcttcacgctccgaagaatggcgtaagctttcaattcgacagtgggagcatcttcgccgcggatgtgaactcgtcggtgctggttcaggcagatttcttcttggccccgcgctactatgcacattgccgcttgtactgggtgctgaaggagatggacaagttgctcgttcttgacacttgtgagatggtgttcttcaccattgacctcgagagggatgaacacatgtcaaacattgccattctggaggaggcagaggaagatatggttggagttttctctctcaggacagacttaggcttcactacaagaactcagctctgttatacaattaggcaagtcgaagctgatgctgccaatgggccaccattgaattttgacaaaataatccccttgcccttgcccatggagtatatgtttcgcatcatagatgcagctgacggatacttgctcttggaagggaggctactggactggttcgaatgctctttgaaggagggcaggccagatacattatatttctcactggagcccaaaacattggttctcaagaggatttgcgtgttggaacgtccaattaccgctgcaaagatatataccggttttccgccatccttatcaccgtcaagtctatgaatatggtaagcttattagaattgcattgctatttgtgttttactggccttggggatcagctattatgatgtggattctatgttgaggaacataaattctgtgtgattgtttttcaaaatgatttggccattatgtgggtttcttgttttgatggaatctctcggtaattgtaatactacataattctgtatacaggctttttggcatgatgatagggacatcgaaaggggacagagcagcactggttatcaatattgctctcattgctcaggaacgccgttgactacatcaagctacaactgatagtggtggcatctatgtaatttttcaacagtaatctagtttgtttctgtagtattgttccacttttaagttttagcccttatgatgatgcattcttggctatttggttgcaagtcaggaggctctttctgatgtaagctgtattatacttgactagtggctagtggagctttgcaggtttgtccaatagaatctggtaaaaatttctgatgaaagttgatggaatctgttagtgcagtttataagcagtttttctctaagtcatcttgaacttgaactgctgtttcaaaccccactatcagtagtttgttcaactgttatctatagtttgttagagtaatcttgttcccgcttttagccttatgacgtactactattcttgaactatttggttgcaagtcaagtcaatgaggccctttcaaacgaactctctccgtcccaaaataaaccaactcgtacgagattgatttattttgagacggagggagtatgctattaaatcatatggaggacatattccagccataaaagacacgtcccaaacagataggcgatgcaaaataggcttattctagcacgatgggctggtcgtggtttcgggccggcacggcaaggcccacatcttattgggtcgtgcctaggccgtaggtacaacctgtgggctggcccagcacagcacgaagagtatccgggccatgctgggtgtcccatttagctatctataccaaaggatggaatttttttcggttttagattttttttaaaaaatatttacagaaataatctatcggccaaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcgacaggcctcgctgcctataaaaggcctgctgctcagcccccagccctcattcttctctcctcaattccagtgaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacatagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctatcagattttattgtatcagaaaggggaattgataaaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacacgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttttgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcttgtactcttgttgtacataattaatctcatgattttattactatttcataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttggaacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggtgacgcggacccagctagacgatggactgtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttaggccagtgaccacggctgtggactggcaggacgatctgacggcacgtttcgcactagtacagcgcgcaccgcacctcccgctcaagccgttggcacaccaccgcaacaccggacctacgaagaggtgactgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggacaagggactctggctttcagaactcagtcacattcagtactctcttccccacttgcttcattacaaatccgaccggctttcgtcaatggctagacgccggggtgttgaggatccaaactggcgtagcgatccttgtgtatatctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatctcgttctcgacctaactacttgtttacaagaaggtcgctggtatttcgcatccgaaagtaatgagcaatacttacagagaaaagcggtttatgaacgacaatgtcatgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaacagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttctacgacccagactgcgataggcctatctaaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtcccttgccgccctctattggggcggcaagagacgcagatgaaaaagtacggtcgcaagctctttatgggcggccaaaattgcaattagccccttgccgccctctgtatgggcggcaagggcctaatcgcaattttggccgacggcggcagacggcgcggtcgacccaccgtctaccacgtcagcttgccgcccaccattagggcggcaggggctatttctgcaatttttttgtcgatagattaattctgtaaatattaaaaaaaaatctaaaaacgaaaaaaactcccaaaggatgcagataggttggaaactgccattctggaggcagatgaaatcaactgatatatagtacgatttgtcggctgatggtgccaatggggcaacacttggatttgcacaatacaatctctttatcattgcccttagattatagctttagcatcctaggtgcagctcagggatacttaatcttgcgaggatgtcacgtcactccttgtccatagactctttggaggacatgctaaggtgcagctcagggatacttctcagtagagccccaaaagttgcagtttgagagggtttacaggtttgatacttggatacctactttgcaatgcagggatatatactggttttccaccatccttgtcacaagcaagtatttgaatatgtggtaagattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcccgaagcatcagaccaatgatcacccatgacttatgtgtaccactagtgccacaaaggcctgcctttggtggtcttattggcgcataccatggtaataatcttgataattgtgttttgctgtcccctgagagattagctctttccatgtgaactcttttggtgattatatgtgtttaccttcctgggtgttcctataccatttacttttcaccgtgcctatattatctcatttttcgttaaccattgtcgccgtgttgattatttgtggtttgccaacttgttagtgcctaagactgtaaactatgcactatatatgttttctatcttggttatggtcggtctgttttcagtccaattaacatgcacgcagttacttttggcatatctgaattatctatttccagttatccgtaattccccacaatcgatgacttattgttgctgcatccgaattgtgttatgctgtttggaaagatagtcagatcagggagttgggaatgcagtgacggtttgcaatgttcttcaaaaaattgccgttctagatattagttttttttactaactgatttccagtttggaacaacattcacacttttagatcactggccatgcggagtacatgtcaattatgtatgaaaataaactgaatgtgaccattcttgtgaatataatttagtaattgcctatagcttcacatatataaaccaactgagttcatttatgctggattcattataaataacctctagcattttgttagctttgacgcttcttgtcatgcacaatactaggtcaaggaacaaggatcaacaagataggccaggaatggttttacagtatatgttgccctattgtgttttagtgcatctcgtcactagcatttctagataaactgacctcatcctctgccataaggaagcacttaacatttcttgccttcagccttggtagtatttttattgaccattttaacacaatatattctgtatacaggcttgtttgacatattgataaggagacatcccaagggggcagagcaggattggttgtcaacattggtctgagtaattaggaatgtcgtgaaagacatctagctacgactgaaagtgctggcatctaaattatgccttaggctgtgtttagttccacgccaaaattggaagtttgaagaaattggaatgatgtgacagaaaagttaaaagtttgtgtgtgtaggaaagttcgatgtgacggaaaagtcggaagtttgaagaaaaaagttggaatctaaactgtgttgtttccatcgaagtttgaatagtaaattatttctggttttcggaaacggaatggatatttagaaaaaaaaaaccacatcagtgtgctactgttcttgtttgacccttgcatgctcttgcagaaggacttctgacttcaccgtatgctccctgtaaattgtacccatggcctgccgtctgaccgctcaaaagttataaataacgaaggcaaagagcaatggtgaaagtggctgccatttttccggacagaaatattcagaagaatggcgtcaagcctgcagtctgcttggaagctgctgatgctgctgctgcatgacaccgaaacagcagcaccgtcgtaggagtaatagcaaatgtaaacctactcctacgtcgggaacagatagcaatcgagtacatttctgcatagcaatgctgcagatacagacaattttgtcagtttaatttcctgttaaaccgatcagttccctgttaaacaccacggtcaaatgcaattcatgcacacaaatgatttatgttgcttgatgctgtacttaagatctgtctaccaaaacagagagaactgctcttttcttaacataaaaggcaatcaaatttcaggaaattcaggtgcatacaggttagtaagtctccttttcccatcttcacattttttcccactttgccaagtgattgatatcctaaggtcctgtttatttttttgaaaaaaaaagcttatggccccagattattagtgtgcatgaatttctctaaaaatatgattctctaaaaatttccttatgcaacattgcttagatacctttacccaaattatttgttaacaatacaaataaatagactattttagctcaaaaagaataggagagtcttcaacaggctctccaaatggctctctaaatcaaaatttaacaattctagcaaaacaaaaacgcgctccaacaacctctccaactaacgccaagccattcggccagccaaatccctctccttgctgaccatacttgactggcctaaatgacttgtcaatggtgacctcacacacattccgcttccctatatggctactcccttcttctctctcgcatcggccgtctaccaacctagccaccaccgtggcccctgctaacaatgacagcacatagcagagaggtgccggatcacgggcaccaccagagctacatgttaacatccaaatatggtacctaagcacgggataggaaaatattgctgaatttggaaaggaccagtttttttttcatggggccggtctgacctacgacatgtggctggtcagaccggctgagtcctaatccgacttgaatttcattgggtctcgggttctcttacttgggctgaggattttcaagttctaattggtctttatcccgaatgaaacgtggataagatcttgtaggaggcaagactaacctctttataaggactatggccggtttaattgagcacacaatctactccaacacaattaaccaatggaatcactttttcaatatcgcatctactttttacctagttcaagcctagtttttgtctatcttcgttggtttgagctgaaagccgtccgtcctcaccgcaagagtgtaaattctcttgtaggtttgtcccgaaattcttccgttctgcttacgagatgggtgtttatccctatatcatctaaatcggctccgctagctggtttcgatttacacgagcttacccactgctagtgggacgtcttcgacggaccccaaggcactgagcattggcctaccctcctacccacgagcgccaggcaagtgtgggaactcgacggatgccatgtaccccccccctccttcttcccccaccctggccaccatcctcatcacccccaaagatggccacgtccaccacgccatcgtcatgctgatggagcatgtagcaggctgcacaggtcgccgccacgggggtaggagccgagcggcgtgggtggcacggggactatgtcgtccctagctctggagtggccgttggccggaggtcacaaggagtggtcgtcggtgggtggatgaggaaataaaagagaagaggaagaaaagatgagttcttaagacactaatatgtggggtccacgaaattcggagagtgtgagatggagaggttattggagcacactgaaaacatagagagagatctttttggcaagttagccaaatggaatgggcaagatagagggtcaaaaataaccatgctattatagcatctccaatagtctctccaaatctgactctccaaatatttatttggctaactctccatctaatttgttaagtcaaactcgttatttactccaacagcctctccatccaccctctctattctaagtctatgatagtgggtcccacgtgtcagtccctacaaccctttcttcttcctcatctttctcccccttttccccaagtccttctgctcagctcgcggtcccctcggccgccgccgccaaatccccatccgcccatcgccatccgccgccgccgctagggatgaaaacggatcggaaacgaacagaaactaactttatcatattcgtcttcatatatttttttcggaatcagaatcggaattgaaaactcggatacggaaatgaaatcgaatattatcgaatacagatacggagcgaatacgagacggaacgaatacggtagcgaatatttaccggtatataaaaaaatccctcaaattgagtttcttgataaaggaagagatatcgcttattattttagttcaacatctccaacatttatatcgtcaattttgtagacggtcccacaactatatgtgaaaatcgattttcatggttgttcctctaagagatccatatgcaaatatgattatcattttctattcccaagaccttttactagatgtataacttacttaccattgtataaattggagatgttatttattttacttcacatcttcgaaacttgtaatgtttgtattatactttaaatgctttcaaatataaatgttataaactacaaatggtaaatcccgttgagctctagaaattccacgaaaacaatccgaaaccaactccccacggaatctgccgatctgaccggcaacctagtgccaccctgcactgttcacccgcgaaaacagtattcaccataatttccaaaacactcacttttgactatttgttcatcatatagattgaatctaacaccttgatttcacaatggaaagggctatctctgaacccaatctttaacacataaagaggagagaaggagttgagacgaaaagcatggagcgagctgcctgagagattgaatgggataggaatctcccaatgtggacacttttcattaatcctttcttactataaaattgatgcccattaactcctaaaactcatcatgcaagtgtgcgacatcatcacccatactagcaattattatctagactattttaaatatcatgcaaacattacgtatcatttacaattttgctgtattattagaactcaatatacaagcaatggcaaattattatctccacatcattttcacattatttaaacatatacatttaccatttctatattgtataacatgtattcatttacacatcttgcagcaaagcatggggtatcaactagttaaactatatttaacccccgaggagtaatagtccctcaaaactcttcactannnnnnnnnnnnnnnnnnnnnnnnnnnnnnnnctcgc

SEQ ID NO: 63582 - DNA, 8635 bp, Oryza sativa
ggcatcacggtgctggactggtgccgcaacgagcagttctacatgatcggctccacaggggtgtacccgcggcgggtgctgtacatggcgctcaagctcgtcaccgggaagggcatctacttcaggctcacgtcgaagcagacgacggccagctccggcgacaagttcgccgacctgtacaccgtgcggtgggtgccgctgctgataccgaccatcgtcatcattgtcgtgaacgtcgccgccgtcggggtggcggtcggcaaggcggcggcgtgggggccgctcaccgagccggggtggctcgccgtgctcgggatggtgttcaacgtgtggatcctggtgctcctctacccgttcgcgctcggggtcatgggtcaatgggggaagcggccggccgtgctgttcgtggcgatggcgatggccgtcgccgccgtggcggccatgtacgtcgccttcggtgcaccgtaccaagctgagttgtcaggtggtgctgcttctctcggaaaagcggcggcgtcgctgaccgggccatccgggtagggacagttcgatcgcgtttgatttgatttgaatatttgattattttcttggtgcaataattggttgttacttctgttatgtcgttacgtcataggagcggctgactatattgctagtctgctctatacgagtgagacttggattgttcttctttaaaaatgacaagatttgaatttctccagcgtgatttgtcgactttatatgttcggatatattttacggctttactctgttcgatttttttttaacacagaagacgttcgcaaatacacaactatgctagtacatctctaaaagtcaagtgcactaattttaacctattcactactccctcagtttcagtttcaggttataaaacgctttaactttggtcaaagtcaaactactttaaatttgactaagtttatagacaaatataataatatttataatatcaaattagtttcattaaatcaataattgaatatattttcataataaatttgtcttggtttgaaaatgttattattttatctacaagcttagtcaaacttgaaacagttcaactgtggccaaagtcaaaacgtcttataacctgaaacggtaacctgaaacggagggagtagtctatataggctactcagctacttgggtgatacttgaatttttgttttgaaattacgatgatttgaatttgttcgacatgacattttgactctaattaagttctcttaaataactttttattgaatttttgcatttaaagttttttaattatgcagaagatgagagcacatggacatattagtgttggtgaatagtaatatattggttgtaaaaagggcaaaagatctaatatatgagtgggaaacctcttacctcagaagctagattttagggtaattaaaaagactatttacgatcctacgagtatatgtaactatatatgcactaattttaactttgcacccaagtactacactaattttaactttacacccaacaaatggaggtcaagtataaatcttttatcatcttcagaaattagaactataatagttaatctaaggggttgtttggtttacttccgaagattgtcgcatctcatattagacaaatttgatcaagttagctcattatttaattcatggtcgcacttatgacaagatgccctttcattttttatgctgtcacgtgttatcaactaaaaaaagtgtccttttcttttgctagctaaagtggcttatttttgttagccataactcaggtgtaacatcctgtctctcccagccggcccacttacatctgatatcttttataggtcatagactgccctcccaacacaactccaggccaagcacgcttaacctctattggtatttaatacggacactgataaaatccgcaagcgtacggatataccgatgtagcactttccctacggagtattataagggtatcgaatccaagaaaacgtgtgtggtcaaatcttcctctggttcatccaaggataccaagcaaaagataggccaggatagagaggatttactagtgagaaacagtgtctagggaaagcttaactttaatcctaatgcaatacttcaggcactggcaacccgctgttcccagatgtcgctttactacgtacccagacagggaggacttaagtgatctgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcgagtatctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgactcctccttgagtttcccttaatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccatcgccgagagaaggatctctctctctctccctctttctttctctctctcgttttctcgctccctctctgtttccctctcgcgccgacaccgcttcccgctgtcgcggcccaaaacctccaccgccttcgcccattcccgcgctcgcctcgcgaggtggccgaccggccggtcgccgccgacgccatgcgctgccgccttgcccccgctccatgccaaaccgaccgccgccgtcatcgtcgacgtcatccatggcccccgccactccacgccgcacccgtccaagagtgggagaagcagctgctctccctctcctcctcctcctcactctccctctcctcattatggcaagggaccaagcccctttttccccttctttttccctttcccgaccactgccggtgtcactgcctccgcgccgcttgaccgaccgcgccaactcgctctccttgaccacgccagcccacgctcccgcggttcgatttccgccgctcgatccatcaccttcgccgcccaacgcatccacgccgtcgccgctttctcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtctccgcctcgctcgaaacacccgcgcctttgttgccggccgccagttgctcgcccccgccccgccgtcgcgaccacctcgccacgactccctccgcatcgccaacgttgctcctctctcgccggtgagctcctcgcccaaattcttgccatttgcatcgtcttggataagccccgagccgttcggttgctcgctcgtccccctaaacgtgccgccccgccgttgctctgcttcgccgccgccgcgcccgactgtgcaccgccatgggccccctcgccaatccctcgcgccaccaccgtccttgagctccctaggacctccccaaaccattccctagcgccgtcgccgcccggcacggcctcgccgccattgccgcccgctcccaaagaccgtctctcgtcgccagccaatctcggtgccgctccgtccaatccgacgccggaaacggattccttgaaccccggagatgctcccacccctttgaatcgaaccctcgtcgtctcgtcatgttttccccttttgctctccagtgattgccgccgccgcaatccaccgtcgtcggctcctctcgcgtcgattcctctcgccgccacgctcccggggatccccatgacctccccctggctgccccaaggccgtcggccttctcctttgtctccggccgtgtcgccgcttccgccgctgcctaacgccgccgcgcgtgcgtcgccggtgaccatcgggtcccgcgtccccgcgtgcgcatcgcggtcgcgtaccgtttcggctaggcccgagtccgcgcccccttgtcccttccctcgcgtgaccacatccccgatccgacgagcttggtcgccgtcgccagccaccgtcgtacctctcctctcaaatccgtgccgttaaacggattccccctgacctcctctagctgccggcggtggccgctcgctccggttcgccgccgctcgccggaacgcctcgcgcgtcgtcggccgtgcgatcccgggcgcctccttctacttcttctcctcccctttggctcctgcccgcgtggccgaccacatggcagccacctcagccccgggcccgcttgactgggtcaagtcgcgcccagtcagcctcctccctccgtcttccctcccgtgcgcgcggtccacgacaagccgtgcggctgcacgtgggcccgccgccatcagtccacccggcgcgccgcgcccgaaccgcgcgcaaccgaaaccctagcgcccgcccccgcgtgcgcccttcccaccgtgaacctaaccaccgccatgtgggtcccgcgcggtggaccgcgcccaccccgtcgtgcctccctctctccccgcgcgccctaatgggctgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagatctatttaatggcactactaataggtctaaataggatctttcttttggtctcttgtttaggttttcgattgtttgtgtatagttgcggttatcggattttcgtcgatcgcgggttttctcgaagattcgtgaagcttcgagaagaccttgagcaaggcaagtcaccctttgatcaatcgcccctataattgaaaagtcattattattttgtttgcaacttgcattattagaatcacacacttaacttgcttggcctcggtttgcgtgccaaaccgacggatctacccagtagtcgcactaatttctgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtaaaaactcgcgatgcgggggttgtgcctatgtagcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcagacaaaccgggttcctggtaaggcaaggacgagaagcttgctcacttaccgatcaaggtggttggagtttgatttgtgaacgcctaaaatggcctatgtttatgtgaggatttgatccttcgatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcaaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctgggtagctagactctgggagtccgagaaaatgaaaaaggctctgggagccgagaagtaatgatctgacctgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctataaatatatatatatagttcctccgccctgaagagatggtgaagtgaagtgaagaattggggtttcgccctggttcccagccgtcgcctgtggtgttgggtgttagaccgttggttccgctgctgttgttgttggtgttcgcctcgtccgtgtcgtcggttgtattctcgggctgtctgagctgcaacctaagttaaggtaaataagtcctctatttattttaaggattgttatgattcatatttgtcaccgtgggtaccagcactatgtcctgggactggtaccgagatcgcggtttcgtaggaagcggttcgcgccgctttccctacgacacgctcctgtcaggtgccgttgtacggcggtatcagattggggtgtgacatgatctcgagagctgtcaccacctctacacctacctcaaacgtactgtgggatacgcagcaattactggataataattacctaaacaccacgtctaaggaatttctatctacttttgtgtttataactcaccaaagtaatcactatattttagttgattatagtgaacaataatcctgtatgttatttaggaactaactaagagataattctcacaagataaatctaaattactcaagaaaaatattatattgaattcagagtaataaacagaataaaagaaataggacaagattaccggcaactccggaattcttccgacctcttctactctactctcttcctattctagtagacaatattgtacaatagagcctcttataattcggctcaaacttggaagtgtgtgtgagagtgaatgaagtgaggtccttttatagggcagttatgacggttgtgagaaggggaaatgtccgaactgccccgcaaccgtcattgggagaacatctggaacgtccacgccaaaccctaggatcaacggcgatcagggggttcggccgaacctgggctgggccctcctggcctctatccatttctcggagttttgggttgattcactgatgttttgattaagttcacaactcatccttgtagggatacataattttcctcactttagtctagatttcctcccaacatcggggtttatcacctgcatacaaatatacaccaacacttgtggaatatgtgagattaagcaactattaatatgttggatgttttattatttgaactttatgtaaatgttggcggtatagaattgacatttaacagccgccaacaacctcagagttctttggaaatcggtttccaaaaaaagttgcaacttgttgatatgagtattctattaattctattagaccctggaccgggatgtcacatcaggttaatgacaataatgttagcataacatccaaacaaccccttaagagcaaggataataatgcagccagctacttacttatagcctatctatcacctcactcatatagtggttaactcttcactataaatatatggtccacatgtctgtctcacagattttcttggttcctgtgtctaagccggctgtaaacttacagcccgcttctcatctctctcctcttttctcctatccacctcagcattcagccttcttatagcccactattatacttgctctaagttgcttaaggcaaaggacggctttgattcgtcggcagtggatcagcttgccgcggtcctccattggcccaatctactccaggtgcacttgctttttctcgattttttttatttatagtaattattagtgacgtacttgaattaaataattagtaaatctttcttcgaatttgtaaaaataatgaactctgttgccaataacgttcagatttggacgcactttcgaagagcgtccaagaaaggacgctgttccggacgaggttctgactgatgcgcctcgactcctctccaacacaatgagtgaaacaggaaaagaaaagaatcaatcttgcgtgagcgtcgttctccggctgtctcagccatcatttgccgaggcacatgaagaggcgtcaccgcctactgcccatctcggcatctcctctggtacaatgtccttgcacggatagagcggaggcggtgccgtccggccggcgtgccgcgcgcacgccaccactgtccgcctcaaagctcaaaggcccacgctgccatccaccgggaaagggatactctgtgt

SEQ ID NO: 63583 - DNA, 1449 bp, Oryza sativa
gtttagatctagggatgtaaagttttggcgtgacacgtcgggtattatataggatgtcgcatgaggcgttagggcactaataaaaaaaaactaattacagaatccgtcagtaaaccatgaggtgaatttattaagcctaattaatctgtccttagcaaatgtttactgtagcaccacattgtcaaatcatggatcaattaggcttaaaagattcgtctcgtaaattagtcataatatgtataattagttatttttcagactatatttaatacttcatacaggtgttcaaacgttcgatgtgatagggtgtaaaatttttgtgtgggatctaaacagggccatagtcattcaagtgcttgttgttggtgcatatcacacaccattctctagatcactatatattcaaacaacataataaactattatcacgatatactaagtactttttaggcatgttttttctgctgaatggaatgtaaatgatatattaagataacataatgtttaatacaaatatttaagtacaaatgcaacactttagtaattaatcaaataatttatttttgcaagtgtgtactctttctggattttaacgtacaacaccgctaatttttagacatacttttgactattcatcttatttaaaagttgtgtaaatatgaaatatacataaaaatacctctaataaaataaatactaacaaaataaatgataaataataaaataaatactaacaaaataaatgataattatgtgattttgttaaatacatctttaaaaatcaagagcatcatgtattaaaaaccaaaaccgaagacaacatatcgaagttccttgttttagtaaatacattttgtatttttacttgaactatgctattgatttttttctctatcattgacagtgtgcattgtagttttgaggctttttgttttgttcatttgaatagaactaagaatccaacggttcattttgcttgctgcctacatctgatggtggtcgttttgtagcctacgtggctcaatgaggatgagagaaagattaattctttcactactttagatattttccctatagtgcaggaaataccataaataggctaattgtagtcggccacaccaggacttcacaaagcaccaataggggttttcagaagacagaaattggtgttgtaggcttgtagtggcaacagcttaggatgcgttcgttcgttagagctaggaaagttcacctctagcaccgaaaaaagagcagttcattagcatatgattaattaattagtattagtcaaaaaaaaaacttgaaaatgcatcgatatgattttttttaaagcaacttttctatagaatttttttttaaaaaaatataccgtttacctgtttaaaaaacgtgcgcgcggaaaatgaggaagcggagttgggaacactcggtgccgaactcagccttaat

SEQ ID NO: 63584 - DNA, 12535 bp, Oryza sativa
ctgattaaggataacttgatggaactaatcacagatttcatgaaaagaaaaattagagttgagagattaaattatggtgttataactttgatccctaaatgcaaagaagcaagaatgatacagaaattcagaccaatatgtcttttaaatgtgagtttcaaaatcataacaaaaattttgatggaaaggctggctgaggtgattgaagtcttgattgctttgaatcaaacagctttcataaaaaatagatatataatggaaggggttgtaactatgcatgaatttttgaactcaattcatcaaaaaaagcaggcaggaattctgttcaaaattgatttcgaaaaggcatatgataacattaagtggtcttttgtgtattaaatggtgaaggccaaaggattccctgacatatggtgtgattggatcttgaaagtggttaaaggggggaaagtggccatcagagtgaatgatcagatagggcactattttacaacacacaaagggttgagacagggggatccactctcacccttgctttttaacattgctgctgatgctttaaccattcttatcaaaagagcagagcaacagggactaatcaagggtttgggaatggatgtcatgagagagggggtggctattttacaatatgcccatgataccatatgcctgatctaggattctctggaatatgcaaaaaacctcaaattctttctgtgtatttttgagcaattgactggcctaaaagtgaactttcataaaagtgaagttttttgcctgggagaggcagctgagagacaggactcatacagccaaatgttcacttgccaaattgagagactgccaatgaaatatttgggtgttcccataaatcaagtaagaatccataacaaagattggaaacctgtagaggaaacaattgaaaagaagttggggtgttggcaggggaaactcctagcaataggagggagggttgctttgattaactctagcattagcagtgtcccactttatatgatgtctttatactctcttccttgtggagttagagaaaaaattgatttttatagaaggagatttctgtggcaagaagatcaaggtaatatgaaatatcatctagtgaaatggccagtgatctgcctccctaaagatcagggagggctggggattttagatttagatgtaatgaataaagctctgttggggaaatggctgtggaatttggagaatacagaaggtttgtgacaagacatgctaagaaacaagtatttgaaaaagaaaactctgactcaaataaaacataagaatggggattctcacttttggtctagtttaatggagatcaaagagctgttcttgagattttgtgacaagaaggtggaaaatggggagagtaccctcttttgggaagatagttggtgggggggggtaaaccaattaaagagtctgctccagatctttataacataaccttgacaaaaaatgtgactgtggcagagatcaaaaggagagggttaggctcaatcaaattcaggagagacctaaatgcagttaaacagagaaaatgggctaatattggtagagccctggacaatgttagtctaactaatgaaaaagacagactgatttggagactgtctagcaaaggtttctctgttaaatctttctacagagctttggtattacaggggatcaattatccctacaaaaaaatgtggaaaatcaaaacaccacccagggtgaaagttttttcctggctggttctaagaaatagtattcttacaaaagataatctgttcaaaaggggttggaggaagggctcgattaaatgccaattctgtgataagagtgaatccatccaacatctgtttttagattgtccgatggctcatttcgtttggagtgttgttgaatgcgctctcaatgtgaagcctggcaggaatgtgggggaaatgtgtagctcctggattttgaaatttggcaaagggaatgggaagttgattatggtgggggttacaacagtcttgtggaccatttggaaagcaagaaacagagcctgctttgatggaattatgcctgttgatcctatagaaatagtttataacatttgctcaaatttaaactcttggagtattttgcagagcaaggagggagacagaggaagaatgcagtggggggcgcagctactaaggcaggtagcaaatgagatctttcactcaaaatttgaatggaggggcggcagacaaagaataggatgggaaacagaggcagtctaaactaatggcaaagagttttgaagacgacgatagaaacctatgttttgatgcttgaaatgccaatgttctagtcctgtaataactgtttgttttcctttttctctcgtcttttctgtaagaacttgatgtctggaactcttgtaatcatctgcgttttctttaatgaaaacgggggagtttccctccctttctcaaaaaaaaaaaaatcatctacgcgaagacgttgaagcctccgtcgtcgtggcgcgcgtaggaagtcgccggtgtgatcgcagccactacgcacccgcacgctgggccaggagtcgctgcgtgcgaatctccccccaaaaaaaggaagggcgccgagcgtgcgtaccggacgtgccgtatcttcggcgcgctccacaggctcgcgtgccgcgggatcactcgattcgatcgtcgcctgggtcgccgtctcgcttggattcttcgcgtcgcgcgagaggccgggagagttcgggcgccgcgcaccacgcgcgcggaggcgggacgggacgtacgccactggccacgtaacgtaacgtgcccgtccgcttccgcgcctcctcgcccgcctgtgtagcaaactagagagaggcggcgcacggatcagatatatggtgcacaactgcacaagtctgcacatgggtggagcccgtgattccggtctcggacgatctggtggatccggagcccacagatatggaagaaacgatatgggtgagaaccagtggattattatttggatttctagaaccatcctatgctgagatttcttcgtcgcccggtggccccggcgggcggcacaccagacaccaaactccaacaccgagggcggaggcgggcgaaatccgtttgcgcgcaaccgacgcgatccatccatccacccaaccagccacgccttgcaaacggccaaaaaaatccagcagacccaccgttttccgccgtctcaaagaaatcgccacggttctcctcacgcaaaaccacatccgcacttcgcgaaacgaccgccttgccaccgcctcgtgccgatgcgacccacgcgcggccgcgccgggacgagggcacggccgtcacttcctacgcgtggggatcaccacaaccaaagccccagtgacgtacgagtactcctgatgtgggtggggccagtgagtcagtgggcggggcacaatgggacccacggtttgggaatcccgggtcgcctttaaagcgagtcccctctccgtcccaagccagtttgccgctctccggctcctccacctttctgcagttctgattccattcttgcaagttctaggtatacacaatcttctctttgttcctgtttttttttcttgcacaagtcaagttgagttgttgataacttggtatggagaaggaaatcaaaggctggttgtaattttaggtcagggttagatttgtttgatctgatgtaagtcctaatcaaaatctttaattctgttaacaccttttatgacaaagagatcttgtaattaattgctcattaaagccatctttaatggtgtgcagaactacagaaagcagggagtaatggcgtccaactacgtggacactgctggggaggaaggcaggttccacggccacggccaccacagcagcggcacgacgccgaccggcgcggcggcgtcgccgaagatgcggaggagctggtcgtccgccgcctcggcgtcgtccggcggcggcggacacgggtccggccccaagtgcgtctgcgcgccggcgacgcacgccggctccttcaagtgccggctccaccgcagcagctcgcacggccacccgtcgtcctctcccaccgccgccgccgcgccggcggcggccgtgcagtcctcgtcctcccgcaccgtcgcggcgcagtgacgcaagaacggtctctcggaccaagaaacgcccaacaagaagagaggagaaggaaaaaagaaggaaagaacataatctaaaccaaagaatatttgtgtcattcataagaaaagggatattatttggttcctcccttgatgtggtgccatttggaaaaaaaaagtcccttttttcccgttctttttcccatctttttgtttgggatctccattgaagaagttgtctgcttttcctctgtcctctcgactattggaaattggaagcattttagtcatattgttaagagtatgtgtggtgctctactatgtaattaacatttcagtaagatccatgcttgttgaaggtgttgattttgttcagacgaatggatatcctggaagagcatttctagtcacaaacagatttgctgataggctgatacaaatgaaccactaaaggataacgtagtagcaaaaaaacggagtagatttgttggagtagaaggtagcaagcacaaatatctggcacaatcaagagagggtctgttggtggttaagctgacttctctgtcaattcctgccatcgtgttttgtgtcagttttttaggttatcatgtgatgcttctgcagcatgctgacaaatgctgcagccacgttatcatgttggtaatgtaaaccactagtagtattcgctgaacaacaacagaacagtttagtagtaacaatgtagtactccctccgtccacgacgtttttcaccttttatttgtaacgtttgaccattcattttatttaaaaaattagtgtaaatataaaaaaaattttatttaaaaaattagtgtaaatataaaaaaagataagttatatgtaaagtacttttgataataaagcaattgacaaataaaataaataataattctaaatttttttaaataatacgaatgattaaatattaacaaacaaaaactcaaaaagacaagtaatatgggacggaggtagtagtaatactagatcagttcttgcgcaaagttaagcaggagattgttgccatgccatgatccgcagttaccctcaattttcctgtagccttggagtatttttttttcttcctgtagactgtaatgccttatatcttatctagaccttgctttaggagcacaaatgcccttcagtgtcatcgactcatcatagtatggcactatacattagatggatgtgatttattggttgggtgctcatcctgtgttatcttggtgtctgatcaactcagccaaccactagttagagcaaggaaaatagtagagctcactttctactattagcacatcttaaagccaatatatatataatagattagctataaggttggctataattttctcctcctctctctatctctcacctatacatttaatgtatttatctaggagcttgtgttaagctagagctaacatccttgattttttgttatctctctcctctatataagtttataatagatttatagctctatgttatacttgctcttatttgtgctggtctggattttgtcttggtggtggtggtggtccagggtaagatgttaggcatagtactaatctagttcatattttcacgagataagctgcagcaagttcgatattttactttactgaaacgtggttaactcattatcgggaagtacttttgcaaaacgagataagcttcagtagaagtgtagaaccagtgaaatgagaggcttgagagcagaccagttcactgtcaacgtgctttctgcatttaggcccatcagcaaaccatgctctttaggcccatttgtaatcagcaaggcgcttttgatttgaaggaaatgcaatactccaattctatagaatattttcctttatgatcggattgaaaattattgaaccctacaaaattcctgaggtttggaggatttttaagatgaggtcaaatcttatggaaagtttcctaatgtatatttctctcattcaatttttatgttttataattttttttttgttttgcacatatattcctgttaaaattttatattttttctcttcttccgttttctaactatgcgtttgaaagaaaccctaaggccccctttgattcaaaggaaattcataagaattttaaaagatttcattcctataggaatttttcctatatagccctttaaatcaaaggaatgaatcctatgtaatcccatgaaattcctatggaatgcctcttgccatgcaagttttggaggaaatttagcatgaggttctacctcatgttaagaattctttgagtctttatctctcctcaaattcctgtgtttttcttgcggctcaatcaaacggttattcctattattttcctgtgttttacaatcctctgttttacacttgtattcatgtcaaaatcctatgtttttcctattcctccgtttttttattcctgtgattcaaagggccctaatcaggagtttcttttcttccgattcacgttgcatgagctgagcgaacccagaggcaaagccttgataagatggtgccacgtgatcgttaggaaatatattcgttatcttattttgtactggtaccatgagctgttcttgtaatcttgttggtgaatcaagtccagagaacaatgatctgggtgcgattatttggaagaaaattcaaattaagcacgagcttctgacaaaataattacacacagctaactatgatcatgcatctccctgaatatctggaacggagtttatctctgtctaactgcagtacagtacttctcttttgagcatgatggcctttgcttacagtcacattactgtctgcaaggtcagtgaacacagtggacagggcacgcctgcgacaccatcacatgactgcataatcgcctgagctgccccgcatgtgtccgtcacagatctaccacgctggtgatttctctgcactgatccattgctcaatgagccgtgaaaagagaacaagttcagaaagagaaaaggcgcaaatgctcatgccagaagcggtgtcatgtgaaagatttgttgatcttctgaacaaactctttagctcgtacttccatgaatgtccagtgacttgccatctgcatcaccgactcgccgtatcaagatctctatcaagtagggtgcatgcctgaaatgaatcattgtggggaaggaaagactgcaccttgcattgccggagcagtaataaatctgtcgatttgatcctcgcgtgctgcagaaatgacaccgggcgtcgtggctgcacagcagaacagcacaggggaacgcgatcttttcctgaaatcggatccaatgccatggttgattggttgttctactgctaatcatgctttttccctggcaaaaaggaaggaactttttcgtgcatcatggagattcgagggaggcatgctgcatctgcagttccaattggagggagcatcatttgcgtactgtgtttgcgtctggtgtatgcgccttcttttgcttctctgtcctggtggcacctgtgatcttcttggaatcttggtggtggagaagaatcatatcattctgtaaccactcctttcagaggaaagtttcagttctttggtggtgacagtcaggcgaatcgggtcttagttaacagaaaagaagggtccctgctatctctgaagatcgtgcgtccatctgtttcagataccgagtgatgctgcaggatacttcttcgattagtgcatgcttgcacagagcacagtgccatgaggccattcacaatgcgtcatgggtttttcctggacctgagatgccacgttggatggaactgctgctaagcaactccatccagaatgcaaagcttgtactccacagtataagctactaatgggtcccaccaccaaacacttttgctctctctctttggttcagattttgcagcaaggaactcggtaccaactttggtcacacggaccaggcaaagccacgatccccactcttctccctcctccacgtaagccaggaacaacattgccacacgccacatcgccgcattgtaaatggcttgaccgaggctcccttggcaggccgatctagtaatccatggcatggaatcttttgaaccacagttttttgagatacattgtgtggttttaacctcacgatctcatgctcaatccctaacatgctcataatttctttaaaaaaaaatatttgaagagatgtctctccctccaaatctccttttttttatccttaaaccctaaacccaataaattattgtatacacatttcagggcataaaaaccagggttttaaatctcctgttatagctgtttgaaaagagttctagctatttgatctcatatacaatttgatcgctatagctccatttagcccactataactgtttgagaaattaatcgctaaatgtcttagcccgctatttaaaacattgataaaaacacagattttcagaaagcacagtacatatatagcacatgttcttaaagtgttttctaatattcagacaagttcaacgcatcgcgaagaagttaggtgccatcgtccagtacatggtccttaccaggatcagctatgaggagtgggtgctgctcatgacagtgaaggtgatctctgtctgatttctagaattcttattaggcacagcacaagggctctaataggccatggagccaaggaggtagattaccaggaggataagctcacgctacacatcgtaaggaccatgccacctgagatgctcagggcactgtccaccaaacagacggcgtagtcagcatgggaggtgatcaagaccataagtgttggcgtctaacacatacgcgaggcgaaagagcagctgctaatgcaagggattcggcgagatcgagttcaagaatggtgaggcaggtcagtgatttctccatccgcatcaccggtctagccaacaacatccgcgtcttcggtagcaacctccctaaagctgatgtactgaagaaatctctgcagtggccctgatcgaacatctatctcgctggatgagtcattgacatcggggagtatatctcagttgcgatcacgacctaggaaaaatgttcgaggagaacttgtaggggttcttcaccacatcagctttgggggatcgtcgtccaacatgcagatgctatcggcgaggacagttcatgcgtatggagaaatcgtcgatcgcctcgccgtctctcattatatgttgccctttcccctcgcatatatgttgagaggctaagatcaacatgtacggtcatgatagcctcacatgccatttgtatctcccatttggtgtacatacctgagcatctcaggtggcacgacccatgggatggcggccagcgcaggactatcctgctagtagttcacctcctcgtcatcgtcaggctcaacggtctgccgtagcccttattgcctacaagttcaccttcatgagcattgtccactcctcgtagttggcctgataaggaccgggtattgacgttggcacctgactccttcacgaccacgggaggaaaaaaagctcgggctcgtgagctcagctttggcttggctcgagttttgtttgtttggctcggctcgtaagccaaacgagccaagtccaagtctcttttttatctcgttgctgaaatgaatcgagtccaagctggctctcgagccgcttgttttggctcgcgagtctaggccatcatgtgtttatattgattattttattttttatagagttattatttgtcaacttaaaatttatcattaagatttgtaagaattgatatataaacttatttaatttttacatattgatgatttgtttttgctttttttaataataacaaaatatatatgaagaggtgtttcaacaggaaggattgcaagccagctcgagctggcttgaaccaggaaacgagccaagccgaactcaagttttagcttgtttttctaactgagccgagccaagccaaacctagtttgttgcgagccacttcaagctgagccgagcctagctcgtttccacccttattcacgacgcgccgccaggatgatctcttgtgtgcgtgcatcatggttgaggctacagagtgggggccaagggagagaggtatgacgacacatgggtggtgtgcaggaaagccggttggctggtgtagattgtgccgacacggcatcaaggtgcaatttggctcttagagcaagtttaatagtatagtccactactggctccaattcatctataccaattgttacaattgagaccagaaatcacaaacacacacgtgttggaagaatgcaagaacacgcaaagggctattggtgagttgcagtgttttctgttgcattataagaacttaagtgcccctttggattgtaggattgaaaaaacgtagaaatagaaaaaacataggattttaataggaatgcaagtgtaaaacagaggattgcaaaatgcagaaaaaaaaacataggaatgaccgtttgattgaactgcggggaaaacgcatgaattggatgagagagatagactcaaaggaaagttatcaagaggttgaaactcttgctaaattttctctaaaatctctatagaattatccattccataggaatttcaaaggattggatatgattcaatcctttatttcaaagggcatcataggaaattttcttataggattgaaattctccaaaatacctttttcctctaattcaaatgagccctaaatagactacatgctaactgtttctctaggcgttccaggccacgcaacctacaattctgatatgcttaccatgccctccaacttgaccgctccatcatatcgccgagggcatgtgatgcacacaatgttgcctaggactcgggactattttgacgtgctccatgaactcgcttgggtaagaggctatcgacacgacacaacgaccaaacctaatcttactttttgattgtttcaatgagaaaattattgaaagggaaaataagaattctagaaatcagacagcgatcgtgctcaacgggaaaaaaaacagagaataagtagtaggattgattcatcacccagtgtttatgagcatcttctattctgaacttttctgaacattgctgggcctaatcaacgcgggccgtgaatttaggtgatctcaccggcaatttagcacgcctatctttaaccttcaccttcatgcatggctttactttcactggttcacaactagatcacatgcaaatcgatctaacagaaaagctaatctttctgttgcctgaatccagatagccttatccatgatctatatatctgtcacttcagagagtgttcgtttcaccacaattctatcgctcccgcgaagcacggtgtgcctcgccgtgcgattgattcagtcattcaggccatgttctagagattttgtaggatctccattgctacatatgcctccaaggtcttgacatgcattgatgcatacctaaaggtcttgacaatgtatgtgcagctcatgattgacaaagcctgcatgcttgatgaagatgacgccatactgtctctgtaaaaaaaaacccaactttttttatacaaatttggatataacataggtctagttgatttttttttagactgagggaatatgtctcttacataacatatcttgaatgctgataattttaatcagcaaaatgttcttttcactaccctctgctagtatattttaagcttgtggttgtgctcacatatactgaactgattgaatctggccctgcaagctacaataactaaaatgtgcatgacaagatttgcgacccttgtatttaggcaattaactgccctttcgactcatcaatggtcaagtgacatactgacatatactagatatttgataaatgaaagcaaatacaataccctcattccattaaaaagtaataaaataaaataaaataaaatcaacaccataccctcacagcccactagtccacagagaacatctcgccagttgcatcattggtcattatcaacatcgtttctatttggttgaaaatttttacactagcttgcattacagcattggtgaatcatctttgatggcagtatcgatcatcatttacagattaacataaagcaacttgcagtaataagtaagatcacaacaaagttgactatttttcgacgcaacttccgtgatgtcatatatgggtgcttaattcaataggaatgtgcaatatatagaagttcataacttgtttagagaaacacacgttaatgctaggagctatatatgcaggactaaccagatctctgaatttttcacattcttttatacagttaaacattaagggtcccattaaaatggagggcttgcaaaagatctttggaggattcaactttcggattttaccctatattc

SEQ ID NO: 63585 - DNA, 640 bp, Oryza sativa
cgctccatgtttgtactccagctcggtacccatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagttattgtatccccaaagatgtttcaaattgatatataaacacattgatcccttaaccacttcatcattaatcaccaaaaaccactagggggataaatgcactttcaattctggaagagaaatatttgtgaacaaacaaaaagtaacaaagaataaagtatgaaactatagtgacagcattttggatgtaaatatataatccaat

SEQ ID NO: 63586 - DNA, 758 bp, Oryza sativa
cctgcagcccgggaggccaggccaagaacaaaaaaatagaaccttgtcttttgaaccatgaaaacaacatactttgcaagcaaggaaacaaaaattggtgtcgtctttgcattttacatctatttaagttggtctaggaaactgaaaagaaatgttcctcaactatgctaacatctgtcccttgcaggaaatttacgcctggtaagcataaaaagagaaatcacacaattttatgcctaaatgttctgagtcagaattatagaagcttctttctctcaaagaagttcttcagatgccacaactgcaaccccgccactgacaggcagatagctagtgagaagaaaccaagccaagccatccttgagtttgttctcctgttcagttcctgcatctcctcctccctagagaaatgaaacacggataataatgatttaagagatcatattgaatttcacaaagaaatgttttatcattgcaagccataccttgcgcgaagataaaacatttcttcatggatagagttgatagtatcctccagcttcttgagctcaacctccatcatctgccacatatcaaaagataaatgtgtgaacaaaagatatatttctgcaaatactacaatatggaggtgattttgcatgtccacattaacatattagtttacaatgtgtaatactgctgataatgagttgcatgataagacccattgtgatgctacagtcaccagttagagagagaagggaggggatatgattgaa

SEQ ID NO: 63587 - DNA, 501 bp, Oryza sativa
caatcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcgaagcttgccagattaccgatcgaggtggttggagtttgatttgtgaaaactgatctggcctatatttatgtgaaggatttgatccttctatgtggcatgaggtaaccctgggtcggcttgggaaaggctttgttgcgaacctccgataccgacaggtgttcggaataagttcgtatcttgtgggtaaagtgtacccctctgcagaggttaactaactgttcgaacagccatgcccacggtcatgggcggttgtgaggtggttcccgttgcgtagatttgtttgcttgtgctttgtgaaaagttgttgtgtgggaatcgtaaccagaatcagcctatgtggcagatggatga

SEQ ID NO: 63588 - DNA, 2314 bp, Oryza sativa
tgaggattcttttggaagatgctgatatgggattatgtgtataattgtttgctggcaaaggagacctagggtctcatttcagaggaactatgttccaacctcgagttaataaccaacctgttgatggaaaagaaaaccaattaaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgagcatgatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaataggaaagaacacatcaaggataaaggtgtaaaggaatacgttgaatgctaactgaggacaacctgaagataatagtgggaaataaactgaatgtaaagaaagtgaatccgagctgcttgttcgtgggagctattcccagttatgaaccaagtgatatgttcgaagatagtctactgaggtcagacaacgaagcttcagatttggcaggataacgatcaaacaataagaagtccagcagtaaagccgtttgggaagacgtcaaagcatgtcaagtgggataagttggttcggttgagaaacataattcaaaggcaaagttatcgaccctcgcatggaatagcagaagtagctagcacccggagagcaggaaagctaatatgatgcagttagtgacaagttgtcaaacatggtatgctggataagcgtgatatcatagtccaaagcattcagtggtaagttagaagtaaatgacaagcatgatattctcatgatgacaagcatggtatcctagtaatgacgagctgatctcgacgcatgacatgaagtgggtaatttgtatgaggttgactccgaagatatgaatcatgagaagttctggaacggaagcatcattaaactaccgcaacctagtctgagtcagctaaaaggtgcaccctggttcaagtcaggtgaatagaagattccatccgcaacaggaggtcaagccaagcagttccgagtcgtgaagttttgctgaaagtttgtgaagacggagcggaagaagtcaaacaagaagagaagaccacccaacctatcttcttgctagcctcctcgaatctcggggacgagattcttgtaaggggggtggatttgtcacgtcctgataaattcatcccgaattaaaaatcattttccaaaaggaataatagaattaattaaaattcgaaaagaaattggcaaacactaaaatacgtacaagaaaaattcaaatgtggcccggagaatttttgtaaaagtcttcttgggctaaaaagagccctcaaatttagtggaatttttagagcccaaataataattatttaataaacaccaagttaaaaagggtttattaaaagaaaagccctaaaaagtcctttttcccccctttccgctcttgggacgggtcggtccaaatctctccctaactctgctgtaacacaggggccatatgacttgttctcgaacaccggcccataaaggcgggccctaatagcgccctgttatgcgggtggggacaacctggtattctgacatcccggaattaacggcggcttatctggctctaccgatcacgccgtcggaaaatacaccactttcttcagtcccctcgcgataagatggcggtaaatatcccgcaacccg

SEQ ID NO: 63589 - DNA, 18201 bp, Oryza sativa
acagtaaaaaaaaatttagataggttttgtgttacgagtgcccctagatatggtgttctatgatttttttagataggttttgtgttaagtgtgagtgaacttgttaacttatcactcgactgtgccgagtgctcttctgagcaacaagcacaactaaatatacacatgtaattaaatgaaaaatactcaaacaagcaccatgtaacaaatgctgttgattttttttggtcatttcaatgatacaccaatgttacatgttcatgtgatagatcaatttggtcctaaaatgtaaaccgttggaatttgtcctgtgcagcagtcaaggctgcgtaagtagatccactgaattttcaccataaaatccatctttattcacttgcactgttgcacatgtaacatagacataggctagtacggcttgaggcagtcaaagagacggtgacccaccgtctcggcagcttccgccgccgtcgcgctcgccgtcggtgacccgactgtggtcgacggcccgccggtcagtgtcaggcactgcgccggcactctcgggctctcccggggctccggcgccggcggagacacgccggcgagcgcctgctccatctgcagctgcttcctcctctgctccctcctcacctcgttgcgcttgttcacgtagtcctcgtggatgaatacctccatcctctcccagaactctaccaaaactaactactacaaagtacaaactaacctcgaaaccgaaagaaacttcacattagatcgacagtacttgacacaaactcagatgaagaagtgagagttacactgaagaaaactgcatgtttatatgggtgtcaaagagaggaggaggtcgccatcatcggtcgctttaacctttaaccatttttacaaagcgcagcctgctattagtctatgccaacgctgcaaaaaaaaaaaaagcctgtattattatggcatggccgaattgcttcatgcttggtggagaaatggttaaaagagaggacttcacaatgccaattcctatggccattccttggtcttttgtgttatagaatgcttgctgtcctttgtctgttgctcctgtgatggtgtggttttaggtttaattaagacatcgttgtcatgagtgatgtgttaaaactcagggattcgtggtgtacatgggtaggtgaataggacaaacggtgtgttccaggttggaccaacctatagctctcccggtcactatccctgcaaaagaaaacaggtagctgcttgcttgcggcgacatggaattggtggatcaggattcaggaatcacaaaattgataccagagatctgtgaaatttgttatgtgtgatgtgaccaagattcatcatccaccacatgatatcttcttcagattgccacatggccttcttcagatttggtatgctacttgattggtagtacttgcaactttgcaagtcctccatttgttctgggagtggcctttccatggatcatctccacatatctataatatcttcagattaataacaagagaaaacaggcaatcccacaccatggctcatacttggattgctaacagtttttttttttttaaaaaaaacaaggaacaattataacaacatgagctaatgaaagcttcagactattccattctgctcttctgattgtaatgccacagaagagcatcagtgtttaagtcatgtgcaaaattatgacaaacaaatttgccgtccaccttttgatctaacaaaagggctggtcactcccaaaactccagatggatatatacacatcatttcgtttattaactatcacacgagattcctaaaacacattcatatgcgaacatccgcaaaactttttaccagttgataagcttgttgcatgaattctgcatcttcagagtgaagttgacgctgtcattgtcctttgagcatttccaaggatgataacaatgatggtaacatcatcgtggtactttctcctgctcccaacaggtatcctcatcaattcttcagctgttaaagctggcacaacataggaagaacaaaaggtgaagagttagttaagtccctgatatcaacataactccaaaaatggagcaatgatgctaattatgcaaaatataaaaatcatcaaaggtgtaatttctttcaaaagagattattaactgtccctgcatctacaagatactatagagcttaattaattaagtctaagggtgtaataatatggaatatgcatttcagcgcaaaagaatcttaatgctaactatttcatattttaatactaaaattataaaactgataatatatttcggatgatacctgcttccttcgctgctttaagtaaaagttgctcaatgagatactttgcaggatcaccaattggattatcatgcataaattgataaaccaactgaacaacttcgtcattgctgaagaaatcaaataagccatcactaccaagcacaacaaacaaatcatcctctgtgactttatgactaactgtgtgaggatttgtgtacacataaggcgggctgcacaaattacgaactcggagaattcccatgagtgcatcgttcaacttcttctgcaaattgacatgtaaagcatgtgtattagtaaaatcataagaacagagatgcattaatgctctttcttcccaaacaaaattatagtacgttacctgttttagatagccaactccaaaagcacgagtaaccttcagcttcccctttattttgttacccatcacaactgatggctcattaggatgatcagctaaaagtttttggtactccaatggattttcaagtgagtggatctcagtcaattgaacagccttcaatttatccattcctgaagacggcactgaagcaagcacagctctactatccccaagatttaagatgcacaaatctgttccatgtagaagcacaaccagaacacaagacccaactgatactaaatctggtctatcgtccatctcttgttcaaccatgcataaaaagtcattttcagcttgctcaacagcagtagtgaggcacttaagcacaccagctcgaaatgtttcagaaaatttcacatcttcattttctgcaaatctcatggccagtgttaactcacttttaacaccattaagagagccctctggtgaaccatatagaccattttcttgtttaatccggcactctaacaaatataggtaatatactatattatcatataaagttactgccaaaaagtcagctgcatctcgtccattaaatccatcatatattccacaaatcaaccatccattcttctcagagcacacagcttggactctatcctctccagcagctccaccagccatttttatctctgtacttgtcagaaaattggatgagacagtagttggggcactggacctccagatatttttactgatttcaaatatagagctctcagtcgatacagggctgccttgtgaggtggataacaagtccaatcttgacattgatggggatgaaacaatttttctgaaagaattaggagagtctagttctggtaaaatttcttccccgataagacccttgcaaatgtttgtattggccagcgtgaaattggcactaatcgcagcaccagacaaacaagtgaaggatccattttgtgatgtcatcatggtattagtttcaagcctcttgttgggagagatgtcatactcatcagtgtctagagaaaaacactgataagaattacaatggtatccaaagctgacgttgagattgctataactcctgacaagcatgtcttcttcctcagaactgatgctgtgatcattggagctcttatcaaacagttcctcatccaccatctttttcaacagaagtataacaccgattgtagtgtatattgctgtcaaactatgctttgaaggtttaaatgctacttaaagcccatgccaaatacaggtccttttatacttaaatggaaacgcaaaccagacctgcaattttaacacaaagcattatttatataagtacggtctgagcatggttgaactgtagagaataaagacggcaaagcgttgccaaacaaagaaatatttcatcaaaatttatagtttctttagagtaccctataatggatatgagccatccattacttttgatctaatggatcagattcaattatacaggggtaaagttagaattggtcgaatgacttcctccataatgtattctagctttctagtccaacgtgatagagttgtgtacaggaggtgtaattgataggtatgtgaacaagattgcttctcgaatctttgatgaataacatggtttccgtcaactgcccctgagcataatactattagtccttagtttgactatccttccatccaaaatataagcagggaaggaatcgatgagacgccccagtagtttgacatttgcaactggtaatattatcccctaaatttttacatgactgcaacaacaattttagattaattatacaagactgtaccttgttaaatatagacggcatcattttatacatatcagaattttattttcataagctaccaaacatggcaggcacagtttgcaaagttcttgaaaaatgaggacacaacccacataacataaatttcaatgagatctactcttaaaattttcttgtctcccaccaccaaatcaatcaagaacttcatcaggaaacagaaactaaggaaccacatacggcaacagaactcgagcggagggattagagacagattaggccggtagcaacaacctgaagtaagaaggggttgcttctgttcaaggagtgatcccgcatacgacagggccaggcaggtcgatgaacttcaccacagcggctatgaccagtgttcccacagaaactaatcttcttggcgttcacctacacacaacaccccccgaacaacacagataagagaagaaagaagaaacagatagaagagaatcaacaagaaggaacatgcgcacagcgcagacgatacgattactcacagatgcatccatcaagttcagagcgatgggaatcgggccagttgacgcagcccctcctttccccccatccctgaaaaccccaaccccaaccagcgaaggaaaaaaaaacaagactaaatttttacccaaaaagctcccttctttctttagccgcccgccgacctgcgcagcgcacaacacggatcaacaagaagcagcacgcgaaatagggaagatcactagaacaggtcgcgcaccccctgcaacagaacgcaaaaaccagacgaaacctgagcgcgattcgcttacctaaaaaaaaacccggttcgttttttttctcttctcggttgcaaactgcagatatcagctcgcgggccaaagaacaaggaagagcagaagctgagaggcggaggaggaggaggaagtggcgggtagatgcagacgggacgggtgtggagtggagaatgggagaaattgagaggaaggtgtgggcttgcggggaatatatcgaggaggtggtggctcagctcagctggtctggtggaaaagagagagagagaagcaacagattcattctccctttccctcctcttttttctattttcgcggaccggataggcttagaatctaaccgcgtcgctcgctctccacatcggagtggtagttaaccatcgcagcgacacaggaggattggggcgcggcggcggcggatgaggagagatcgcgttctcctttttacttatttttttcactttaaccttggggtgaaaatttacgtgggtactcagttgataggtgggttcgctatattttaacttttaagggtatatatgtactttttttttgttattataggatccataatacaaactccaattgatatcataatataaattaaatatcataagagccgacacgtagattatcagttctgaaatataaaatatactaagaaagtaagaagtggtttttattgtaggtaggtttttgtgtagtattatcctatatggcaggttgagattactagtacgagtgtctctattgtacgtgccctaaagtagcttcctttttcagttttttccagtcataaaaaacacaccacgagttatgataaggaagatacatgactcattgatcaaaaatttgcttgagaagatcaggtcagatgacgagaagttgcaattgtgacacctaagtacctaactagaggtggaggaacgttatgtgttcaagcctcgatgggtgcatgacactaggaatagaacaaacataagctagattgatctatgatagattttctattggttcttatgtgcttttgccccctctggttaaataatactccatccgtactcgtaaaggaagtcgtttaggacagcgacacggtctccaaaacataaatttgacttcttttttctataaaaatatttattgaaaagtgatatatgtatacttttatgaaagtatttttcaagacaaatctattcgtataatttttatattttcaaactcacaactcgagagttattcatgatttatattcccaaggtttgacttaaacattatcctaaacgacttcctttatgagtacggagggagtagtacctaagcaagtgagttaggattcaaaactcaatttgtttggcatatgtgactagtcaccaggattcaccaaacaattttaggtggggttatcgctaccccaccgtaagacggttatcacggtaaccgtgcggttaccgtgagggttaacatggtttcaaaaacttgccccttgcctcttgctacacgtttttgcaaaccctgttagccacttgccccttccagtcgatgggggttgatggtgtcaccacgatcaataaccttaagattaacaaaaatgtattgttcatgttgagcttaaaccatctctaataaatttgtacctaaaaagtggtcgaaaacctaactttttgtagatttatgctaaaggtcaaacgcattaacactgtggatatgcgggggcctctatattgagctgatgtggtactatatgaatctagagcatttagaatagtccacttagtccactatggattattgaccaagcaattattcttattcatgtatgaggagatcgatataatacattcacatctctatctatttagtagaaatatagataaatatatttattattatttcttcatgtttaggatttaacacggtttccgaaatacattgaaatgtttagcgataaatattataataccatttttcacgtaggaaatatcaatatatattttggcatgtattaatatttaatagtactttaaggcctgctcggcccttctaaaaagttgcatccaattttaaattttgctacaatttagggtttatttattctagctttattttcacgattgctaagaaaaagacctataaaacaagactagctattcacgaaaattacatttaaaaaatgttctttttatgaaaaaagcagcaccaagcggtgcctactttcatagtatttgaggggagtagctcgcataaactgataaacatctctgtttcttaagttataccgcatggagtccatgttactgtcatcatgtagctattccacctgttccaatcggcagcaaccaactattgaaatgggactgtcctttctttgtttcgccccatgtaattaactacgagtctgtggccacagccgatcagccaatggcaccagtccgtgtcacaaaccttcgctttcttaaagggaaattataggataagcatcaatgcatggccgctgcagaatttagtatattggtgagatgtggcgagcagcagatgcgatgaactaaccggagtgagctcgaatcacgagaggcatcgaaaacgatccccacgaatatcagacggccatggcgatcgacagccacatatgctgatgttaggtagttctacagtactctcctatgatagttggccattcattattatatttgttttgggttgtttgtatggatcagaatagatgatcgctgacgaaaatgcagattgtttttggtactagtagcgtgctgacctcgtggtctctcatgccgtacgaactggagtagtactgtagaggattagcctgcagacttgcgggtgtcatctgtgatctatctactcaaacagcatgtgagccgtctgatataaaaaaaaaggagggaactgtgatgttagcacgagttcatatacatatagttctcccatgtactccctccgttccataatatagcaaaaaattgggtaggtgcaacaaatcctagtataataaatatgaacagaccatctgtacatattcattgtactaggatatatcacatccacccaaaatcctttatattatgggacggagagagtatatggtccctcggctatagcataagttcagtttttctagtttcaaatgtgaattgttgagactggaataaaatcacatcaacacattaatttttcaaaactggataaagtcaaaccttttgatggtgattcgtggtggttcgagttttttttttcatttcatcttgcttgttgaatcatcttgtaagatcgctgcaaagtaatttttgtaagcattactagctactccctccgtttcaaaatataaaggattttggacggatagaacactttttattactatgaatctggacatggagcacatctaaattcgtagtattataaagtatcatatccatccaaagtctcttatattttttgatggagggagtatgtgacaacactttcaccaaagtactccgaatctgtgataattgaaggggtgtattttgtcaactttttctcagcaaacagaaaacatttgaaatcactgtcctgtacagttatgacaaagctagagcatggtttgtttgtttgtttgtaatttctgcacaacagtcatgtccagaactagaacatggcataatataatgcaaataacgaaaattaggaataaataagtgatgaacgaaatgcataatagttacatccgattatcattcaataacatgatcaagaatatagaattatactactattaaatagtagtagaattcttatttgaccttattaattaagggcatacaattaaagtgctccagttcattttttatatatactaaattgatgatccattaaaagaattgaaaatgatgaatcatatatgtgtgagagggatagttttgtttggcaaagaaaactagcaaggtggtcgtgcagatcgtgtggctaacattttctcatataatggtaagtatgtttttttcacacgtaattgcgaaagaaaaaaaatattgcaagtggtaatatagttttgtgttctgccacaacttgagaaaacttttacatctgttactctgattagcagggtaattcctaatttcctatgcacacaaagtaaacatgatgactctgtttagtattttcttaacattataaaaacatgatggtatatttgcttctctcctttcctccatcttcctctcccattttatttctcaataaaagtaaatcatgtctcgagaaagaaaaatggaagaaaaaaagaaaaaaatgtctaaaattctaaaatgacttatatttagaaaagggtgaatagctaatttagtccctcaagttttaccgaagactcaatttgattcttcaggtttcattttgtccacataggtaatctaagtatttgttttggatcaaaatcatccttgggtccacttaatatgccatatggctatttctagtcaacaattctgttagaaaatatcccttttgcctttaatttgcatgcaacactagaaaaaagaaaaccaaaatgaataaacaacattgcatatatacttccaattatttcaacatgtgcacatgaaacttaagcctaatggctatcatatacacttgcaagtacataatttatttttgtttgacataaattgctatgaattatctataaaaagaattcattgcatgcaattttttctcttatatatgtgaatgagggggtataactgtcatttattttggttacgtgggttcaaggataaatttgaattaaaacaaaaacttgaagtactaatatggatagattgaaacattaagaactaaaccgattcttacatgaaatttagatgaccactttagctattcaccctttagaaaatatctctgaaggctaaatgttttcaaaatggagggagtattgttgagtgtttataggcagtgcatataatgttttatcattaggtgacgtggatagaattaagtactttaagacagctggagatagtcgtatttgtacttgtacatgtcctgagcaattcgtcgtgacacatgcatatacaaattaaatcgtgatcgtcaggttgacctagctgatcattacctacattgtgcatgcaactgtcacaaattattgatcaacaccaagtcataatttgaaagcgatccagggtgtggggcctgtggggggcttgaaggccattatgaattcaatcggccaataattcttggcgtcattagcaaaacaatttagcatttttcaatccttttttattacaagacttacaaatatactagatctgcataatgtctttttcatcgcgcctacgtcattgcaagaaattcaccgggcccaaactttgtagttgtattaaagtttgtttcaaattatactgtcagcttcagcatagctcatacatgtatttagaaaataaaggaaggatgggtggaattggcaacactaccaactcaaggattctatatcaaaagtttaaaaacacaaggattcctagttaatgctgaaggtttgtttggttataggggactgggataagatgtggcttataatatttagagtaaattacactttggtccaccttttattacctaagttttattttgaagtaccacccataaatctatcttttcaatttggaccaggtaaatttaccattgttgtggtttggactaccataaataacttttctcgtcatatctaacttccctttcggcaaacatatgaaccatacatagaggagttcgcccgtacactagcgttgatgtgtttaatgtcgttgattgtaccaaaaaaaatcgttcatggtggtccaaatcgcaacaatggcaaatttatccggttcaaagtgaaaagatatgtttaagggtggtccaaagtgaaacttaggtaataaaatatagctcaaagcataatacactctaatatttaattaaaccttggcataattacacattgcatatcgattagtatcagctagtaaggtgaaaagaaacatctcagtgttctccattaagggctaaaaattaccgagttaattaattggatcaaaagagagagatccgagtgtttaatagagtgtgctgaaattatatggtatagcctaatcgattggaaatgtatcagagttgtacggtaactataatacaacttgcttaattcagttataaatatttggcgcccacgacaaatttgtcaaacttgaaaattttgaccattaattttctgttaaatgagtttataaaatgtaaggtttatgatagcattcatcaaagctaatctatgcatatctcttttttttttcaaaaaagaactaatcatttcagaaatctatagtaaaatttgaagagtttaacaaagatctggttccagtcatcgaatattttaaccggagggagtacttccaaataggcacgcaagtgtggatgttaaaacaaatgagctgaacacagcatgcctatcctcaatgcaaaaccatgtcctgaacagcacccaagaaattttactgctactagattgagaattaatcttgctccccctcaaacaaccgcgcgtgatatatccacaaaacgcacaagagaatcaatatatctcgtcagatacaaaattacccgatatcacgatcacgatgatgtaaagatcactcctatcctaacaaaaagttataaatagcctatcgggaaaatatcttgtgaaaatgattgaagtgttaaaaactctagttttgtgtacatataaaatatattctcaccaaatctcaagtacgcacccaactttatttgagagaagcaaaaatgaaagatttcagatgaacagtgttaggttactattcacccaaaatttatagttgagtttgaacttgagattctattagaatatatttcttatctactcctatctctattaaactttttttatgaatttagagcaaaattattattcctgaatgaacaagttacacgagccgatgtatctacagacagaaacggcactgatctatagtgcagaattatatttgcattgcccgcggccgatacatcggcatcgacctcaccaatgcatcacggcacaaggacagtgcattgcacctgcccggccagttgctagtgcgcgcttgcagaaaaccctttaattttcatcctagattgcagtcgcgtttccttttctgatcgaagaggaatatatatatatatatatcgaataatttggctgcagccatattgacattgacagggacactagcctagctagatataggtttaacgaccgatatatacatatcgccgtcgctttcgcggcctagttagttaataattaattaatctctcgtatacagtatatgcgtacgtaggatgaaccttctcaattcgtgcgtatgcgttggatctgcatcgatcgatcggtgatgcattattgggtgacatatttaatggcatattaattttatatatgtgtacgtttgtatatagatataaaacaaaaatgaacacgaaagagagagggggggagaactggagaaccttgtgcggctgcgccgcggctacccgacttgccaaaggtcaacgaattctattttgcgtcgctcgcgaggaagaagacaaccgcggcggcgacgacgtcacagagagagagagagagagagagagagagagagagagagagagagagagagacggcaatcggagctgcagatttgattaattaaccagccggcgaattgaaatgagaagaatcaaaaattggggcggcacaaacaaaagatatgggacttgtggcccgtagaatccgtgtgaaatttgcaaggatctaagggcccctttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggctattcctgtatttttcctatgttttgcaatcctctgttttacaattgtattcatgttagaatcctgtgtttttcctattcctctgttttttcattcctacgattcaaaggggccctaaacggaggaatggtggtggggagctagggatcttgtggatctggacaacatgtgttgcacagcagtacacgttgtctgtacgaacttcacaggaatttcagtattgccgttcttttctttttatttatttttggaagctactctgatcatggtgctggtagggtgtttcttttctttcttttttggaggatggttgtgtttttttttccatgttgaacctaccgtcataatgtgtactgttacatggtactcactccgttctaaattaagtttgaacttatttttgggatagatgtagtatgtgagcttatcatttgaaatgtgtaatagaaaaaaaaacacacacacacaaattaaaggtactcctgtcgacgtttgatgtctcgactacggtatttggacagtatggggatcgttggtgctaggatatacgcgagactgaggtaaaagagatggagacgaagatttttatacaggttcgggcccctgagctgtcaggtaatagccctacatcctgttggccgaagccggtattgctcttattcatgataatcacaccagtacaatatgtggggtagcctatctaactgttgtcgacatggcggtctgacgatctgactcgtagtcgacaacagagtagccttcctcctcgaatccgtgcccggcgagatcagagatagcgctttcgtctctcctaacagtatccggagacaccgtagggtactagccgtgcttatccctgaagtcgacatccggcggcgtgtcttggcgtatgtaggcttctatgtcgattgtgttaggtgttgatcctccatggtgggtcttgtatttatacccataggtgtccccttatccaagtagaactagggaaaccaatatggatacaatccgagtagtccttgtcgtttccatgtagaactctggttgtctttccttatccggaactccctcgaggtcagtttccgtataagacatggtatgtggtggatcctaccgagatttagtcaactactattaggtatgtggtatccataaccctgacagtagcccccgacttcgatgcaaatgaacgaattcatattctcaaccgcagacttcggaggaactgttatcgagctcatgtgaccgttctcggtgagtttagagataacgttagacttcctttattagcctcgtgcgggcaccgaaagggtttgtctaagtcaatctctgatgtcgaccgagaaagtacagaacgtacgactaagtctcccgtcttgttgtaatcgagaatttggattgaagtcaagaaattttatctcggcgggtacaccatttcttcattccatattccttgtcgagatccagcaaccattcttgagcgatcgagaaggcgtagagtctgcgacggagccttgtcaacattggttgtactcgccttagtcgatcttggtgtagaaccatagagacatgtagtcttccacaatgtcgaatagaattttcctgaaatcaatactcagaaaagaatatcaaatataaagagcccccgagcgaatgctcaaagggtaacatgttataatatgtatggtaaattaaaaatgaattaaatttaccgaccaatgttttgtgtatgagcgtcttctctcttaccgacttcgatcagtcagtttgtagagtcatacactctccctagcccccagccttgtcgtcggagaatcgttctcggatgataaggctgttggacccttgacctgccttggttgaacaagcactgatcctagcccccagccatgaagttggaaagttaatttccgattacacggcttggttaatacgcacggcgagaactcttacatgaccagatcttacatggtctttcgtctctacaggatccgacaaggccttattggctctgggcgtccccagccgaagatcccttaggttcctcggaggccttgtcaagacggcgtaaagggacagtaggatatgtttcaacgctaggtgtcgttgtggtaagggatctctgggtaaaacacttgccgatattgtgtacctgctatcaactttgttgaagtagaggtagtaggagaaatcgctacaccgctggtcgaggaccaggcagtagtcgtaactcgaccacttgaagtggaaatagtgggagaaacgctacatcgctggtcgaggaccaggcagtagttgtaactcgaccacttgaagtggaagtagtgggagagacgctacatcgctggtcgaggactaggcagtagtcgtaactcgatcacttaaagtggaagtagtgggagagacgctacatcgctggtcgaggaccagacagtagtcgtaactcgaccacttaaagtggaagtagtgggacatcgctagtcgaggaccaggcagtagtcgtaactcgaccacttaaagtgaggcgagaaagatcactacgttttactggttcgagaaccaggagtaggagtctcttaatcacctataggggcgctaaagttggtttattacatgtgcatatcatgtggccagcatgactcatatacccaacttatagcatatccggatgtccgctcgcaatcatatcgggtgatcaagccgacggcgtttgcgaggaattatccgttaacaaccttttctcgagttgtccagtgatggccggtgctatgagataggtcgtcggtcttccttagtaggttgggtgcgataactccgcatttgtcgagaatgttctcgataatggagtgtactcgaccacaacctactcgagtgctcagttgttcctgaaaattattttctagaaggcaagacatatagcagaggatatcgagtatgtactcaaaaactgcatggatcttctagtatcatcaggatataacgagcaaatgtaaatgtcagggattatgtaaaccgtaagcaagcatgatttatacggaagaaaatagagcgagcccccagcattaaattgtagtcgatttaacatcggggacactcgcgcaacagatattgtataaaaaacatgctctaggtaaacgtaataaattatagatctgacaatattgtatagactggaaaaataggtacggtaaattgcatataaattattgcatacctgtgtagatatatgccggatatatctacggaattagtagatcaatttaaaaaatcaatccactaattacctgtgttaatgttgtgacgacctcgtgtggtcaaagcatatgcaacagcactgtacgtaccaatatatatgcacacgcgtacatgcatgtccgggtagacatgtatgtgtattgtatgcataggtgttaggctctgtacagggacatctgatacgcctcctgacgtcaggacgtcgaccggttggtgacgtggcaacgcacgagtgggcaggaaatttggccatagcttcctgttatctcgtctgtcgtcatggtcggttgcgatctgctgcttctacccaggataaccgagtctgatatgagtcaacaaagaccctgatatcggactcgatgccgtcgtcggcgaatatccactcgaggtagtcgatctggccgaggcttcatgatggataacatcaaaatgccgttctccgcgtcggtgacgtcttcaaagcttggtcgatctcgagagatcgaattattgatgacgatggttccgatctcgtcggaagatgtacttggataggttggatctccccacagccgaagtcgtcgagtagcttgttgtcggagagtccatctcttaaacccaactcgtcgaaatcctgaagcaccaaaatccccctacctggcgcgccactgtcgacgtttgatgtctcgactacagtatttggacagtatggggatcattggtgctaggatatacgcgagactgaggtaaaagagatggagacgaggatttttatacaggttcgggccgctgagctgtcaggtaatagccctacatcctattggccgaagccggtattgctcttattcatgataatcacaccagtacaatatgtggggtagcctatataactgttgtcgacatggcggtctgacgatctgactcgtagtcgacaacagggtagccttcctcctcgaatccgtgcccggcgagatcagagatagcgctttcgtctctcctaacagtatccggagacaccgtagggtactagcgtgcttatccctgaagtcgacatccggcggcgtgtcttggcgtatgtaggcttctatgtcgattgtgttaggtgttgatcctccatggtgggtcttgtatttatacccataggtgtccccttgtccaagtagaactagggaaaccaatatggatacaatccgagtagtccttgtcgttttcatgtagaactctggttatctttccttatccggaactccctcgaggtcagtttccgtataagacatggtatgtggtggatcctgccgagatttagtcaactactattaggtatatgtggtatccataaccctgacaactccctccattcaaaatataccgatcaaaatcacttatattttaagacggagggagtactataatagaccacctaatactacgaattaaaaaatgagagttttgctatgttttgagacggggtagtatggtttttcaatactacatgaattgaaaacaaaaaaaatctgaaagagatgttccttatttacacctcaaggaaaaatgaaccatatatcttatgaaattgatgataagaatgcaatcatgtgaaaattttctaccat

SEQ ID NO: 63590 - DNA, 5681 bp, Oryza sativa
taggcatataattttacatattttacaaaagtttttgaataagacgaacggtcaaacatgtgctaaaaagtcaacagtatcaaacatttcgaaacggagggagtattgtgatggggccagtgagaggattccaaatgcttcatatttgtcatatatagaaaagtcagaaaaaacagaaaaatatatatttggaatattcctactaaggaaacgatgataaaatccatgtttttgaatttttgaaatattataacatgctaattcaatatcatgctggtgcggaacatgtcatctatgtcgtacttaaaccgtcatttgtgatagtgaagggtctagtcattgatgaatgatcaataatgtgaaaaacttatctgtatcagatcagctgtcgtaaccaataatatcatacacctttaacgagttgcaataacaacctcaccttaaggtgcgtgcgaaaaactcagcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagggtgcgtttggcagcttgtgttcacaactacacctcctctgttttccacgcacatgcttcacaaactgctaaacggtgtgttttttcaaaaaaaattctatacaaaagttgctttaaaaaatcatattaatctatttttcagaaaaaatagctaatacttaattaatcacgtgctaatgaaccatctcgttttacgtgtttggagggagagttcccaactcccctaccgaacacaacctaagtgtattcatcaacgtctttttatgttggaagtgcatatttttaagaaatagagctttaaatgaaaaaaaaatacaaacctttgcgccattggtaagagggagcttacaaatggctgcctgggtgcaaactacggtagaatccaaagccacagcatgcttgctctccagctgcccccagctttccaaacctctcatctgcacatattcaccatggcatggatgcatcataatgtcagagaagtaatcactaaaggatcaattttgacggacaaatatcgaactgaacaaaaacatgtactcctatgtatcaacctgagaagaaagtacggaattcaacttgattttgagcttctctttctcgagttgtacacgcctccttgccactttaccttgcagctctgatatcctagcccatgcacccatgaattccacctatatacacataggttaggagtaaaataaaacataacgacataatataccatttgatgaattgatgtttaatttccaaaggcggcctaaagcacatacatacgtacatttaagcatatgcaggtataccatgtatctcaatttgggaaaaaaaattaaccactgcaaattttgttaacacattaagaaaaaacactattaggctcgttttcatttcgtcgaatacttgagaatttcactgttcactgagctgcaggtgttcgacgctgagagtttgggctgaaatccaacaaactaggtatgtcaccaaactgaacaaattttagttattatataggctcacaaattataagtgtgggtacttataatattgatgtgaacggtgcattcttgatatatatatacctcgaaaatagacagcttgttcttgctgacggcttctgccttggcatttgcgaagcgccactgcaacagccggcagtgcatcatcttcatctgatggccgatctccctattaccacctccaccgctccgccgcgacgccggcgaggacagtgttgccgttgcttgcgctccggtggccgtttccgccgccgccgccttcctccggctaaagagatggccccatccaaggcctattaggctcttcgtcttgcccttgagctccggcaccgtcgccagcgtcgtcttcagcggcgagccgctccgtcgccccggcgacagcgcccactgcgtgttgctggacccgagcaggcgggtggagttggttcgcgctatcaacggcgagggcggcggcttgggcagcttcgtcgtcgtcctcggtgtggagccgccgccgcccctggaggcgtcgctgcactccgacccggagctggcgacgtcggcgccggcgtcgagcctgcggaggtcggacggcgcgacgcggcccggggtgagtgtgacgccggctggcctcgtggacgggaggagccgcatggagcggccgatcgcgctcgcgtggccgcccgacctggcgacgacgaccttcctcgcctcggcgtccgcgtcggcgaagcgcgggagctcggtgcagctccgctgccgcgagagcgcagcaggcggcgcgtccagagagtcttcggcgaggtggtcggcgagcgtggtggccacagacgaggaggaggagggggttgacgcggctggcgcaggggacgagggcgacggcgacgccttcctagtgctcgtgttgccactgttagaggaggaggaggaaggccatatcgtgcgggcgatggatggcgccggatcggggcgcgacacggcgggggagcggcgggcgctcgggcggacgggggagagcgcggcggcggggagaggcgaccggccggcggacgacaggtccgtaacggaggccgacgcccaccgcctcgacgacgacgacgacgacatgcctgcgttgcttgatctctagctagcttgttcgtagcttattaacaaacacgcacgacgtctctgtaacggaggcatgcgtgcgcgcacaaatacgtacttgttggtgtgtgtgcgtgcgttgcgccggcggcggccggcggtggcagctgcacgcacgtagcgatcgagagcgaagccagccggcagggcaaaggtttttgggcgtgcaggacagcgtccgatgcgcgcgagacaaatggaagagcaaggggactacctatacaataaaaatgatctcgtgataagttgttgatgcgagtttatttgttgcatggtcagttactggtttttaaagtataaattaatgtggcttaatcgtggattctaatccctcgaggggatatctcccctcgtatacctgtttcttccaaattcgatgtaaatagttgtgaaaaattctaaaaaaaattgataatgtagagtataatgatacctacttgtccaccaaaattcatattcaaattcgatctacacatcgagaaacaaaaaagacaaatttagatataaacagtacgctactatttatacgctgaatttgtcttttttatatctcgacgtgtgagttgagtttggagttaagattttgtggagttgtatatatgtgttgtatgaatgttgtcaaatttttccagaatttttcataaccgtttagatgttttttgagcaaacgagggaacatcccctcgagggattagaatagtttccgcttaatcctagcccctgaaatatatatggaatggcacatatttggccaacttcacccggtagagttatacccaactctaggggatctggatcccatccacacccgctctacatccgcttaaaaaaatgatgttggatatggtatgaccaatgtccgtccgaatccgctccattttcacccctacgtagccacttttctcatcggtttcagagctagtggattagacaaaaatactatccatcttaccccttttatgtttatttccatggtggttattgttagtagaatcaatcacgatcttatatcatttctccttcaatgagtcatttataattatttctactggtggtagagtactttttaattaaactaatagtttagataatttttgcaggtaatcatgcatcggtagatcgatagcactgcaaaagtactatatatatacttgatgcctaactcgcagtgagctggctgatgtttatcgggtaaaccaacggcggggatccatcaaacgcaaccttggtgagtctcttggccgtgatctccgtcggatggacgatgtcccagaacatgtagcttgttcggttggcgcagtacgagcttgccggagtgcactggaacatggcgttgttgtcccctaggccgcagcatgctgctttcacctcagtataacctaaaaaaaataaaagaaaaaacaccaaaatggcattggattaattcataggagatgtatttttaatatgaaatataaaatattaattatagagtaaattacaccaaattacatatttaaaaccttgtatcacaataaaatggaccgtagatttagtgacaaatttatcagaaaattacaaattatagaccaaatatcacaaactacatctttactattaaagttactacaaaactacggattccaatctttaaatccttaccactaccgttatatatgttggagttataagttgtagttttgttattgaattggtacatgtagttctatggtaaatctactatttaatctttatttttatgacacttcatcataaatttatagttattttataagaaattttgtatgaaatctttaattttgtgatgcaacaataccttaaattttatagctttattattatttgattaaagcatcggaagctttgtgaaaatattcattcttaattatattttcatgtgagcactcatacgtactaaatatgttcagatattccggtatatacactgattgctctttagtctatgtactgcgttctatgattaaatgggcacatatagttccatgaaaaatctgctatttaatatttattttttgacacttcatcttaaatttataattttatgagaaatttcgcattaaatctatatttttttatataacaatatcttagatttatagttttatgataatttgattaaagtatccatagttctatgaaattcactcttaattagtatagactgattgctctatcctttctccgtcacataaaaatcaaatctaagatcggacgtgacacatcctaatactatgaatctggacagatatatctctactatattcgtagtattagaatgtgtcatatgtagtacttcctccgtattttagtgtatgacgctgttgactttttgaccaacgtttgattatccgttttatttacaaaaattatgtaattatcattcattttattttgactttgtttatcatcaaatattccttaagcatgaaataaatatttttatatttgcacaaaaattttgaataagatgaatagtcaaacattagtaaaaaaagtcaacggtattatatactccctccgtattttaatgtatgacgccgttgactttttgactaacgtttgaccactagtcttattcaaaatttttgtgcaaatgtaaaaatacttatatca

SEQ ID NO: 63591 - DNA, 581 bp, Oryza sativa
aaacataaggtccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactaaccgaatgtgcgctctttctcttttggcaaccatgattggacaatcaataaatgagaattctataaaagctcctaatcaacaccactcccgaatacggtatgctcgatcctaacagaagacacgagagtagccactgct

SEQ ID NO: 63592 - DNA, 556 bp, Oryza sativa
agcgttcattggattaccagctggtacaggtggttcatcaggccgcctctacctaccctctatgggggggaaccccactccacttttttgggcttcaaactgtgtcttctcccggaagctaagcaatagccgtttcttgagcagaattcggcgtcgtcccccgtctgacacgggggacagccctgtcattccctcataaatgaacggtgacatgcaacagcccttcctcaagtgacgcccggatgtgacgggtcatacccacccccactccgccggggacaagggcgacgtgaggacacgactgccctatccatcggatgtgacggagacgggccgatcacagaccggtcacatccgatggacaggggttagctaggcgcgccgcacgtctgccctgaccgcattaaatgcggtgagggacagttggggcgttgcacatttatggctgttcagcctgcactccccttttgctctctccctctgccgcgtggcggccgggtgagggcctcggggcgaagccgtgagagagcccgagggggtgacgtcatgccctgag

SEQ ID NO: 63593 - DNA, 788 bp, Oryza sativa
  unsure (1)..(788): unsure at all n locations
tggggacttgaaacccnttgagtaaccnnctgaaancccntttnannnncgntnnnnntnnnnnnnnannnnccaccannannnncagtaggcgacttcagaacggccttttatgtttgtttttatctttcacgactaacacaactgccctcatctaatcaacaatcttgacaggtgaccacagcataccttgatatgtgcaataatttggactcatggagcttgaagatgggctctgaaaattgcagaaactaagttagagaaattaatcaagtcagaaccaccagtgattcacccctgctctgaaaaaaagaagagccgacaaggcagcgaaaagaacaaatcttacaagtaaacgtcgaaatgcctcatcgatttcatccacggtgagccctttcttctcaaggaaagaacgcctctggacatcaaaagaggccactacctttgggtgtttcagaaaaacgaacgggctctgaaccagctccttccttaccggttcaacggccgcaacaaccttcgaacgtcactaatactttgaacaccaattctagatgtcatccagttctgataatgcacgcccaaaccatccaggtaatatcaaatgtgataacacaagacttttcaaagtagtttcagctgaccattagtcacaaacaaagtgaaattaaacaagcaagagaatctttccaacggtcaaactaccactaatttaagctactgcgttctaattttttagacgttaaacgacaccacataccttttccgttaacttggtccatgccagaagc

SEQ ID NO: 63594 - DNA, 615 bp, Oryza sativa
tcttcggtgtcaccgccgccgctcgctgaatgtggaacaacgcctgatgccctgaccctagctacctttcacacgatgccaagtggatacgcgaatgcgaggtgaagcggggaacttgcacgatgcaaagcgcacaacacatcacacaggcatctatgatgggctggctcatgcgttcatactcatcaacttttgccccaaactaatacatgctatatactataagtttttcgtttttttgggtgtgccggtgcatacccggcacaccccctgggtccggccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataacccatgtccaaatcagttcttaagcaaaacatgtttaaaatgaagtcagggaatatttcaacaaatttattctaacataagcatttacaattaaaattaaagcaaaatttaacaaggtgtcccggcatttctagttcgtattaataattgaaaccactcaatgctagaaaaataatgcag

SEQ ID NO: 63595 - DNA, 4183 bp, Oryza sativa
ggcacggcaagctcggcgccctgaccccgctcgacgtcaagggcgccatcctgatccagcccttctttggcggcgagacccgcaccgcctccgagaagacgatgccccagccaccaggctcggcgctgacgctctcgacctcggacacctactggcgcatgtcgctccccgccggcgccacacgcgaccacccgtggtgcaaccccgtcaccgggcgtggcgcgccgcggctcgactccctgccgctcccggacttcctcgtgtgcatctccgagcaggacatcctccgcgaccgcaacctggagctctgcagcgcgctgcgcagggccgaccatagcgtggagcaggccacgtacggcggcgtcgggcacgcgttccaggtgctcaacaactaccacctctcgcagccgcggacgcaggagatgctcgcccacatcaaggctttcgtcagagccagatagccccagccagtggctaagcttagctgacactcgccgtgtcacgctaattaatccatcctaatccatccaaccatccaaccagtttctgctgcagcagatgatgagtaggtgtcgtgtaagctgtaaattaattacttttgtagtacgtgtcactcaagacaagcgttgtccatcccaatacccaacttggatcgtcgtagcggtgtcggaaagcaaaagcgtagcacataaaaacgacactgccgctatgccacgatgttgttgctccgtgtatcattcatgttcatcaatatacttaaaaagcaagttgtggatactgttttcaaatcgggttgccgtcctcgacgacactgatggtgttgcatcaaggaaaccggaaaagtttccaagagcaaataattgtctgattgtctgctgctttctgggctttgcatcaggcatcatcaagtgaatagaagaactgatagtcgtagtagtatcctctatctcagaatatagcaacctaaaatcagatggaacgtattctaatactataaatctcgttttgtccgattctaaatttctataatctggaacggaggtaataatattttttcctctcttttccccgctttgggaaggttcaggctagatggagcccagcgaatttggcccggcaattccttctctaacaagcacgaatcatcatcgccatcatcgtccatcggctacgattagcgtcaggtcattagggcagaccggcagaatggaatctttggtctcttcccaatgcaatgctgctgctagctcccatggccatgattgagagatgccttgtgcactgaagccaccacatgattcgctcaatgctgcagcaaagtcgcaaaaagctctagtgctgctgctacaagtgcatcagacaaactgttcgatcgttggatgcatcatcagctcgttcctgctgttagagtttgtgtcgaatatacagctcgctgcgctcgtgctcaaggttttacctccagtacaacattctctgcggcttgtaagattggatcgcacgcagaattccgcattcttatcattagctcaccaaccccatcatagctgcagctgaatgcgtgcaagcaggccaacatcatgtgtgatcatgccggtttctgataaccacggtagtagtaaatggctaggattagttagttgcttctactgacacaccaatgagaccatggttggttgcagaagtaatactatcttattttttcttttccttcgccggggtggcgtgaagagccagccgagatttattaagagaactatcttattttttcttatattttaggacttcgatcagactcttgtttgatttagtcagaatgaaaaacgtcaaatgcattcaggattagtacgtaactagggacctgaaaatgcgtactcctaagttgtttcaaaaagcaagtatgaaactgtaagatgtgaagggtaaccaactattagtctgaaagtggatttggtagaaacttcagagactgtcctctaaccgacaaatgccattgctcatggtagactgttctctaaccaacaaaatgcagaattttcttctcatgtttgacaagaaaaatgaatcgacaagtagcttagagcgcctctctatcaaactttcttccgaagtggcactaaaagctcgcggcatttccttcagaatctgccgcggaacgcctttacaacagtagccgcggcattgcggttttcggcagatcaaaatcagcatggcaccgatgtgatcatgatccgatatggcggatattagagatcgacatgtaccctacccgagaatctcaatctatccccgtagatctcttgagaatccctgacttcatcctctcttttgccaagcttctcagcacattcagagcaccgccggccgtttcgtctcccacttgtttctctcacaagatatcacgatcaaaccaccgcgaaaaaaattaaaactttattcctgaataacgatattctcaaaatctttagctgatgtaaccacacgggccttgcaagtctgcatgatgcattgacctcatgcttgcccgcgcgtgcgtgagggagatgtttgccccaatatgtcaaaccgacctgcaagcgatgtcaaactgagatgccgcggtgcaatttatccgttgtttcttttgtaaaaaggcagccgtggtattcgataaattgccaatctgatctttgcgctcctgattcatgcatgagttgcgctgaacgaatataaagattttgctttggtacttcgtactgcacatgtgtttgaagatgcatgcaccgatcagtgcagcctgttctggaagaatccgaatagctaaagagcaagagcatggaagatgtcaaataagcagctgattctgagttgtgaaatgtgtgtagcattgaaacatttttttttttggaaaagagcagcattgaaacatatgtaactcatttatataacacaaggacgtaaagcttgtagaggtcggggatgtaatcatcttccttataaagaaaataacatatggctgtcattatctgttaattttagctaacagcgcattaacactgacataacaatggtcttaacactaacataacaatgctacactggtgagaatctggtaataggaatgatcatggatatctatctatggagatatgcacacttaaaagtggtagaaacaatcaagcacgccgtgcaatagcagtatggaatcattcataagaaaacgactgatctagactctagagcacatgagacttacatggtcaaaaaccacaggaagatatactggatagccaagaacaacgtgttggtaagctagagagacagtgccgctagaaagatggaagacaacgaaaagtcggtgcatcgtccagaattcgttccaaatggtataagatgcatcatgatgaagctgcaaagcgaggcacgggcaaaagcggctggagatgcaactcgagaggaatctcgcatttgccggatgctaacttgacagggaagcatcaggcgctctccttttagcttggaggcgcccgagcgagtggctgactaaaccagatagatgcctcctttgactatggctggaatgacaatgtccatgtcctctgctacggacggatggatggatagattgcaattgcattatggcacacaagtaggagcttcgctttttggaggtcactgattgagaggaacaatccttattccaaagaactagcttgcttgcattgcattggatattccagggttctttttcttactgttctggtgtgcatatatatcttcttcagaccttcagggacgtactgtagtgtagtttgtgcggtgaaaagtctgaaatatcaagagcttttcatgcactgcaagtggcatttgactgcagttttcactatatctcagtcatatcctgccaagaaaggaagctatcctgagtgggaggtcatagagactcctctggtttttgtggaggttgtgtgaaaattctagtaagctatgaatgtaaggaaacaaacactttcaggtggggaatatgtggacacgatgatcacacttacgaagcactagacgacttttaaggtcccattttcccagtgctatgctgcaatgtccaacttgagcaaggaaactggtttctgaaatggtacagcactagttcgtagtgataatgcagcatttctaagagtacaaaaacatttgggaatggctgagtccc

SEQ ID NO: 63596 - DNA, 19651 bp, Oryza sativa
ctcaactgcatgtgcagttaagtcagaggatctgcttcccttccactgggggttgctagcgcgcgtacgcgccagcaatttagctagcgcgcgcggcagctggccttctcccagtgtctttttttttcttcttaatgtttacacttttttttaaattttatgcgtgtttttcttcttcttttttgccgtttcttttcgatttttttaatctttcgcacacctctttacaaatatagaattgaaagtttttaattttgacttgaaagttttcaaattttgagttgaaagaatctttcaactcaaaatttgaaaactttcgaccggaatttgaaagatttgaaaactttcaacttgaatttgaaaactttctacctgaatttgaaaactttcgaccagaatttgaaaactttcgacctgaaatttgaaaacttttagctcaaaacttaaaaaactttcaactcaaatatgaaaacttccaaacttgaatttgaaagctttcaaatcaaatttcaaaaccgtcaccttgaaattttaactttcaaaatattttttaaaaaaactttcaactcaacttttgaaaatttcatcatatttctgaaacttttcaacttaactatttgtatattattttgatataataaaatctataattaaattaatctacacgcttagcactattattagtgctaatgactagtgggcccacgcgcttaacctcccatgcaagaagtggaaccgaaaatacagaaaacggaaaaaaaaaaggaacacgaggcgctacggactcggagtgcgcgcgagttgctaatctggcgcgtctgcgcggattagcaatctcgggggagagggctgcttctctctcggtttgcacgtgtgctgcacgtgaggaatgggagggccgagtgaagaggatgggccgagcaagagagaaacggcccaacgaccaagagggacgcaaaatagacttttccaaaagatttgatttggaggtattggattcggatttggatttagaattgaattcaaatgtgatgttcgaactcacggacggagaggtaaaggaaaggatccaaggagaaagtcatcattcaaaaacggaacgatgggagatgacgatagagcaatagatagatggatggatagggcgatagataggtcgatcgatagacatggatggatttaaggtagggatttaatattttcttgtaatcggggacaagtatttggcgaggattcaaaggaatagattgaatgtcggagttgtctttggaatgggaatttcgaggagacaatttttgatttcgacgagagggatcaaggagatttaaactgagatccacgacatgacttagactcgcccacaaagaatgaaaattttcgcaattaggattttattaattaggttttttaacgtctcgcgaaaaatgaggcgttacacttttcaaactggtattaatccattaacactaactgtggacccatagaatttactaggaataaattgggcctaacccatttagttctaacaataatccccacctaatttcagagctcacagaaatgttctcagtatttcggcgtagactgtgaagttgaactttcacctagaaaaaggagttacacctgaccacaactgaacaatggactattccttgaattgtcggtcttgtgcagttaggctttactcaatttcttaattgatactagactgtcattagcatctcctttgtgtggtgtgtataagttgtactccaggccttttcatgagtatctagagatcacctaaatctcatagactttggctagcagtcggactcatataggtgtgttccttctaagatgttctgtaggctaacatatcttgtttaagaaaagccactcaggtcacataagggaatgcaccaacccaccatacaaataaggagataagtacatcatagaaatgagctttgggtctctcctcctagctaccaaatagcttgtttcaccatcctaattcacaggatctctaatcataaaggacggattatcactattgtgtaactcaagtggatccaagcccatctcactcgatgcactgtctatcacattacgcgatagacccttagtgaactgatttgccagatttttagtagtctgaacatagtacaatgctatcactccggagtttttcagcttcctgacagactatattagtattctctttatatgtctggatgacttcatgttgtccttctattaacgccaaaatatggtatgtttttttactgcattcaggtaagggaaagagcgaaagggcctgtagcctagtggttacaagagcctcagtagcacccgaggtcctgggttcgactccccatgggagcgaattttccaggatttaatggcgttgtgctttcagtggtagacgacgtacccgtcgacagcgaggcgcctgtggtgacttcgtcaatctctccaggatttgccggcccagtcttcgaagatgctcataggggtgagtgcacgtgcgttgtgagtgtctgtgttgtactgtgtaattctcaaaaaaaaatgtaaggaaagaagtcgatcaactaatgtaaacctatgcagaagagaccaatctccggaaggaatcgtgaagatcatagtgtggcaatttaattctacctattaattggacataatttagtaattttctgttatcttcaaaaagttttgtttagtgtctgatcttgacttatatcttttatttttatctttagaaaacttatattgtgtccgatcaagactagtatcaacccggaggtataaatatgtacaaccaaagttgttttaatcaatcttcataaatcaatacaattattttcaacgcatcaccaccctttttatcccggcgagttcttagttaatttcgaggggggatacatcggttaagttcgatctccgacgagaagtgagctccgtcatcttcgctttcattggcgttgctaggactttctcggttaggtccgatgctctattcgggctaaagcaagcgttgcctatcttatatgtcgtctctaattttttatgcattgttgcttaaagttacatactcacatcagattagtttggactttattggttcagtccgatattctaatcaagttaatgacttttattataaatttgttatatccatctctttaaatataacattttttttaaaaaaagtgggcaaaagctttgcctcgtatatattgatagagaagaggtactaatatatataataatataatatctttttttaaagaacccaacaaagctggttttatattatagaaggaagagaataaccatacaggagcaggaatgacattcctagaacaaaaatgtctcccacaagtaactactccctccgtcccataataatataagaagttttaaagttggacacggttattaaaaaattaggtaaaagtgaatggtggaggattgtgattggatgagcagtagaggtaggtgggaaaagtgaatggtggagggttgtgattggttgagaagagaatgttagtggagaagttgttatattttgggacaaatcctaagaactaaaagttgttatattttgggatgaagggagtagaaattaaaacaagcctattctcgcgacattatacactgcactcccttagcacccgccaactcccacaattggagttcatccataatcttgcttgtaagtaccggtggtgtagattcgatgttcctgaagatgcgattgtttctttctatccaaaccacccaaagcgtggtcggtgccaccaattgagtagggtgtcatcattgctcgtgttcaagaatcgatttggtctgatctggtggcctatctcctgccaaaccctctgtatgaagaggcactcctttgtatgaagaggcactccttgaagaggtgctgcacagtttccagatttctaaaacacagttggcaaaaatagttatttagccagcctcggcattgtaatcgatcccccgtccatattctgttcttgctctttggccagaacttttgcttggccgacgcccaagttttctatatgagaatagcggactctgatcttgttttcccctgaactgcatggtgtatgcagaccttgccgtatagaggccgttggccgaccatctccattggatttatcctcattcctcagtcccttcttggaacacaactcctgcaatgtccagcacttcccaaacataaatgtattcctgaagcaattgtataatataatatctgagtggaaagaagtctaagcatataaaaaacctagaacaaacaagttaactataaatagacaagtagacaactataaaaatattgtagaaacagaaagcggttcgcagagttatatgttatatatatatatatatatatataagtacagacttctcgctttacttatgctaattactccgtaaccttcttcaggaaaacttaaacaactccactggcaactgacaaggttaggtaagaccgtaagagatggaatatctcagttactatcagtgggcgagctggtcgtacgagccggaggctgcgttggtacaattgggctgtgtacaccagtcagcttcgcgtatccggtgctctctttgacctcgccttttaaaaaaataaaaattgttttttgttcccctctgaccagcacagcagcaagctagtacactggtttcaactttcagctcgtcttttcacaaaaaaaaatactgtaattaaattttgtaaagatccgatcaagctcacgcgtacgtacacgcgcttgatagcatcatcagaaattcagaatctattatatctataaagtaatataaagtaatagaaaaagaagcctccacgttcgctctcacggtctagaaattctcacattaattaaaaaataagaaaaaaggaaaaatagaactaagattaggattaggattagttaaaaactaaagaaaggcaaaaaaaactaaaaaaaactaagatacttgaatcggacaacagtcaaaaactaaaaaaaggaaaacggaatcatactaatatgctttcgtaggatacaggaaacggacaaggtttctttcgatttagaaaacgtatcagacactaattttgaaaaccgtgtgagacactaaaaaaagacagactaaaaaaccatcatcgtcagattcatgcaatctgaattgtacacaaattacatgccatggtaatatataaatagtacgctagaaatcttctctccacaatccaccgcaacaaaaaaaaaaggaaaaaaagattaagtacaaaatagtgatgaaactctgtacgaatccgacttttagcgatgaaaaaaattgtgagataaaagcaagtgtttcaggaaaatagcaactaactgatgctctaaaataccatagagctgaaacgatatcaaaacaagaaggcaaactcaatctattatcttaataaagaaatagaaataaaaaaggagccaccactctcatagactaaaaattttcacatgaattagagagaaataaaaattctaatatatgaaaaaagagcctagatggaaagtaatagaaaaagaagctaccatgtttgctctcacggcttagaaattcccacgttaatcgaagaaaaataaaaagtagagtccatataggaatactatttaaaaatagctgaaattcagaattaaaaataaggaatattgaaagagtagacaagagtccatacaagcctacaatttagaattaattaaaattcggaattaaaaaaaatagaaaaactaaaattagaagttagagtccatatagaaatacaatttagaattaataaaattcaaaattaaaaaaagtaagattgggagaagtgtcatagtctatatatgaatacaatttataaataactgaaattcaaaattaacaaataagaaatcttgaaaaaaaagtccagcatctatataggaatacaatttagaaataactaaaattaaaaaaatattgagaaaagaagtctagagtcaatataggaatacggtttactaataattgaaattcaaaataaaaaaaaatattgaaagaagagtttagagttcatatagaaatacaatttataaataactaaaattcagagctaagaaaaaatgaatattggaagagtagtccagaatccatataggaatataatttatgaacaaagaaaattcaaaatttaaaataaggaatgttaaaatatgattcttgagtccatatagaaatataatttataaataactatcacatatatacaatacaataaaaatatcacacatttgttagttcaaccaagaatttaaaattatgttgtcaataataaaatatgaaaatatttaaactattgtatgagaaaaaaaatctaacaatgctagccgtgcaatctgcgcgggccgccatgctagttgtcgttaatgttacaagctgccatgtgaccataaggtccacacgtaaatattatttttagatattgcattatattctaatccattaactatgctataaacttgtatttttttttgtgttttcttttatctcttacagtatttgttgcaatgtaggggccttagctagttttttttaagtaagtagatcaatatgggatatgatattttacatacttgcaagtttaaactgaacttatataagaaaaaacaaaaataacaaaatatattgattctaaatagaacgtgcaatttttagtcaaatctattacttttatttcttattgtatagactaaatttgaactggtgtgtttgtggaataatatgtcacatattgatctatcttatttatttttctaaaaaaaaagtttaatgtttttttaaatgatatgcactaaacgagacgagggacacgtccctctatgaacaatagtccatctccactcgacaaaatttgtcgtcagaacaagattataagggcaacctcaatgttgggttgctgaatgagcagatagctttagctatatctatctctacaatggttatggccttggatgagaaacaagccgggtcccactgggtcccatcaaagaagaaacataccaccaattcgcaatcatatgctgataggctccattagatatcattttttaatctcttaagttcaactgtaaggttagagctgtttttaagcatttaatgtcttatgtccatgtccacaatgtatatagctgaaaaaaagtcttaaggctcactcttatggtcacattgtggatgccctaaacagaaactaaaatgcaataactctgtctttagatattggaaaaggaataaattctcgcttcatgcgtacgttacgtacctgaacaatcccagcgtgttgccctttccggtgattctccgccggctcaaaccatgtgccgggccaatgcgtcccatcagccatccatgtcgcgttttcaccgtcatctttgccatccttcgctctgttgtacgcgtcagatcgcttgcgaatggtgctgaacagcgagtcgatcctgaccttgaactcctcgtactctcgccgcacgcggcggcgatcgctcatcagctcgccggcgacgccgcccctgtacgcctgcgtcttcatcgcgaagtagctctccggcgccctcggctcgacgcagtgcttccggcagaagggcacccacagctcagcgaacttggcgacctccaccatggcctcgtagtggaccagcgtcccgccgtcgtcggacaggtagcaggcgtacctgtccaccgggtagtcggcggcgaggatggagaggatggagttcacggtgtagaggatcggctcgtcgacggggtcgacggtggtgacgaagacgtcgacgccggggagctcgccgccgccggaggtgccgtgctgctgccggtcggcgagggcggcgaggtccgcgacgcgcttgatggggttcagcttcgggagctgttgagcgcccacgaaaagccgaaccagacgtcgccggccatggacattgtccacagccacgcgccgtcgcggttcttgtggcgtacgcgccacgcgaagaagcgacgatggcgatcagtcgaactaggatcaagaacctgttcgtatattagagaacagcataagggcaaccaaaatgaatgctgtaaattaatcacactttattgattcgcaattaatttgtctaagtttgattataagtttataagagtagttagtagtatttgacatcagtgtgggcccaggcggtcagacctgtaaggatgcaggatgctgcccttgaccttgtacgtccggaacagcgtcggccgaacgccatcgccgccgctgggccccgacacgtccgcctcgtcgacggccacccacacgtcatccttgccgccgccgtcgttcacccgcttggccgccggcgagcacggtgccgccgccgccgccacgtagacgccggccgcgccattgccgttggtgacctcgacgcggaggccgcccgcgttgatccggcgagtcacggccgccgcggacatcgtggaggccgtagccaactccatgcacgcaaacgcacctagctaactacgtaagctccgtggcgaactggtgaacacatcgtggtggcttatatagcgcggcgaaacgacatgagtttaattaaatcatcgtctcaccctgcctggtcaaaatactgctgctacctacgtggtacaagagaagccgccactgtcacagtgcagcaagctgatgagcatttttcctctctgcagcgtatgtaattttcgttcctctctttcgatcaaactcggcaacgatcgtcgtgttggcgatcaaaaaccaccggcacaaggtcaccagtcgggcgcagaaactacagattctcggttctcctctagcagccaagtcagctgatcgtgtgacatcttcagaaacaaggaaaaataaaacgtgtacatctgcaccagcaacagtagagacctactccatctaatttatattacaagacatttttagttttctttaatttgattatattgtggaataaacgtagtagcaacatctataacatctttcattaaatctaacattaaatatattttgatacatttttataaaaaaaatacttcaacatttttctataaactctgctttgacttaaaaaaaatcaaaacattttataatacaataaggaaggagtacctaacaaaataaattaatatgcaatatatcattctctacaaacatataagttcaaatttaaattcaacatgttataacaaattaaactctaagtaatatatttgtagtcaaatttgtctctttttttttacaatttatactagttgaatttaaatttaatatatgcttgttgaatgcttcctccgttcaaaaactattagagatttagatggatgtggcagtacatcctagtagtacgaatctgaccactcaaaatataagagatttaggatggacggggtacattctaatatttcgaattcggacaggaacctggccagattccaaagtcgtaatgctagaatgtgtctcatccatcctaaatctcttatattttaggtgaccagattcgtactattaagatgtgtcacatccattcaaaatccattatatcttgagatagagaaaggaatatatttcatataaatcattcttgtcgttctttttttaaaaaagttataatcaccttagtttatgtgtaataaacgagtgatcattcacttgatgattaactcaggtgattaaaaaagatagagataggctgcagcttccacgtcaaaatcataaaaacagctggaacgaaaggtacgggagaacatagtgttgtccacttggacacgaacaaaaaaccgaaccgagtacgtactcaagttgttactaattactactagtatatatatcgaaacaagtgcatggattatgcccaaaattgtgcacgcatgtgttggcctttctgagttctgaactcctgatgatgttatcaagcgcgtacgtacgaacgtacgtacgtaagctcaaattttcaaaaaaaatattgccgggttttgtatgagaagacagagttaaaacatgtgtacgtacctagctgccgtgctggtcagaggggaggaaaaataaaagggagagaggtcaaggagagcatcgatcgagtatatatgagacagtgatcaagtggtggacagccaaacttgatggggatagcaacggtgaaatgaaatcagcagctgacgagctcgcccactgatactctaataactttttttcgaggggaagatactctaataactgagatgttccatttgagttatttattagtttatttatgtttctttggaaagaaccagcggagttgtttaagtttttctgaggaagggttagcacaaaagaaaagagagaagtctgtactttagtccgtaatttctgaccaaatcatgcccgttgaatatagtgtttcagcaaatccatattaactaagtgcaatttgctccgaatcagttcgtgtgcttcctaaacctgcctaaactcacacacatactctcgttctttttatttaacactttataattggtgtccttagacatctaatttttttaacagttcatcagattctttaccagcagaattggacacatgaaagctacaccacttgatttgtcattattgcacagttcttgtaacttgtttaattagagttagtaataggtatttctaaatagcggtctaaattctgttctggagaactagaaaggtgaaaaaaaaatcaaaaccgaatagcatagacagatatattggattttacttttgtctgctttgaaccaacaattcaaattcctttctaaggaaaaaaaacaaacataatcagagttagatgcttgtcgaatggtaaagcatttttcagtgttgagcggtccaccgtattcatttagatccactccaagtgtgatctttgtaaaacttaccagagaagttacattgaagagggtgacatatctttgcatgttctactgattaccaatatcctaaaatcgatgcaaaccacgaattaaatttaaaaatatattgtttatttataattttcttataaacattcgggatacaaatttttttacaaaagtataccatcgtcgctggatgaaagcgcgaaaacgatacggtatcgctgatccactatgcgagaatgacgtggggtgacgatgcgccacggtttcgtattggttagccgcgagagcgtacggtctcgcacattgcttgtgcgagaccgcacggcatggctgcgacagggccaataattaatgtttaatcacattgattagcgactaattaatccctaatcatcattaattaatcactaattatggtaatcaatcactagttaaacgaaaccattggacaacacattcggtatcgctgtttcattatgcgacattgtttcggtctcgctctttcctttcgcgagactgttcggtctcgctcttttcatctgcgagaccgtgcggtctcgcaccattgctgtgcgataccgtccgtatcgtcatacccacatcattttcgcacaacgatcgtgtgagatcggacgtatatttctgccaaaacaattgtatcccgaatatttttgttaaaaaaataaatgaacagtatatttttaaatttctttctgcaaaccacctgcttttatatttactcatgtggtttttctatatgttcaatatgaaaaagatataggacatgaatatataaagacagttgatggtacatatgaaagttctcatataagggaagtccaaagaagtaaaattgaacagactcagagttagatgcttgttgaatggtagcatgcatctacagtggtagcattttttcagtgttaaacctcacggtccaccgtattcatatagatatagcccaagtgtggtctttttaaagttcaccaagaaagttatattaaagaggttgacgcatccttgccaattataccgattaccaacatcctaagatgtaaaccactcgcttttctatttactcaagtgatttttctatatgttcaatatgaagaatatatatgacatgaatatgtaaagacagttggtaatacatatgaaagttctcatataaggtaagtccaaaaatatttgacacaattggattagttcaagaacaatattatttattacaaaagttaaacaatacaatcttttatctatgcacctagaatggaataatgtttgctagtaagatatgggtagcaacatatacaagggcaacaattacaaagataattggcaacaaaacaacaagaatgattgacctctttgcccatctccccatgattgctagtgcaaatgggtaaaggagaaacataacccacatgttgaataggagtcccattgcagcatgtctcttctgtgctatcgtccatactcccatatatactgccgtctttccaatagctacaccaatggcaccgatattagcaactaaaactaccattgttgggattaacatgggaacccatctcatctcatataagtcagcaaatttatcgttggtgtcagcggttgtttgctttgaagtgactctaaaatgtatacccttctttgtgagaagattgaccaccatatgaagcacagctgttgggtaagcactcgttgagccgatcatgaagaactgctcattgcgccaataatctaaccatgtgatccctgcccactttatctcgagccatccgatcatatgaatcatcaaaatgatcacgagaaggtacaccacatacctagtgaatggcctctgaatatatacttcatcggggataagccacatcacagggctgatagcatagagtaaaataaagagtgatgtcaccgggtagattgtcatattgaggtatgagacacgctggagaggttggagccgacgacctccaataagtgggttattgtgggagaagaacatctctagggatccaccagaccaacgtacaatttggtgaagacgttctgttagatttataggtgcagtgccacagaatgcatcatgctccatggtgcaatacatggatcgccaaccttgcccatggatgcgaaaacccgtgactatatcttctgtggctatgtcatatatgtatccaacacccttgccccaatcggtttctttgtcgaatgaagctgacacaaccatctccagctcattgacaaatatgtcattgaccggtgatggtgtagcaaatcggtcttggtttagggcttctaacactgactctaataagagtatggagttaccaaacttgctagcttcaggtgtgatgttgtcttgtctccaatgaggaggatcaataccatagagagctaagcgacggaacatgcaaccagtaccaaggtatgaaggtccttggagaccatttagggcaagcattgtgccatcaaagaatacacgattatgattgccatatcggtcttttgggtcaacattgtcaaagcgttgtgggaactgaacaaaggcagtattatcaccttctctttggtcaagcatgaaacaaattgctgcacggaaggcttgagaattgttgatgtagtgatcacaatcaaagttgatgatgaattgtgcattggagagtagagcagaggcacgaagttgcgcatttaatgcacccgccttcttattatgatcataatttgggttctttccacgagacacatagacaagcatcgggatgcgcacatcagtggcattaaaattaagattgttgcccgtgctatccttcaggctaagattgtggccacggatgggatggtccaacacaacctgttcaaattgacaaatatgtaggtcatgttaatggaaaatttatggtgaatccacttaacaaggtaattgcggattgcacaatatgatattatccccttagtaatacattagaaaaaaaattaaggtggagttatgtaccttaacaattccagcatggtgtcctttcctgtgattttctattggctcaatccacgtgcctggccattgggtcccattagccatccaagtcgcatttggtgctccttgatcagttttcatactattgtaaacatctgatcgtttacgaatagtctcaggaagtgcttccaatcgcaccttgaactcatcatactcaagatgcacaatcctagagtcattcttgaactcctctggtgcacttccagtatacgatggtgcctcaagctcaaagtagctctctggggatctaggctcaatgcaatgcttccggcaaaatggaacccatagagtagcaaatttggctgtctcaaccaatgcttcatataggatcaatgctccactatcatcagagagatagcaggctgacctatcaacagggtagtcagccgcaagaatagagagaacacaattcatggtgtatagaaccggttcgtcgattggatcagcggtggtgacgaaaacatcgatgccgggaagtctgtagcttccgtcggcgagatcacagtactgccttagggcagtaaggtcaggtatggttttgaccggattgaactttgggagttggttaagtagccatgaaaaaccaaaccaaacatcaccggcgactgacattgtccagaaccacattatgtcagaattattgtgcctgatccgccatccgaagaagaggagaacggcaatcaagcgtgcaaagatcagagccctgtaagagattaaaaaaaacatgatccgactgtagttaatttctattgaaacgaaggctgaattttatttattatcttaaaaacaattatttctagaaatgcaagtaaatgcacatgcccaggtgaccagaaagggtaaatattcttgatccaattataagctgcaaagacattattggaaacatgaggccgtactgtgggttactacgagtcaacggattagcactgaaagaaatccgggagcagaatatatatcactcacgatccatccaaatgatcaacgtgctcattgacttgcatatatatatacttcattctaccaactagaaaacgcatacattcccggcttaactaatttttagatactcccccgtttcacaatgtaagtcattctaccattttccacatttatattgatgttaataaatctaagcatatatatctatctagattcattaacatcaagataaatgtgggaaatactaaaataacttatacagaggaagtaacaaaagtatagcgtccagattctgtatctagcaagctcagtactaataataatctttatgcataaaaagattttcattgcaatgtcgctgatttttcgatcgtacactcgatcggatgtacgtacctgtacgggtgcaggagggagcccttgaccctgtacgacctgaacagcagcggccggcggccgtcctcgccgccgcactccttcgccgcgcgccgctcccccttatcggcggcggcccagtgcttccccttggcgccgccgccgccgccgccggccgccttcctctccgcgccgccgatgctgctcgtgcggctcactagcagcgggtcgatgaggctgctgcagccattgctatcctcaccaccgccggcgaccgacgccggcgaagccatgacgagcactctatagagctcactggcaagcttaagccagtgcaagtgtgctgccctactggtacttgaagctgaagagagtgtgcagatgcaccatgtatatatagtactgtactagtgactgatcgttgggttgaatgaatatttgcgtgcatccagatctgcgtgcgccgcaactatcgtctatcgattgatcggtcgcctcgcctcaccaaacgtgttactccctccatatattaatttatatgtatgacgccgttaatttttcaatcaatgtttgaccatttattttatttaaaaaatttatataaatatgaaaatatttatgtcatgtttaaagaatatttgatgacgaattaagtcataataaaataaataataattatataattttttttgaataagataaattattaaacgttgaaaaaaagtcaacggtgtcatgcattagtacgttgcttcgtctgagcactaaacaaaccactggtgaacaaaacgtgcagcagaatgcataagcatgttgcgtccatgtgcctgcaggctgacccaaaaaacgcacttgtctgcagtgctttgcatgcatgctctgtactgtcttacgtcttgtcaggctaattaataaatatcgccatatggttactttggttaagctgcattgctaatcagctgtattaactgtgccactgtaatatataagctcaggttatttgtgaaagtcaacttttgccgccttaattacggcctggtgttactcagtcgtcgtcgagcatgtgggtgcaacgatcagatcgatggagatggatctacctatgcaagttgcagttaagcagaagtagcttaattagatcaccgtgcatgcatgagagagagatcgatccagtgcgaggggacgatcagaaatctggcagcatagattttaatttgtttggttctctcgtgtttttgttaaacaaatcagaaatccagtatgattctctcttggcagatctgcagagagtactgattttggtgcatataagttagtttatacatcaatgtgttgcatgttgtgtgttgattttttttttttactcatagagatctggtgatgccggttgtatatactactggaatccaaattgatctcacagaactgtggggagataaaataaatggccagatctatatattgatcgaaataagagttcacacactgctcggagaagcatctttgtggtgaattgatctatgtactactactccctccgttttatgtttactactcgctccatttaataatgtaagtcattttaacattttcacattcatattgatgttcattaacatcaatataaatgtagaaaatactagaatgacttacattataaaacggaggaagtactactcaattcgtctcaaaatatagcaacctagaattaaatgagatacatcctaatacaacgaatccggacaacacctaagactagacgagacacctcctagtactacaaatctgaataacatatatgatcggacgtgagacacattaaattactatgaatctggataggctctgtccaaattgagtatatccagattcacagtattaggatctgttttgttcgattttaagttgctatattttggaacgtatgtagtaaattagaagacatatcctagtatgcaaatctagatatattctatccaaattgatcatgtctaaattcacagtactacgatgtatttcgtctagttctaggtggttgtatttaggaactgaggtagtaaatcatatgggttttgttaaaccttttaaagtttgaaaccaagtttgtaaaaaattagcagtattttgatatacgaaacaagcacactataaaaatatatttaatagttgatttcaatgaaacttatggttggtgttgtacatattgctgcgttttccaataaacttagtaaaagttgaagtctgagactattataatatggaatagaggggtagtattcaaatgctatatattgttcataattgagggtgtatatgcaagaacattttggaaagattttatatgcacaacgtcatggatattaattatcttggactatatctcttgaacatgtgtgatcgatgtgtaagtgtcacaattgtggtagcatataaattaatgtgacggtacgtctttcgtagatgtcacttcgtgtacttttttttctatgtttaatgtaaatagttaagatagtttgaaaaaaattgattgtatacgaatatagtaatatctaccactccatcaaaaatctcaaattcaacatatacattaggaggaaaaaaaaccgggtatgaatagtacaactactatttatatgctgaatttgttttttaatctcactgtgtgagttgagtttgaaccttatattggttaatctttagacaattcgaaaccatttacgaacttgagatttacaatagcagacaaggcattatactaggggtgtgttcggcacccaattttctcaacccatctccctcgttttccgcgcgcacgtttttcaaactattaaacggtgtattttttacaaaaagtttctatacaaaagttgcttaaaaaatcatattaatctatttttttaaaaaatagtaaatacttaattaatcacgtgcttatggactgctccgtttttcgtgttactgtttcgagttgggaaccagcatatgcgaacacaccctagtatgtgttcacaatggcagtactgcagtttgccaggcatgtgtacatgcatgtttgaaatttatgcaccacattaccagctacagtcatctaaaaaagaaatagatctgtagatgcaggagtactgttagaactgtgtattaaatcagctatgatcagtagaccgtctagtctgatttactaattacaagtccaaacgaatcttaattcctgttcttctgacctcttaattattataccaacatgctcatcaaaactcgagagtccgactgatcagatgcaaagattaacctcaaggtgaatgtcaaaaagaacaaaatcatacatgtagattgctatcagtacatgtcaaatcaaagagtgtgtacttaatttttaatacagtattaatgggtggatcttagagtgttaacggtaattacctggtacaccaatctagtccatctctgacaagctaacatgtaggcggccgggttaggaaactgagggagatctagttaattcagaggcgacgatgcgtgtgcatcacatgtgttttagccgtccatgtgacaatgcatcaagctggaataatcgattggctgatacagctaatacaagccaagaagtcgatggtttctagtgttagtctttctttttaaaattttgagatgagttttggtcattttgcttggcgttaattccctaatcacgtgatcttggagagacgagttagagcaggtacaatagcaggctataagccggctataatcatatatcgagaagaaagcgggctacagatttgtagccggctgtaatacggacttcaagatgttatgtgtgtatgagatgtgggaccgggtattaatggtgtagtatatttttatagttaactattgtatgaatgagctattagattggctatagatgttttggagccagaagttgtctatactattgaccttgctcttaggcgtactaatgaaggcattaactaaagttcttactagtaatataaactcgcacttcatgattttggtacacgtgagatacggcccaacacgctccccgaatcccgctccggcccattcctggtaatccccgttccggcccaaaagaaggtgctatatttagttgggccgtactcacgacatctttttagggccgaggaagatttccttgtccgcactcactccgcacgtcgtcgtcttcctctcgccgctccaaccccaggacccccaggtacgcgcggcgcgccttctcttcccctccgctagctcctctcgaactggttgcgccgctgctttccccatttggttgacctccgcgcggcggctgaccagcctccaacgcgtcatgccggggttgttttttttttttttggtgggggtgggggt

SEQ ID NO: 63597 - DNA, 7274 bp, Oryza sativa
agctatgctagaggagctagattctcttgaaaagaacaaaacatgggaccttgtaccattccctaaagggaagaaagtggttaactgtaaatgggtttatacagtaaagcaaaatcctaatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaggatctgggccaattaaaatattttttgggtattgaaattgcaagatctcctagaggaatagttctttcgcagcgaaagtatgtattggatctgctcagtgatacaggtatgcttggatgtcggccagcttctacaccaattgaacaaaatcataagttatgtgctgaatctggagatccagttaataaaaagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgataggaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttcgagaggaaaaatcacaaaactacacaccaccactagggacagctttcaccctgctcactctgcgttcaaacggtttcaggggagaacaccggagttctgaagaaaacagcattggctctccttcacctgagattaaagtcgtacaagaaaatctctaaaaaatttcgtttgtcaccagagttcgtttgtttttggaaatataaaatgaatcgtacaagaaaatctctaaaaaaacttgtacgctaacttgagattaaagtcagactcctaattgcagctcatgattttctaaaaaaaatttatcaaagcgaattcccacatcaaacttcaccctagttaaaccgtataacaataataataataagattaaaatagtattcatccgttacaacgcatgggcatattttctagtaaaagaaaaattcaagtatcacccaaggggccgagtagcacagaatagcaagtatgttagaattgaacgtaagctaaaattagcgcacttgacttttagatctgcatgtatggtggtggatgtgtgaacgtctttcgtttaatgagtaatactgtaaaaggtctccgagaatttagcgtcaagatatgcacactggacaaattcaagtcttcatatttttaaaagaacaattaaaatatcaccctagtggcagagtagcatagactacaaatatgctagaattgaacttaggctgtgtttagttcagtacgaagtttggattttggttgaaattggagatgatgtgactgaaaagttgtgtgtgtatgacaggttgatgtgatggaaaaggactgaaatttggatccaaactttggatctaaacacaaccttaagctaaaagtagttcacttggcttttaggatttcttgcaaagtgttgttctccctccatatttctatatagttagcaccgttaattttttaagttacctttgattatttatcttatttagaaaactatacaaatatgaaaaatagaagtcataattaaagtattgtagtgatgagacaaatcataaaaagataagtaataaatgttttttaaaacgatgaatggtcgtatgtaagttaaaaaatcaacaatgttaaacattatttaaaaagagagtacaatttttatagaatggtaatatttacccaacatttgtatccaatcggatatatgcatctttttaaattggtaaacaaccaaacttgaaattcgctcttatggatatttgaactcaggatcttggggtgctactcagatcactgcaaccactaagctaaatgccttttagcgaaaaaaaagtcaacgtgttaagaatccaaataaagtaatatatgtcgtaaaagatatccgagcatataaagtcaacatatcacaccggagaaattcaaatgttgtcatttttcaagaagaacaattcaagtctcacacggatagagcagactagcataatcagccgctctcatgacgtaacaacataatagaagtaacaaccagattattgcacaagaaaatcatcaaatactcaaatcaaattcaaacccgaaccgtccctacccagatggcccagtcagcgatgccgccgccactttaccgagagaagcagcaacacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgaccatgatgacgatggtcgggatcagcagaggcacccaccgcacggtgtacaggtcggcgaacttgtcgccggagctggctgccgtctgcttcgacgtgaggcggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatcacgtggatcatggcgatgacggcgacgaggtagaggaggtactcgccgaacggccgctggatgtaatactgctcggagatgagccacatcaccgggaagaggttgtagaagaagatgaacacggtcacgatcgggtaggtggacatattgaggtaggcgacgcgctgcagcgggtggaggcggcggccggcgaggagcgcgttgctgtgggagaagaacatctccagcgagccgcccgaccaccggaggatctggtagaggcgctcggtgaggttgatcggcgccgtgccgcggaacgcggcgggctccactgaggcgtatacggagcgccacccctgccggtgcatgcggaacccggtcaccacgtcctccgtcgcgatgttgtacacccacccgacgtctctcccccatgacgtcccgtcctcatacgcgcacgccgtcagggcggcgaggtcgccggcgaccgactcgtcgagcaccgccagcggcgtgatcgaccgttcttggttggcgccgtccagcatcgtgccgacgaacgacgtcgagctgccgaacttgttggcgatgtccatagccttgatctggctcgccgccgctccccagcgcggcggctccacgccgtagagcgcgacgcggcggaacatggtgccggtgccgaggtaggagggcccctggaggccgttgagggagagcatggtgccgtcgaagaagacgcggttatggttcgcgtaccggtccgtcgggtcaacgtcgtcgaaccgctgcgggaactggacgaacgccgtgttctcgccgccgcggccgcggccgtcgagcatgaagcacatcggcgccctgaacgcctgcgagttgttgacgtagtggtcgccgtcgaagttgatgacgaacggcgcgttcgacagcagcgcggacacgcggagcatcacgttcatggcgccggccttcttctggtggttgtatccgggccgcttctcgcgcgagatgtacaccagcatggggagccgcacgtcgacaccgctgaaatcaaccggattctcagcactcgccgccaatccaagcctcggtttacagcttggatggttcagtaaaacctatcaaaaacacacaaaaaccattcactctgatacaatttgcccggacaagattggaaacagaaattaaacatgtgtagtgcgcaaatacctgaacaattccagcatgtttccctctctggtggttgtcagccggctcaaaccatgtgccgggccaatgtgtgccatcagccatccatgtcgcattttcgccggcatgtttggcgttgtacacatcagatcgctggcgaatggtgctcgagagggagtcgatcctgaccttgaactcctcgtactctcgccgcacacgccggtgatcgctcatcagctcgccggggacgccgcctttgtacgcctgcgtcttcatcgcgaagtagttctccggcgacctcggctcgacgcagtgcttccggcagaagggcacccacagctcggcgaacttggcgacctccaccatagcctcgtagtggaccagcgtcccgccgtcgtcggagaggtagcaagcgtacctgtccaccgggtagtcggcggcgagaatggagaggatggtgttcacggtgtagagtatcggctcgtcgacagggtcgacggtggtgacgaagacgtcgacgccgggtaggtcgccggagtgccggtcggcgagggcggcgatgtccgggacgcgcttgatggggctctgcttcggtagctggttgagcacccacgagaagccgaaccagacgtcgccgaccatggacattgtccacagccacgcgccgtcgcggttcttgtgacgtatgcgccacgcgaagaaggcgacgatggcgatcagtcgcgccaggatcaagaacctgtaaggatgaaggatgctgcccttgaccttgtacgtctggaacagcggcggccggccgccgccgtcgctgccgcgggcccccgacacgtccgcttcgtcgacggccacccacacatcgtccttgccgccgtcgttcacccgcgtagccgcgggcgaccagcatccgttagtccagcttgtcaccgctgccgccgcggacatcgtggaagccgtggtggccgccgccaagcatgcaatgcacctagttagctagcccctccttgtccatggcaaattatttcacgccaagggggctttatgcctttatgtagcgccgcaaacaacatgagtttcatgggtctgtttgagagcttcttgcaactactgtactgcttcttctaaaatcagaatctcttttaaacattattttttaaaattctatgaatccaacaatataaattagaaaataactaccaactagttaattattagaattttaagcttcaccctaaataatgacatgtctacctaccaagtcaatttgctactattgctactatacggcctccaccagaccaccacactagcgcaagctgagcattttactttctccgtaccaaattattgctacctagaattagagaattttggtgagagagtagtgatttctatgcccacggtttctttatcaccaacactatcatactcctagttgctgcaagtttgataaaagagaggacaaaaaatacatagctcgagtatagtgtgttggctgcaggaagctactacctccgttcgatcaaaatatcttatattttgagacagaggagatactagtcgagtatagaaacagaaactacagattaattcttgttcttcgttgactagcagatccaagtcacgtcttcaaagaagaaaatgttactacgctgcacgcctgcaccagcaagttttcatgttgttttatctaaactagcatggcggcccgcgcagattgcgcggctagcattgttagattttttttctcatacaatagtttaaatattttcatattttattattgacaacataattttaaattcttggttgaactaacaaatgtgtgatatttttattgtattgtatatatgtgatagttatttataaattatatttctatatggactcaagaatcatattttaacattccttattttaaattttgaattttctttgttcataaattatattcctatatggattctggactactcttccaatattcattttttcttagctctgaattttagttatttataaattgtatttctatatgaactctaaactcttctttcaatatttttttttattttgaatttcaattattagtaaaccgtattcctatattgactctagacttcttttctcaatatttttttaattttagttatttctaaattgtattcctatatagatgctggacttttttttcaagatttcttatttgttaattttgaatttcagttatttataaattgtattcatatatagactatgacacttctcccaatcttactttttttaattttgaattttattaattctaaattgtatttctatatggactctaacttctaattttagttttcctattttttaattccgaattttaattaattctaaattgtatgcttgtatgg

SEQ ID NO: 63598 - DNA, 18585 bp, Oryza sativa
cctccaccacccccacccccaccaaaaaaaaaaaaaacaaccccggcatgacgcgttggaggctggtcagccgccgcgcggaggtcaaccaaatggggaaagcagcggcgcaaccagttcgagaggagctagcggaggggaagaggaggcgcgccgcgcgtacctgggggtcctggggttggagcggcgagaggaagacgacgacgtgcggagtgagtgcggacaaggaaatcttcctcggccctaaaaagatgtcgtgagtacggcccaactaaatatagcaccttcttttgggccggaacggggattaccaggaatgggccggagcgggattcggggagcgtgttgggccgtatctcacgtgtaccaaaatcatgaagtgcgagtttatattactagtaagaactttagttaatgccttcattagtacgcctaagagcaaggtcaatagtatagacaacttctggctccaaaacatctatagccaatctaatagctcattcatacaatagttaactataaaaatatactacaccattaatacccggtcccacatctcatacacacataacatcttgaagtccgtattacagccggctacaaatctgtagcccgctttcttctcgatatatgattatagccggcttatagcctgctattgtacctgctctaactcgtctctccaagatcacgtgattagggaattaacgccaagcaaaatgaccaaaactcatctcaaaattttaaaaagaaagactaacactagaaaccatcgacttcttggcttgtattagctgtatcagccaatcgattattccagcttgatgcattgtcacatggacggctaaaacacatgtgatgcacacgcatcgtcgcctctgaattaactagatctccctcagtttcctaacccggccgcctacatgttagcttgtcagagatggactagattggtgtaccaggtaattaccgttaacactctaagatccacccattaatactgtattaaaaattaagtacacactctttgatttgacatgtactgatagcaatctacatgtatgattttgttctttttgacattcaccttgaggttaatctttgcatctgatcagtcggactctcgagttttgatgagcatgttggtataataattaagaggtcagaagaacaggaattaagattcgtttggacttgtaattagtaaatcagactagacggtctactgatcatagctgatttaatacacagttctaacagtactcctgcatctacagatctatttcttttttagatgactgtagctggtaatgtggtgcataaatttcaaacatgcatgtacacatgcctggcaaactgcagtactgccattgtgaacacatactagggtgtgttcgcatatgctggttcccaactcgaaacagtaacacgaaaaacggagcagtccataagcacgtgattaattaagtatttactattttttaaaaaaatagattaatatgattttttaagcaacttttgtatagaaactttttgtaaaaaatacaccgtttaatagtttgaaaaacgtgcgcgcggaaaacgagggagatgggttgagaaaattgggtgccgaacacacccctagtataatgccttgtctgctattgtaaatctcaagttcgtaaatggtttcgaattgtctaaagattaaccaatataaggttcaaactcaactcacacagtgagattaaaaaacaaattcagcatataaatagtagttgtactattcatacccggttttttttcctcctaatgtatatgttgaatttgagatttttgatggagtggtagatattactatattcgtatacaatcaatttttttcaaactatcttaactatttacattaaacatagaaaaaaaagtacacgaagtgacatctacgaaagacgtaccgtcacattaatttatatgctaccacaattgtgacacttacacatcgatcacacatgttcaagagatatagtccaagataattaatatccatgacgttgtgcatataaaatctttccaaaatgttcttgcatatacaccctcaattatgaacaatatatagcatttgaatactacccctctattccatattataatagtctcagacttcaacttttactaagtttattggaaaacgcagcaatatgtacaacaccaaccataagtttcattgaaatcaactattaaatatatttttatagtgtgcttgtttcgtatatcaaaatactgctaattttttacaaacttggtttcaaactttaaaaggtttaacaaaacccatatgatttactacctcagttcctaaatacaaccacctagaactagacgaaatacatcgtagtactgtgaatttagacatgatcaatttggatagaatatatctagatttgcatactaggatatgtcttctaatttactacatacgttccaaaatatagcaacttaaaatcgaacaaaacagatcctaatactgtgaatctggatatactcaatttggacagagcctatccagattcatagtaatttaatgtgtctcacgtccgatcatatatgttattcagatttgtagtactaggaggtgtctcgtctagtcttaggtgttgtccggattcgttgtattaggatgtatctcatttaattctaggttgctatattttgagacgaattgagtagtacttcctccgttttataatgtaagtcattctagtattttctacatttatattgatgttaatgaacatcaatatgaatgtgaaaatgttaaaatgacttacattattaaatggagcgagtagtaaacataaaacggagggagtagtagtacatagatcaattcaccacaaagatgcttctccgagcagtgtgtgaactcttatttcgatcaatatatagatctggccatttattttatctccccacagttctgtgagatcaatttggattccagtagtatatacaaccggcatcaccagatctctatgagtaaaaaaaaaaaatcaacacacaacatgcaacacattgatgtataaactaacttatatgcaccaaaatcagtactctctgcagatctgccaagagagaatcatactggatttctgatttgtttaacaaaaacacgagagaaccaaacaaattaaaatctatgctgccagatttctgatcgtcccctcgcactggatcgatctctctctcatgcatgcacggtgatctaattaagctacttctgcttaactgcaacttgcataggtagatccatctccatcgatctgatcgttgcacccacatgctcgacgacgactgagtaacaccaggccgtaattaaggcggcaaaagttgactttcacaaataacctgagcttatatattacagtggcacagttaatacagctgattagcaatgcagcttaaccaaagtaaccatatggcgatatttattaattagcctgacaagacgtaagacagtacagagcatgcatgcaaagcactgcagacaagtgcgttttttgggtcagcctgcaggcacatggacgcaacatgcttatgcattctgctgcacgttttgttcaccagtggtttgtttagtgctcagacgaagcaacgtactaatgcatgacaccgttgactttttttcaacgtttaataatttatcttattcaaaaaaaattatataattattatttattttattatgacttaattcgtcatcaaatattctttaaacatgacataaatattttcatatttatataaattttttaaataaaataaatggtcaaacattgattgaaaaattaacggcgtcatacatataaattaatatatggagggagtaacacgtttggtgaggcgaggcgaccgatcaatcgatagacgatagttgcggcgcacgcagatctggatgcacgcaaatattcattcaacccaacgatcagtcactagtacagtactatatatacatggtgcatctgcacactctcttcagcttcaagtaccagtagggcagcacacttgcactggcttaagcttgccagtgagctctatagagtgctcgtcatggcttcgccggcgtcggtcgccggcggtggtgaggatagcaatggctgcagcagcctcatcgacccgctgctagtgagccgcacgagcagcatcggcggcgcggagaggaaggcggccggcggcggcggcggcggcgccaaggggaagcactgggccgccgccgataagggggagcggcgcgcggcgaaggagtgcggcggcgaggacggccgccggccgctgctgttcaggtcgtacagggtcaagggctccctcctgcacccgtacaggtacgtacatccgatcgagtgtacgatcgaaaaatcagcgacattgcaatgaaaatctttttatgcataaagattattattagtactgagcttgctagatacagaatctggacgctatacttttgttacttcctctgtataagttattttagtatttcccacatttatcttgatgttaatgaatctagatagatatatatgcttagatttattaacatcaatataaatgtggaaaatggtagaatgacttacattgtgaaacgggggagtatctaaaaattagttaagccgggaatgtatgcgttttctagttggtagaatgaagtatatatatatgcaagtcaatgagcacgttgatcatttggatggatcgtgagtgatatatattctgctcccggatttctttcagtgctaatccgttgactcgtagtaacccacagtacggcctcatgtttccaataatgtctttgcagcttataattggatcaagaatatttaccctttctggtcacctgggcatgtgcatttacttgcatttctagaaataattgtttttaagataataaataaaattcagccttcgtttcaatagaaattaactacagtcggatcatgttttttttaatctcttacagggctctgatctttgcacgcttgattgccgttctcctcttcttcggatggcggatcaggcacaataattctgacataatgtggttctggacaatgtcagtcgccggtgatgtttggtttggtttttcatggctacttaaccaactcccaaagttcaatccggtcaaaaccatacctgaccttactgccctaaggcagtactgtgatctcgccgacggaagctacagacttcccggcatcgatgttttcgtcaccaccgctgatccaatcgacgaaccggttctatacaccatgaattgtgttctctctattcttgcggctgactaccctgttgataggtcagcctgctatctctctgatgatagtggagcattgatcctatatgaagcattggttgagacagccaaatttgctactctatgggttccattttgccggaagcattgcattgagcctagatccccagagagctactttgagcttgaggcaccatcgtatactggaagtgcaccagaggagttcaagaatgactctaggattgtgcatcttgagtatgatgagttcaaggtgcgattggaagcacttcctgagactattcgtaaacgatcagatgtttacaatagtatgaaaactgatcaaggagcaccaaatgcgacttggatggctaatgggacccaatggccaggcacgtggattgagccaatagaaaatcacaggaaaggacaccatgctggaattgttaaggtacataactccaccttaattttttttctaatgtattactaaggggataatatcatattgtgcaatccgcaattaccttgttaagtggattcaccataaattttccattaacatgacctacatatttgtcaatttgaacaggttgtgttggaccatcccatccgtggccacaatcttagcctgaaggatagcacgggcaacaatcttaattttaatgccactgatgtgcgcatcccgatgcttgtctatgtgtctcgtggaaagaacccaaattatgatcataataagaaggcgggtgcattaaatgcgcaacttcgtgcctctgctctactctccaatgcacaattcatcatcaactttgattgtgatcactacatcaacaattctcaagccttccgtgcagcaatttgtttcatgcttgaccaaagagaaggtgataatactgcctttgttcagttcccacaacgctttgacaatgttgacccaaaagaccgatatggcaatcataatcgtgtattctttgatggcacaatgcttgccctaaatggtctccaaggaccttcataccttggtactggttgcatgttccgtcgcttagctctctatggtattgatcctcctcattggagacaagacaacatcacacctgaagctagcaagtttggtaactccatactcttattagagtcagtgttagaagccctaaaccaagaccgatttgctacaccatcaccggtcaatgacatatttgtcaatgagctggagatggttgtgtcagcttcattcgacaaagaaaccgattggggcaagggtgttggatacatatatgacatagccacagaagatatagtcacgggttttcgcatccatgggcaaggttggcgatccatgtattgcaccatggagcatgatgcattctgtggcactgcacctataaatctaacagaacgtcttcaccaaattgtacgttggtctggtggatccctagagatgttcttctcccacaataacccacttattggaggtcgtcggctccaacctctccagcgtgtctcatacctcaatatgacaatctacccggtgacatcactctttattttactctatgctatcagccctgtgatgtggcttatccccgatgaagtatatattcagaggccattcactaggtatgtggtgtaccttctcgtgatcattttgatgattcatatgatcggatggctcgagataaagtgggcagggatcacatggttagattattggcgcaatgagcagttcttcatgatcggctcaacgagtgcttacccaacagctgtgcttcatatggtggtcaatcttctcacaaagaagggtatacattttagagtcacttcaaagcaaacaaccgctgacaccaacgataaatttgctgacttatatgagatgagatgggttcccatgttaatcccaacaatggtagttttagttgctaatatcggtgccattggtgtagctattggaaagacggcagtatatatgggagtatggacgatagcacagaagagacatgctgcaatgggactcctattcaacatgtgggttatgtttctcctttacccatttgcactagcaatcatggggagatgggcaaagaggtcaatcattcttgttgttttgttgccaattatctttgtaattgttgcccttgtatatgttgctacccatatcttactagcaaacattattccattctaggtgcatagataaaagattgtattgtttaacttttgtaataaataatattgttcttgaactaatccaattgtgtcaaatatttttggacttaccttatatgagaactttcatatgtattaccaactgtctttacatattcatgtcatatatattcttcatattgaacatatagaaaaatcacttgagtaaatagaaaagcgagtggtttacatcttaggatgttggtaatcggtataattggcaaggatgcgtcaacctctttaatataactttcttggtgaactttaaaaagaccacacttgggctatatctatatgaatacggtggaccgtgaggtttaacactgaaaaaatgctaccactgtagatgcatgctaccattcaacaagcatctaactctgagtctgttcaattttacttctttggacttcccttatatgagaactttcatatgtaccatcaactgtctttatatattcatgtcctatatctttttcatattgaacatatagaaaaaccacatgagtaaatataaaagcaggtggtttgcagaaagaaatttaaaaatatactgttcatttatttttttaacaaaaatattcgggatacaattgttttggcagaaatatacgtccgatctcacacgatcgttgtgcgaaaatgatgtgggtatgacgatacggacggtatcgcacagcaatggtgcgagaccgcacggtctcgcagatgaaaagagcgagaccgaacagtctcgcgaaaggaaagagcgagaccgaaacaatgtcgcataatgaaacagcgataccgaatgtgttgtccaatggtttcgtttaactagtgattgattaccataattagtgattaattaatgatgattagggattaattagtcgctaatcaatgtgattaaacattaattattggccctgtcgcagccatgccgtgcggtctcgcacaagcaatgtgcgagaccgtacgctctcgcggctaaccaatacgaaaccgtggcgcatcgtcaccccacgtcattctcgcatagtggatcagcgataccgtatcgttttcgcgctttcatccagcgacgatggtatacttttgtaaaaaaatttgtatcccgaatgtttataagaaaattataaataaacaatatatttttaaatttaattcgtggtttgcatcgattttaggatattggtaatcagtagaacatgcaaagatatgtcaccctcttcaatgtaacttctctggtaagttttacaaagatcacacttggagtggatctaaatgaatacggtggaccgctcaacactgaaaaatgctttaccattcgacaagcatctaactctgattatgtttgttttttttccttagaaaggaatttgaattgttggttcaaagcagacaaaagtaaaatccaatatatctgtctatgctattcggttttgatttttttttcacctttctagttctccagaacagaatttagaccgctatttagaaatacctattactaactctaattaaacaagttacaagaactgtgcaataatgacaaatcaagtggtgtagctttcatgtgtccaattctgctggtaaagaatctgatgaactgttaaaaaaattagatgtctaaggacaccaattataaagtgttaaataaaaagaacgagagtatgtgtgtgagtttaggcaggtttaggaagcacacgaactgattcggagcaaattgcacttagttaatatggatttgctgaaacactatattcaacgggcatgatttggtcagaaattacggactaaagtacagacttctctcttttcttttgtgctaacccttcctcagaaaaacttaaacaactccgctggttctttccaaagaaacataaataaactaataaataactcaaatggaacatctcagttattagagtatcttcccctcgaaaaaaagttattagagtatcagtgggcgagctcgtcagctgctgatttcatttcaccgttgctatccccatcaagtttggctgtccaccacttgatcactgtctcatatatactcgatcgatgctctccttgacctctctcccttttatttttcctcccctctgaccagcacggcagctaggtacgtacacatgttttaactctgtcttctcatacaaaacccggcaatattttttttgaaaatttgagcttacgtacgtacgttcgtacgtacgcgcttgataacatcatcaggagttcagaactcagaaaggccaacacatgcgtgcacaattttgggcataatccatgcacttgtttcgatatatatactagtagtaattagtaacaacttgagtacgtactcggttcggttttttgttcgtgtccaagtggacaacactatgttctcccgtacctttcgttccagctgtttttatgattttgacgtggaagctgcagcctatctctatcttttttaatcacctgagttaatcatcaagtgaatgatcactcgtttattacacataaactaaggtgattataacttttttaaaaaaagaacgacaagaatgatttatatgaaatatattcctttctctatctcaagatataatggattttgaatggatgtgacacatcttaatagtacgaatctggtcacctaaaatataagagatttaggatggatgagacacattctagcattacgactttggaatctggccaggttcctgtccgaattcgaaatattagaatgtaccccgtccatcctaaatctcttatattttgagtggtcagattcgtactactaggatgtactgccacatccatctaaatctctaatagtttttgaacggaggaagcattcaacaagcatatattaaatttaaattcaactagtataaattgtaaaaaaaaagagacaaatttgactacaaatatattacttagagtttaatttgttataacatgttgaatttaaatttgaacttatatgtttgtagagaatgatatattgcatattaatttattttgttaggtactccttccttattgtattataaaatgttttgattttttttaagtcaaagcagagtttatagaaaaatgttgaagtattttttttataaaaatgtatcaaaatatatttaatgttagatttaatgaaagatgttatagatgttgctactacgtttattccacaatataatcaaattaaagaaaactaaaaatgtcttgtaatataaattagatggagtaggtctctactgttgctggtgcagatgtacacgttttatttttccttgtttctgaagatgtcacacgatcagctgacttggctgctagaggagaaccgagaatctgtagtttctgcgcccgactggtgaccttgtgccggtggtttttgatcgccaacacgacgatcgttgccgagtttgatcgaaagagaggaacgaaaattacatacgctgcagagaggaaaaatgctcatcagcttgctgcactgtgacagtggcggcttctcttgtaccacgtaggtagcagcagtattttgaccaggcagggtgagacgatgatttaattaaactcatgtcgtttcgccgcgctatataagccaccacgatgtgttcaccagttcgccacggagcttacgtagttagctaggtgcgtttgcgtgcatggagttggctacggcctccacgatgtccgcggcggccgtgactcgccggatcaacgcgggcggcctccgcgtcgaggtcaccaacggcaatggcgcggccggcgtctacgtggcggcggcggcggcaccgtgctcgccggcggccaagcgggtgaacgacggcggcggcaaggatgacgtgtgggtggccgtcgacgaggcggacgtgtcggggcccagcggcggcgatggcgttcggccgacgctgttccggacgtacaaggtcaagggcagcatcctgcatccttacaggtctgaccgcctgggcccacactgatgtcaaatactactaactactcttataaacttataatcaaacttagacaaattaattgcgaatcaataaagtgtgattaatttacagcattcattttggttgcccttatgctgttctctaatatacgaacaggttcttgatcctagttcgactgatcgccatcgtcgccttcttcgcgtggcgcgtacgccacaagaaccgcgacggcgcgtggctgtggacaatgtccatggccggcgacgtctggttcggcttctcgtgggcgctcaaccagctcccgaagctgaaccccatcaagcgcgtcgcggacctcgccgccctcgccgaccggcagcagcacggcacctccggcggcggcgagctccccggcgtcgacgtcttcgtcaccaccgtcgaccccgtcgacgagccgatcctctacaccgtgaactccatcctctccatcctcgccgccgactacccggtggacaggtacgcctgctacctgtccgacgacggcgggacgctggtccactacgaggccatggtggaggtcgccaagttcgctgagctgtgggtgcccttctgccggaagcactgcgtcgagccgagggcgccggagagctacttcgcgatgaagacgcaggcgtacaggggcggcgtcgccggcgagctgatgagcgatcgccgccgcgtgcggcgagagtacgaggagttcaaggtcaggatcgactcgctgttcagcaccattcgcaagcgatctgacgcgtacaacagagcgaaggatggcaaagatgacggtgaaaacgcgacatggatggctgatgggacgcattggcccggcacatggtttgagccggcggagaatcaccggaaagggcaacacgctgggattgttcaggtacgtaacgtacgcatgaagcgagaatttattccttttccaatatctaaagacagagttattgcattttagtttctgtttagggcatccacaatgtgaccataagagtgagccttaagactttttttcagctatatacattgtggacatggacataagacattaaatgcttaaaaacagctctaaccttacagttgaacttaagagattaaaaaatgatatctaatggagcctatcagcatatgattgcgaattggtggtatgtttcttctttgatgggacccagtgggacccggcttgtttctcatccaaggccataaccattgtagagatagatatagctaaagctatctgctcattcagcaacccaacattgaggttgcccttataatcttgttctgacgacaaattttgtcgagtggagatggactattgttcatagagggacgtgtccctcgtctcgtttagtgcatatcatttaaaaaaacattaaactttttttttagaaaaataaataagatagatcaatatgtgacatattattccacaaacacaccagttcaaatttagtctatacaataagaaataaaagtaatagatttgactaaaaattgcacgttctatttagaatcaatatattttgttatttttgttttttcttatataagttcagtttaaacttgcaagtatgtaaaatatcatatcccatattgatctacttacttaaaaaaaactagctaaggcccctacattgcaacaaatactgtaagagataaaagaaaacacaaaaaaaaatacaagtttatagcatagttaatggattagaatataatgcaatatctaaaaataatatttacgtgtggaccttatggtcacatggcagcttgtaacattaacgacaactagcatggcggcccgcgcagattgcacggctagcattgttagattttttttctcatacaatagtttaaatattttcatattttattattgacaacataattttaaattcttggttgaactaacaaatgtgtgatatttttattgtattgtatatatgtgatagttatttataaattatatttctatatggactcaagaatcatattttaacattccttattttaaattttgaattttctttgttcataaattatattcctatatggattctggactactcttccaatattcattttttcttagctctgaattttagttatttataaattgtatttctatatgaactctaaactcttctttcaatattttttttattttgaatttcaattattagtaaaccgtattcctatattgactctagacttcttttctcaatatttttttaattttagttatttctaaattgtattcctatatagatgctggacttttttttcaagatttcttatttgttaattttgaatttcagttatttataaattgtattcatatatagactatgacacttctcccaatcttactttttttaattttgaattttattaattctaaattgtatttctatatggactctaacttctaattttagttttcctattttttaattccgaattttaattaattctaaattgtatgcttgtatggactctagtatactctttcaatattcattatttttaattccaaatttcagctatttttaaattgtattcctatatggactctactttcgaatttcctttgtttataaattctattcctatatggattctagactactcttccaatattattttttcttaactctaaattttagttatttataaattatatttctatatgaactctaaactcttctttcaatattttttagttttttaattttgaatttcaattgttggtaaagtgtattcctatattgactctagagttcttttttcaatatttatttttttaattttagttatttctaaattgtattcctatatggacgctggacttttttttttccagtattccttatttgttaattttgaatttcagttatttataaattgtattcatatacggactatgaccttctcccaatcttaatttttttaattttgaattttagttatttctaaattgtatttctatatggactctaacttctaattttagtttttctattttttttagttccgaattttaattaattctaaattgtaggcttgtatggactcttgtctactctttcaatattccttatttttaattctgaatttcagctatttttaaatagtattcctatatggactctactttttatttttcttcgattaacgtgggaatttctaagccgtgagagcaaacatggtagcttctttttctattactttccatctaggctcttttttcatatattagaatttttatttctctctaattcatgtgaaaatttttagtctatgagagtggtggctccttttttatttctatttctttattaagataatagattgagtttgccttcttgttttgatatcgtttcagctctatggtattttagagcatcagttagttgctattttcctgaaacacttgcttttatctcacaatttttttcatcgctaaaagtcggattcgtacagagtttcatcactattttgtacttaatctttttttcctttttttttgttgcggtggattgtggagagaagatttctagcgtactatttatatattaccatggcatgtaatttgtgtacaattcagattgcatgaatctgacgatgatttttttttagtctgtcttttattagtgtctcacacggttttcaaaattagtgtctgatacgttttctaaatcgaaagaaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatagatataatagattttagacaccatcactaatatcttttaatgcagtataaatataattttttttaactttgaggcaacatgcacaacctagacattccctccgagaatataatagactttccccaaagtgagtggttttctttgtgtttttgacaggttttactgaaccatcccaccagtaagccacggtttggagtggcggcgagtgttgacaacccgttggacttcagcggcgtggacgtgcggctccccatgctggtgtacatctcgcgcgagaagcgccccgggtacaaccaccagaagaaggccggcgccatgaacgcgctgctccgcgtgtccgcgctgctgtcgaacgcgcccttcatcatcaacttcgactgcgaccactacgtcaacaactcgcaggcgttccgtgcgccgatgtgcttcatgctcgaccggcgcggcggcggcgacgacgtggcgttcgtccagttcccgcagcggttcgacgacgtcgacccgacggaccggtacgcgaaccacaaccgcgtcttcttcgacggcaccacgctctccctcaacggcctccagggcccctcctacctcggcaccggcaccatgttccgccgcgccgcgctctacggcctggagccgccgcggtggggggcggcggggagccagatcaaggccatggacaatgccaacaagttcggcgcctcgtcgacgctagtcagctcgatgctggacggcgccaaccaagaacggtcgatcacgccgcccgtggcgatcgacgggtcggtcgcccgtgacctcgccgccgtgacggcgtgcggctacgacctcgggacgtcgtgggggagagacgccgggtgggtgtacgacatcgcgacggaggacgtggcgaccgggttccgcatgcaccagcagggatggcgctccgtgtacacctccatggagcccgccgcgttccgcggcacggcgccgatcaacctcaccgagcgcctctaccagatcctaaggtggtcgggcggctcgctcgagatgttcttctcccacagcaacgcgctcctcgccggccgccgcctccacccgctgcagcgcatcgcctacctcaacatgtcgacctacccgatcgtcaccgtgttcatcttcttctacaacctcttcccggtgatgtggctcatctccgagcagtactacatccagcagccattcggcgagtacctcctctacctcgtcgccatcatcgccatgatccacgtgatcggcatgttcgaggtgaagtggtcgggcatcacggtgctggactggtgccgcaacgagcagttctacatgatcggctccacgggggtgtacccgacggcggtgctgtacatggcgctcaagctcttcaccgggaagggcatccacttcaggctcacgtcgaagcagacgacggccagctccggcgacaagttcgccgacctgtacaccgtgcggtgggtgcctctgctgatcccgaccatcgtcgtcctggccgtgaacgtcggcgccgtcggggtggcggtcggcaaggcagcggcgtgggggttgctcaccgagcaggggcggttcgcggtgctcgggatggtgttcaacgtgtggatcctggcgctcctctacccgttcgcgctggggatcatggggcagcgggggaagcggccggcggtgctgttcgtggcgacggtgatggccgtcgccgccgtggcgatcatgtacgccgccttcggtgcgccgtaccaagctgggttgtcaggtgtcgcggcttctctcggtaaagcggcgtcgctgaccgggccatctgggtagggacgacatgagtccggatttgaatttgatgaatgatctcgcgggggtaataatccgggtgttcagatatatctcgttacgtcatgagggcggcagctgattatgtgctagtctactctgatcgagtgagacttgaattattttttaaaatgtgaagacttgaattattttattttattttatttgttcagtgtgatatgttggcattaaattcatggagaactttttttttctctgtgttgttttttcttaaagagtactcctatatactgctataaatatagatgacacaacattacaagtttaattaattaagtttaagtaccattttagtgtgttatatacactactagtcacatgcccatgcattgtaacgaatctaaaggaaaaccgatgaatgggtatgggttcacaatttttaagtcatttttaatactttttcaattcgagtaaaattttgtaatagaacttctttgtttcattatttaaaaattcaatacttttaacataaattttgaaacttttaacttaaaatttagaactttcaaattgaaattttaaaaacactaacccaaattagaaacttttcggctcaaaatttgaactattataaacacgtaataggaaaaaaaactttaaaatgttccatatatgttgggcctacaagtctgcagggccatggaaaggcctggagcagaggcatagatgcgtcaaataaattttccataggagtaagtctattttgcctttctcatctctggttgttgattgaatcacttccctcaatcacaaaaccgggtaaaatgactcccccatctttaaaaaccggtgcaaatcagcttctttggtggtttggaaggtgtttttttgctcatgtagcatattgaccatggttgactagctaagtcagcgggtgggatccacatgtcataaaaatctcatatacttttgcccctctcccttccccctctctcttgctaggcggcaaacgatggcggccagcatcgtggggccctagctcgtagccgctgaagggctagcgcggggtgaagacggcatcaagggctaagtgggagggtagggatgaggagcaggtcacccttgacgtgggaggatggaggtggaaggatggggaggagatcgctttggcatcgacagcggaagagagagaaggcggctcgagtagtggggagtggagtggggggtaggagcgacagtagaggaggagcgttgaggaaaggaggagggagggtggcagaatatagtgggaggaagtagtgaaaccgacgggtggaggcggagtagtggtcgcggcaaagaactgcgccacctccacgataggggagatggtgtagagttcacagttttgggag

SEQ ID NO: 63599 - DNA, 8976 bp, Oryza sativa
ctaacaggatatgggattgagccaaccacaaatttcatgcttcttgattgtgtgtcttcttcaatacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttactgtcatgactgcctcactccatagaaactttggtacattcatcgtatacatgagtaaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcaaaggacatatgtcccaattgacaatgttttagaatcaatttagcctcctcttcacttgtgctagctaacaaagcactacatagtgctttgtccgtccctcttctatccagataccacaacccattatgcctaacaccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaataaagttgccaagcactgttgttttcttcttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgttgagaacctctgcagcagccgtcgccgcctccgccgtcgacactgccgctccgcctccgctgtccgacgtcgccgctccgcctcagccgtcgacgtcgccgcagaacccctctggtcacaacgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacaggtgtgccaaggaagattattttcagagaagcgggctctgcgagctcatcctcgataggggaaaagagggatctgctgcacccgacagaaccaccggtaagaattgatacttttgatggctttgagtcaagagagagaaaaggggatgaaggtgtggatgcccaactagcagaacaggccaaccagatacgcgtgtcggacatgaatagttcccagcataaacccataaatactgataaggggctctctagagatttgattatggctgaaagagggggggagctgttgccaatcccttcaaatgagatgataccggctgtcagggatctgagcgcttatcaggactcgttggatgaaggctctatggatgaaacaagcagtccgagcaagaggaaaacaggcagtttgtcagatacaaagaagacaggcattgttcagcaagctttgttggagtacaaacagctagaggagagcacagctcaaagcaagaaggacattgagtccataggacggtcgctaaagagactcaggaaggatggtggagcaacaggggaggtgactggcttggaagctaccagcgctggggctgctggttcactggcgagacctacggcagggtcccgccagggacaatgagttgcttggcttggaactgtcgggggatagggaacccctcgacagttcgtgaactgtgtaccttagtcaaggacactagttcccagttagtcttcttgtgtgaaacaaggcagcgagttgagaaggtaagccgcctcagtaaaaggttgggtcttagaggttttactggtgttagtagtgaaggtatgagtggtggtttggctttgttctggcacgaatctgtcattgttgatattaaagatgtgaatgcaagatatattgatgcgtatgttcgtttgtctccgattgatcctgtttggcatgttacttttgtgtatggcgaacctcgggtggagaatcggcaccatatgtggtcgtctttgaatgcccttcgacaatcgtcaaactttccgtggatggtcataggcgattttaatgaagccttatggcaattcgaacacttttcgaaaacaccgagaaatgagaatcagatgaaggcttttcgggatgtcttgcagatctgtggtctgagtgacctgggtttcaaagggctaccccatacttatgataaccgtagggaaggctggaacaatgtgaaggtgagattggacagagtgattgtagatgatagttggagggatattttctctgaggcacatgttgttcatttggtttctccctgctctgaccattcacctcttttgttaaactgtaagatgaaggatactagcactgtacgtaacaagtgcttgcactatgagatattgtgggaaagggaagctgatttccctgaggttgtggcagatgcttggtctgatgcaggggataagggcgacctggggaaagttaacaaagctctagatcgggtgatggcttcactgcgttcttggagtaacaggaaggttaagaatataggcagggagtcagaaaaggcaagaaaaagactggcggctctgttagagaatggagctgatagttcagttgttcggcaagcttcagaccatatgaatgaattgttatacaaggaagaaatgttgtggctccaacgctccagaattagttggttgaaggaaggtgatcgtaatactcgattctttcacagccgggcagtttggagggctaagaaaaatagttcaaattggtcccctgaaggcaccgggccctgacggctttcctgctcggttttatcagaggaattggggtgctgttaaacaggatattgtacatgctgttagcaagttctttcagacaagcactatgcctgatggggtaaacgacacaacgatagttcttatcccgaagattgattaacccatggagctaaaggatttcagacctataagtttatgcaatgttatgtacaaggtggtatcgaaatgtttggtcaaccggttgaggactatacttgatgagctagtttcctgtgagcaaagtgcattcgtgccaggtcgcctaattacagataatgccttgctggcttttgaatgcttccacaccattcaaactaacagaagacagaatagagcaatgtgtgcctacaagctagacttatcgaaagcttacgatcgtgtggattggcggtatctggaaatggcattgaacaagttgggtttcgctcaccgttgggttaactggattatggcatgtgttacctcggtgagatactctgtcaaatttaacggaactctccttagctcctttgcaccctccaggggtcttcgtcaaggagatcctcagtcgccattcttgtttctattcatagctgatggtttgtctatgttgttgagagaaagagttgcacaggggtccatctctcctattcagatatgtcgacgcgctcctggtatatctcatttgctctttgcagatgataccttgttatttttcaaggctgaacaacaacaggcgattgcggtaagtgaggttctcagtgcttatgcagctgggactggacagctaataaacccagcgaaatgttctattatgtttagtgaggcttctccaccaggaatacaggaagcaattaagagtattcttcacattgagaaagacgaatttgaagaaaggtacttggggttccctactcccgaaggtaggatgaagagagggaaattccaaagtcttcaagagaagatatggaaaagaattattcagtggggggaaacattcctgtcctctggcggcaaagaaataatgatcaaagcagtcctccaagtgataccagtgtatgtcatgggaatcttcaaactgccagagtctgtgtgtgaggatttgaacaaactcactcgtcaattctggtggggatctcaggatggacggcgaaaaactcattggaaggcatgggatgtgctaatgaagtcgaaacagagtggtggcatgggtttcagggatattagatggttcaaccaagccttgctagctaggcaagcatggcggttgattgaatctcccgatagtctctgtgctcgggtgttgaaagcgaagtattatccgaatggttccctcattgatactgtttttggcggtaatgcctctcctggatggaaaggagtggaatatggtttggtacttctgaaacaaggattaatttggaggataggaaacgggaaatcaatgaaaatttggagagatccttggttgccgagggagtttactagaagaccaattacagtcaaacgacattgtcgtctgaaatgggtttcagagctaattgatgagaatgttgcttgggatgtagataaggtctctcaatacttttggaatgttgatgcagaggaaattttaaaaatcagactaccctatagggaaacggaggacttcatatcctggaaccccgacaagaacggccggttctcggtgagaagcgcctatcaccttgcagtgaggctggcatccaaggatgagagctcttcatcctcttcaatttgtgcaaagaattcttgggatttaatctggaaatgtgaagttccacacaaggttaagatcttctcctggagagtagccacagacagtttggcaacgatggagaataaaaagaaaaggaaactggagatgagtgattcctacaccatctgtgatagagaaagagaggatactggacatgctctatgtcgatgcagtcatgccaggaatctttggatggaaatggccaaggcaggaaatcttgtatctgacattaattcgatcagagggggttcttactggttcttggactggttggggagagttccagctgaggagcaccctatgattctcatgatcctttggcgaaattggcaggttcgtaatgatataactcatgggaagccggctgcccccgtgtgggcgtcaaggcggttcctggaaagctatatgtcaacaattgtccaaatcaagcagaatcctggtgcaaatttgaagaaagggaaactggctgttggtattgctaagcgggctcctgccccttgctgctctgtcaaggatgtccccgtgtcgtgggagaaaccaccagcggggtggatgaaactgaatatcgatggatccttccatccacaggaggaaacaggaggagtaggaatggttctgcgcaacagttcaggagaggtaattttctcctcttgcaggtttttgaacagatgccaggaggcgctagaatctgaacttcttgcctgtgtcgaaggacttggattggcactccagtggacgattctccccatcgtcatagagacagattgcttgacagtggttaatttggcgctttcaaaagaccaagatcgatctgtcttctcgcatattgtcagcgagattaaatgtttgctggaagatgagagaggagtcaccataaagaagatacagagatcccagaatcaagccatccatgttttagcttgtaaagctcgtggtgatcacatctctgatttttggttagaaaatacttgtagcataatatctcagattctctgtaaggactcctctggttgagtaatatatctttgctcttcccctcaaaaaaaaacaaacgaacttaaaatttgactcatacacggaattatattttcaaaagctaacgaactaaaaaaccaactcaaacacggatgagacgtaccaaaataccggcaaaaacttcttcaacttttataatagtagagaaaaatgtgaagacttgaatttgttctgcatgacattttgactttaagttctcaaagatctttttagcgaatttatgcatataaactttttttattatgcagatcaagatgagaacacatgatctatgtaccatacgtccacaagtgtactaattttaactatatggacactaaactctatttttaattttattatttttattctagattttaattaattccaaattcctatatacactctatacttttcttctaatatttatttttttaattctgaatttcttttactttttaattgtatttctatatggacactatacttttcttctaaaattctttatttttaatcccaaattttagttatttataaattgtatttctatatgactctaacctcaacttttaattttatttttttttctaatttcgaattttcattagttctaaattatatacttgtatggactctatttttcttggtctttgattaataggagaatttctaggccgtgagaactaacatggagattcttttttctattactttaataagttaatagatttgcaattaagccccgtaaaactatagaagaattcataaaattaactgcgcggcggcagggtacacggtggcggataccccctcctgctggcacaccgagggggaagctgcacgagatggtgttgaaggagcaggaggagagctccaccgccttcgtcgagtcccccctttatcccgctgacaaagctgggtccaagcctcggcatgtgctcgtcgcctcctcgggattctccgtcaacgcgagcggtgccgactccgacaacggcgaggaccggagcagcgatagcagccagcaggtcctccactgccatgagcgcccctcaccgccacgactcctcgccctcttcctcgcactcagtggcaggcggtgatggggtcgaaggggggagagagaagagagagaagggagggagcgagaaggaagaaggagcgaggagtggatgacgtgtgggtcccacgtgtcagtgggtccacaattttttgtgtgtgaatgacaaatgggtcccacatatatgtttttaactctaatgacacctaagtgtcatgtcaatgccacaaaccaagtcaacacggccacgtagatgccacgtcagcgaaaccgtcctccaaaaacactgagagagtcaaattgcatcggttttaatagttgaggggtcgagatatctagtattgtgattaaaggatacgaatcatatccaaatcttattccaatttaaattatggccttgctcggttgtacttgctgcagctagctacagctcattccgctgcaagcagtaatcgttggtcttgtcacttgtgtagttgtgtttctggcatccaatgaaatcggccaagctgtggggctttgaaactttcctcataaaaatagaactatgaatcttcaattcaaatttagcatattttggctggttattccggccggtgctgtcattggcttcgaactgattactaatattttgaacgaataatgggccaccaccttataataaggccttattgagaagcgcttcagtatagccttcacaaatgcatggcctagattgctttatgttatcatagactcacaggtaagcctctacggaaaaatcagtagtttccacatgtcatccttctctctactttcctcccatacctttctcttcacctttcctccgtctctcttacctacgggcgactgagagacagcgacaagcggtgatgcaaaggaggacgcggcagtgggcagcgcgatggcatggcggtgcagaagtcaatatgctctccacaaattcatcgatgccgacgcagaaggaggatggcaagtagacaacatcgagaggtgggggcaaagagggcggggggggggggaggg

SEQ ID NO: 63600 - DNA, 84239 bp, Oryza sativa
  unsure (1)..(84239): unsure at all n locations
cagttgtttgttgtcttgtagttccgtgcactatcagaccagctatatcgatcacccgattatcacaagcatgttcgaaaggaaatagtgaagcaggtacagcagatcaccttctggaattaccggtctttagtttatattactgtgctcatatgtttaaactgcaatatctttatcagatgccgtaacacaatgaatctgtcattctctgctctagttattgcatttttttttctccaggtgatgaatgaagaaacaaaatttcatcaatatattgtagttatatgctgataaactcctgttagagatacatgcattcttacccatgctgtttttctacttgtctagctcaaggcatgtaactctttgtatgaaggttatgttccaatgaaatataaacattattgcaagaagatgaaaaagtatgtacttctgaggctgacctagcttcctcaattaaaacagttcctgaaccttttgccttctgtaatgatggcactgaaattttgcctattccagatctggtgaatggggcgaccatgtcacattgcaagctgctgctgataaggttagttattttctttgccatcatcctttttctcgtctaaattcttactcagctccctgcagtccaacaaaagttacagtaacatttgtacataattggtactatttgttgcattttactgttgtacagaactgaagatgtccgttcttttgtttataacaggatattcaaatataatgttaatcatttattgactgatcattctatgattatcactctctttgtacagcacttgacattttacatcgtgttcactaaaatttatactttggcaacttcaaactaccgccatagttttatgaacccttaaagaagcctaatgtttttccttcttttggcagtttgctgcaaaaatatgccttctaacatcattcagagacacatgttttgttgaaattgttccacagtatcaggcaccacagagaggtaaggttcaaatccttgtctctactagtaacaaaaactttatgcatatgtacatggagaatactaattacagtcagtgccattttgcataatgcagttttctagcttatatacccctgcatgtggatttgttgcacatatgcttatacacatcccctgattactgcaaacttactcattgcataactggaaacataactaaaaggataaaatcagcttgttgctaacccctgaagcttcgtgtttttcagaaatttggctaagtttctggtcggaagttcactataactcgctatatgatgctcgaggtgagaaaaaataaatatttctcatttcttatagtgcgctatcagatttggtgccttgtactgttatacatccctttccctaataagaggaaaatacccattactttgcagatctccctagcaaatacaagcctaggaagaagcactggttattgttttagtaaccacgcgggagctttgctttggacatggattttattgcttggccttttggcccctcctgatagttggagcttggaaccctgaagagtggaatcctctgtggttctcttccttgaagcgctgaatgggtttgccggatgcactcctcaccacagtacatacagcattagttatactataatactgagagaatttgagattgcttccttgtgaatatatacccatagggaaattactgacatccatgttgattgtaaaccatatttgttcattggtatattctgtatacattttataggctgctaggtctcttatcattttattcattccattttccccggacaattcatctgatttcaatttacatactgaatgtcttttgtcagtatctagtaattcaattcatacgccttgtattatgtgccgagtatatttttgaccgatccttatgcatggatgcaatgcaagattagtagttgaaccaactaaaccaaagcaatgaacagagccccggcattgaagtgagtaaggccctgtttgattcagcttaggattattataatctagattattagaaataagctgaaaaaaatagatagcttattatgatagattattataatctagtaatccactctaaatgtgcttattttagattattgggtggctaacagctaacaaacagcttataatccagagaaacaaatagctcacagcttattttatatcggtttattataattcactttacagtaatttggttcaataatctatattacaataatctcaaagagagcctaaatctctgtgagccttgtgtttagaatttgctttagggggagcttcgcaaatgtctattgaagtaggttgttgaatgatctgaacgatgctaaccgcacaactagactaaactgagatcgtgggctgtctgtagcacatcctaagttccaaacttgcaagtatttcgctctcaccctgttcgttttggtgaggaattattctggactcaaagttggtcgcttttcgtgcaagaaattctcactggtattgttgcttccccgatagcaacttgagatgaatatagccgggtcggaaaggaatcgagcatgggatcctgtttgggacgttttgatcctggtgatggtgtagcttgtgtgaggtaaaaaataataataataataataaactcgaagcacatctgcagttagtaatgctagccttttgtgagtgggaaagctagaaaaacttgcaagcatagcccatgggctatggcctatggcccatatcatatggctgcatgtcagcatccaaatcaagtcacaaatacaagccctcgcaatttgcaaagcatatgcatgcgtagctacccctttatatactacacacttgtaattaatcttgtacgcagtattatcatcccatatatatatatatgaatatatctacatcatacaataacgacataggacaaaacaaaaggaaaatgaaaaacagcgatcctactcatactctggtagtagcaccaaacaattccggtgtcaaagctaaagccaagcgcaccttgtcgtcaagacctcgacgaaaaaccaggcccatcatcccagagtcacgcacgcagatgcgcgcagtcacgtagtcagcaactccggccccggccaacggcagccaaaccactttaatttccattccaccgcacatacaggggatacagcacggtcgccctccccttcccccacgcgttcggctttcgcgcctctatcggcgtcttcggccggccggcacccaccacacgcaccgtcgtcacatgctgttttacatctctgcaggcaggacgaccactgcgcgcactgcgtcgcatggcagcgccatccgcgctccacgcgtggaaggcgaacgcgacagccgaagtggccacacacgcgcacacccctgatgatcacatctcagaccgtgcgtgtgtttctcggtcaaaacacgcggttcatcgtgcggatccgtggactccgggaggcagggagggagggtggccgccggcgagcgatcgatccgcgacttggcgtgccgggcgggtgggcgggtgttggtcaaagcgtaacacggtcatcagtcatcacgaaccaccactggtaaagcttggggtttggggggccaacgcaacctccgtgctgccgcatttgaggaacgacgagaagacgcacgtaatccagaagtagtggtacagtcatccagttgcttggtctcaacatgggcataacaattattggagcacaggatcggtattatttcagctaagagagttggatcttgtggtaattggagacttggagtatatgtactccaaggcaaatccaattgctttggatggtgtccactggaaatccagccggagggccgcgtcagaatcgccgtagtacgtcaattgagtttttaccgatcaggtttacccttccatgtatcacacatttaaacggaccaacacatccacatgttcttttttttttcttaccgtattttttttttaggaaactctagcggaaagaaaacaaaaactaagaaaaggtacagctaccgccgttcaagtgaccacgctgatggcatccccatcctgcaaacttgcaaagattctaattcgaatgtcaaatacaatccaaatcagcgttgccaacttgaacacggaagtgaccaaactatcttctcatctatatcttgttcatcaacccttttacaatctctcagacaagagcttaaagaacgaaacatgatggggtgtactgagtagcacgtgcacacgaaacagtactaaaatgctccacgagaaaattcattcttgactaacgcaatcatgcacggaaagatggacagatcaagacgaaacctaacgcaagtaacgtgaaacccagggatgccacagatgttcaaagctccgagtgtacagcgtgcataaaacgtcaaatagtcacttgatcagataagaatcgtcattctttttaattaaaaagaaacaattcctgctgattgaaggaccgcaggatcacacatcgctacatgaattggaacaaaaactttgaccaattttacaagacaatctttctaattatgcctttgatcaaggcattttcgatgttccatgcgcaaaaaatctcctgctgttcttgtacaggatcctcgcacaactcgacccctaatcgttagtgcgcctctacactccctttctgcactccaaagcaaagcagagttttgacccaaaccaatttatgttcagaataacttcgatggtggccgacacagccgaagcagatttctgaaacgccgcactttcgaccatcatgcgtggagctttgggttgcagcggccatcatcagctgctgtcatttctcatttgtatagcatctcgtctgactgtaactgtaactgtaaccccctttgttgtctctgttcatctcaagaacaacacctccatcacttcacagttcacaccacacctctgaagataattaatctgccagctgaaccgtgtaaccccggacaacggcgacaagtgaaccagtgcatttatacgccggtgccaaactgccaattatggacagggattgtgttcgtagaagtaggtccattttagactgccccccacttgctgccaaatcttttgaagcaacggtacctgcggcagatgagatcgatcggcaatcaaaccattcaatccaccgcaccgaacactgttgcttccaccgacaaaaactcgcgtggcccggagatcaccgatgcactgaaccgtggcatgaattttccatgtaacttgggacaggatgattgttgttagctttgcttgacgccggatggtcggtttcggtctcgccatagctgtggttcgtgtgacttcaggagaggaggacatggacggaggcgttcttggtggcggcgcagacggggcaagcgtcggcggcggcctcgcaggcgccgcacaggcacaggtggcggcacgggagcagcagcacggacgcctccgcgacacggcatgccttgcacgacgtcgccgtggagaccgcgacatcggcggcggcggcgggggtctcgaagcagcacgagtgggcgtcctcggcgtcgccttcccccgcggaggcggcggcggcggcggcggcgcagggggactggaggaggagctggtcgagcgtggcgcggaggccggcggcgacggcctcgtggctcttggcgacgcccatccacgcctgcccctccgcgctcacctggcggagcttctcctccagctccgcgttgcggcagcgcgcgcgctccagctcggcctccgccgcacgcaccctccccgtcgtggcgcgcgccgcggccgccaccagcgcccggacgtgccgccgctgcgcctcctccagccccgcgcgcatccgctcggcctgcacgaacatccaccaaacaccgacgccgatcaaacaccactcaccaaacacaaacaggggagtccacggttaacggagaagccttcttcccatacctcgagccgaacgagcgcgtcgatctccacgccatggtggtagagctgcgaaagaaggccctgcgagattccgcccgcaccgtccatcctcctcccgctggtggacgccgcgccggcgcacgccgccctgcccgccacatccccgaagggcaagatcccctgcagcggcgccgccatcgcgtgcgccaggaccgcgcgctggtcctccaacagacccgccgccacgcgcggccgcttcctctccacgaacccgtactcgccgttgtcgccgccgaacaccaccgcgcccccgatcccttccaccgccgccatgggcggcgcgcactcgccggcgagctcgtccaggaacagggcgccgccgctcgccgccgcgtggaggtcgtaagggaaagcctgggcgaggcgctgcgcctgcacggccatggccagcgacacgatgcgtgagcgcgagctttccttgatgagatgagagggcggagaaggcaaggaatggcgcgcgcgagttgggtgagaagcagtggagtcagtggaagggatgcgtggaaacgaatggcgaacggcggcgagcgttttatatgtacccgctcctacggttggggaagcagtggctcactggcctgtgaagagaggcgttgtgggtaagacacgtattacacgctcctgggaaggacaaagccacaaaaggcgtgacaaaaattcaatatgtgaaaatactagtactacggtaaggactactccctccgtcccacgataaaagggattttaagtttttatttgtactttttgatcgcttgtcttgtttaaaaaaaattaaaattattgtttttttacttgctttattatccaaagtaatttaagcacaacttttcgttttttatatttacacaaatttttttgaataagacgagtggttaagtagtgcaaacaaaaactaaaaatcccttatattatgggacggagggagtaacttggtataaaaccacggtagtacaaactaaaaaaaaacctattttattaaattctaatgaaattattttttactttacctacttccaatatgattattagctgatttcacaatctccaatgcaatgattactaaaagatgaatttattttgagacaaataaaggcatgtaaagactattgtttcaggcttgttttgacacggtttcaaatgcaaattttttttgaaagggatatttctaactttacaaatttgtaaatctagatatgtgattacattaatagtatctgaatgatttttttttattttgaaagaaatataaaattttcgagcactttaatttaatttacaaagtatttatccgatttaggatatgtgtgttggaagagtgtgtactggtggttatatacttatgtacgtgtggcgtttgtcttgtgtaatgaaaacgtctcaggaaaaagaaatagtgtatcctgcctgttatcttggtataatacgccttacctactagcagtatgtgtgttcttttttttcttttgagatccagtacatatgtacgtgttcttgttagccgatcagagtacgctcggtaggaaacaggtgagcggtgaaaatgccgctttctccctggaagtccatggcatagcgcccgccccagacactttctaggcgcgcgaggtcgacgcgatcgaagcgcttcattcaaccggcagcgccgtaagccacggagatgcgcagtttaaggacttgtttgtttggagagctactagctattataacttctctcggaatctgaagctccctaaacagcctatcttttgattcagattttgagaagttatagttttagattttagaaaataacttctctggattctgaaactaaggcctacgctgcgcagcactgtgcagcgtcttcccagcccccacacctcacggctcgcaaattaatcaacggaatcatggccagggaggagtggaccgtggaattcaatggatgggcacgttgcgtttgcattataaccggatctagcgttgtctgatgagcgatctcttaactcgtcgtgaccccggaaatatttagtggttaaccacatctctgtgctgcccgtgccaatacagctttttgattaattacctttggcggattgggtttactactagttcaggcgcgtgcatacctcattacagtagtaccttgccccccttgtctcccacatgtaggtctgacggttgacggatccgtcgaagatctagctagcacatctccagatctagaactacaagaacggtgatcgattaatttccgtaacagagctgaactagcagcatatatagtactcctatacgtaccccgagcaagcagccgtacgtacagttgcagtgcaaaacgatccaaagacaatctgcccaccgtgacagcagcagcagcggcagctatacgtacgtacatcgcacgtacagcgcgcgctgcggcgtacgcagtccgtgcttgtcttggcaccgatgaagcttagcgagatactccgatccaccacgcacgtacactgcaccgcgcgcgcaggctgcagcttgttgttgtacgtcgtcgccacgcgcgccattatattgatggctcgcaccgaccgaccgaccggccggcacggccctgaccgtcgagccggccgccggggaggactggctggtggaccgcgcgcccgcgcgagctgcagctgctgtacccaactagctactacccatgcatgcaattgcatggggacacgcattaagattcgagcagccgtgcacgcgagccgcgtgatcaccctgcctgcaccctgatatactgctgcctctgggcctgcctgcctggccgtgcacacagctgcatgcaaaaacacacagtatatgtcagccgtgctccagtaggcgttagcgttacattacgtacgtaatccatgacattgtcaatatgctaatgcggtaatgccgtattactgtcatctgctaactgcgatgcatcatgcgctgtggcgctaccacgtagtagtacggtgtacgtgcagcgcgagtacgtcagcgcctacgtctccggggggagtcgatcggcgaccgactgatcgatctgatcgcgcgcccgcccgtaatgaattcgatcacacggtcggtggccccgccggcctgggaaagctaccgcaaattaaagcccgcccacatccgatccccctttcgtacatactccctccgtattttaacgtatgacaccattgatttttcgatcaacgtttgatcattcgttttatttaaaatttttgtacaaatatgaaagtatttatatcatgcttaaagaacatttaacatttgatgatgaatcacaataaaataaatgataattgtataattttttttgaataaaacgaacagtcaaacgttagataaaaaattaacggcgtcatacattaaaatatgaaggtagtaatacttatacctgcggctgtccaccagaacacacggactaaccgatcaatataagcatgcacacgcatcatggatggatatatggattggtgtactgcgtgccccgtcgtgcatgcattactgcgtacgcgtacgttcctagtagtcgatcgtagcgcgcaaagcatggccagatctgcgagtctaatggcaacacgcatgcacggccgtcggggtagagagctatagtatagtagctagcttacataagctatagccccatgaccacatcacagtaaacgtaccacatacttccagtgaacagtgtcacatgccgtgtggagtcacgtatatatgcgcccgcgtcgtgcacagctagcttaacagccgcatatatatacatgacacatctatatggcagctgcattgcacagtttcagcctttcaggaccatggctcgtgctgtgttggtccggacggctgtatcatgcatgcgcgcagtaagcagggtccctgaacctgaacgtacgtacggatagcgctgctgccctatcgactgcacgcatcggcgcgcgcgtgtgggcatatgcatccagcgctttctctgtttacgctgctgaattttttatgtttcgaccctttcttaaaacttattttacaaataaaccctttctctaaaaacttattctaaaaatggtccatttctcaatgacaataacccttgacaccaaggtctaaaaccaaaaatattggtgccaacaccattacccccctagcagccgaggacagatttgtaatatatttttttgagaaggaccattatgtaattaccttttcttataaatagatcctcagcatcatggaggctagcattgaggtctatttgtaagaaaatattttagtttttaatcatttttgaaaaagaatataaataggtcctcggtattagtttccttggctcgacccacttcatatgagcgacttaggtaatagggagtgacgagggtgtcgacgccaattaatggctttgatgtcgagaaagattgttaatttctaaaacaagtttttcaggggattatcataaaataagtttttcttataaaaaaaatccaggttttcctgtttggctcgtcgtagccagcgctagatggtccaagctcgccagtcgtgagctctgtttctgtgagctagcgctagggcacggcgccgtgccagtccatgctgtgtacgtacatggaataaccgtacatattgacatatcgatactcctacattgcgtgatgaacggtcgtattcaaaaaatctactgctccctacatttcaaaatgcttaaaaaagttgactttttagtaaatatttgaccgttcgtcttattaaaaaaatttgtgaaatatgtaaaactatatgtgtatatgaaagtatatttaaaaataaatcaaatgatatgaaaaaaaataaataattacttaatttttttaaataagacgaatggtcaaatacgtactaaaaagtcaacggtgttaaatattttgaaacggggagagtgctattattattggatatgctccgagcagtgcctagttaaccaaacaatatacttggtaaaccgagcacacgaattttacattattttttaaactgtagcaatgcatcatagagcaaagtgaatagtagtgcctcagtcattaatagtatttgacgttgggagtataagcttaatgacgggagataatattcggctagttaaacaaaaattgcatccattggctattttttaaaaaattaagatacatagtttatctcatttgtgttatacgcttttcaaactcgtaagtatatataggttgttttaaaatacaagatacattcattttaagtttaaaaaattaaaaacaaatttaattaattatgcgatgtgacatcccttcaaaatctctaatactatgggaccggggagttgcaattttctcattttatgtttccgtatttaatcttcattttaagtgaactcacacaggcctggaacatgatgcaattaacgacaggttttttttttttttttgcctcgttagacttgagcatggactagcaaaagggctcacggatcacggactcaggttgcttgacatcacaaccccaggaggaggttggcagccaggtcctctctcttttctctctcaaccttttcggttgccatcagatcatccgtacttcccccccacaggcacaggcacactgcaaatgcctgcccccctgcagacgacgtaccagtaccactgtggcactgtcccatattattgcaatcgatgccaacgcccaagtcgaaggcatggcatcacattggcatatgcacccccccctactccaccatgcaactctcgtctctcaaggcgcggaatggccgggccaaggaggagagctggcagatcagatccacgcatggtgcatgcacttctgcttcgccctgtcgtttggtgagagtagtaaagagaaagatacgctttcacttttctgtgatgaggagaagggggagggggctcatcagggcccaggtttgtagggggggaggaggaggaacagtctgcgtgatggcagacgaccagatactatcgctgcttgctgctgttgctgccgctgctttgctgttgcccggactgatgatgcgtggtttgtttcagatggcttgttgcgaggagtaaccaacagtggccgtttggggagacgggaaaggtttgtaaaaaaggctgtgcgctacgcctgctgctacaggccgaatttttagccagtaggagcggtgcggcgggcacaggcatgcgatcgatgcgatgcacaggaggagcagcagcgcatggttcgtcctgctctgttccaactgcgacatgcgtagtgcagtgataggactaggagtattacatactgtgtgtactcttctcagtattttttaatactagtacagagaaaaaaaccttgctctagggatctttgcgctggtaaactccaaagaaaagtcacaaaatactccatacggaccgggaatcccaggtacgccgtacgcgcacacgacggtctgcacatttcataaagtggagtgagtgcacatttcataaaaatacagctactagtagctaacagtgcttaattgtttcatgacaaaagctatacacgaagccggtcgcggaccacagcatcacgtcctgacagcgaacctcgtttcctagtaaatcaatacactattaacttatcggcagcgggacatctgcaacctgtggtcctccagtgcttggagtggcatctagctaccgggacctgcgttgcacgtttcctggcgcgccatgaaccatgccggccacaccaaacacgcacggatggatatataaacaactggggccgcacacacacgctctgtctctgtctctctctctgtctctctctctctaatttcttgcacgatagtataaaaacggacggtaacttgtgggggccatgtgagcatgcgacgggctgaatcagcgctgcatcaaagacgacgacgacgacaacaacgtcaagggggggcacggcgagcgacgacagctagcctagcagcactaccggataatggagttggaatctgggcgccggccggcacaggcaggcaggcaggcgtgcgtctccggtcatcacccgtagtgatggatggagtagatgatggtcagggtcaaaagccgcattgagatcgagagacagatgcacgcttgctcatgcacgggcacgataaaatcataagaacccccgctccgctgatgagtgttaggctagctgcacggcctgccgccccccacgcagtgcgcgtccaccagcgcgcgcgtcaggaaagccaccatgtagtagtatgggtttggtggcgtgtgcgccgtgccgtgcgctgcgcggtggggcgtcgagccccgcgcgcgcgcgcgcgctcgcggccacacgccgcgggtgccagccttttcggtggcgcaggcagctaccaccccgtgatcatccacgatcaaaattgttcactcaccctcacccgtgccgttccacaaatagtagtgctccggtatccgtatattcacaattacaccttgttcgattaattctcttgagagaaggattggatgggatttatttcacacatcaatcctctcaatccctccaaaccgaacaagcccttacagtgaaatctgcttcggattttacataatccggactatttagaccggatcaaaacacaaaccccaaatttcaatctaatctagggttcttcagttgtatctgtagcgcctagttaaaaaccactcgaattttcaagttaaatttttaaaaatcaaactaaattttaatttttaacaaaatttatccaaaattcattggttttattggtttacaacagatcccgtggaatccgatgaaaccactcatgagcggattctaatccaacatagggattgtgaatactatgtatagtccagttattcagtattactccaatattggctactctctttatctcaaaataagctaatttttcatgcatctcacacatatctctactgttacaaaaagagatgtgcttctatacttttttaaaaaaagttgcacgaaaatcaaagcacatcagtggctgagattaagagggattaatactctattcctcattagcgaggggtattttcgtccatggaattttgagccccgtccaactctgcagcaataccaagggcctgtttggtacagctcaaactcctaaatataacttcaggagctaagtctggagtggagttgtggagctgcctaaacctagctccacaactctagtacattttgtgagagagctccacctaactccactcctagttctggtggagctgaaactgtttggctgagctccagctccaggaggggtggagctggagctggagctgtgccaaacaggccccgaattaccaatggcgacgccgattcctccacgaccacgaccacgaccatgaccgctagtctgggatgctctctccttgggtagcgccgctcctcagcctcgcaagcaccgcccgcgcttcccttgcctcgccgcctcccctccctcttcctcccctcgcagcccggccggcttcctcttgcaaacagcgccgccgctctgccctcttcttcctctcatcacgcggtgcagcacgacgctccatgcattttgtccatctcacaactagccagtactcataaacaagtacagtatatatctacatgcatgtctcccccgttcattaatttacacagctcaccaccatcacaagtcacatcaaacttgctgttgcagctactttggttcaattgattggagacagaaaaaggattattttgtgttatttcttctgtttaaactttggttcaatcgaattgcgacttggccttaaatgagtggtagatcatggcaccggatcgagaagctgctgcagctgtcgttggggtggcctgactactgccgtcacggtggtgtgctcgatgtggcggtggtggccttcacgttgctatatatatagtccacgtgctcgaggctgatcttgttgagcatggcggcgacgatcttcattgtggcccggggcagcatattattcactggagctcccgctagctcatcgtgttgcgagcgaactgccgactcaaatcaccacgaatcgatcaatccatcgatgggatctaattagggtgttctagcggggtagggaggggaagcgcgcgggtggcgcttacgctgcagaggaaaccagcgggtagcaacgctgcctgacgaggagacaacgatatcgtcgtgggctggaatttctatggacgaagacgaaagtacccctcactaatgaggattagactgttaacccacttttaatctcagccacttatgtgctttgattttcgtgcaatttttttttaagaagtatagaagcacatctcttataaaaattgaagatatttttattaatactttggtacatcattcgtgtatgaatcggtttttaagttcgtttgatttaaaaatacatatttgtatttaagtcgggttttaaattcgtttgcttttggaaatacggaaagagttgtataagatactagtatctctttaaaaatatcgcatgctaacttgattgagatgatcggactcctaattgcagctcatgattttttagaaaaaatatatatccaagcgaatttctacagtgaatatcatcttaactcaacctaccatataacaataataacattaaaataacattcacccgttgtaacgcacgggcatttttttcctagtcaatacaaagctaaaagactaaaacaatcgtactttatcaaatcgcacaataattatttctttcatttatctctgacttttaaaaaatctgattaaatgattgctaaagaaaatagatttatatgaaaaacaaacgggaaacgaaaaaaataatcttattctcaaatggaggaagtatgcagcagcgagctaggtgacaggtaaactgtagacttaatagtggaatactaacacttatcggtatagttaagtaaaagggacataatgaaaagatttggcccgggaggcccgaattgcccataagggccttgaagtggtcattgcaacgatcgacttgattctctctcaatctctgttcatgcgatcaattcgatggttgctgcaaaccgattaggattgactatcatgataacgatgcgatcgcctctctctaatttgaataattcggtggacaacttggatgagacgtcaagtcactaatcctcatctcatcactcgataagatgatttgttgtagtcaatcgatcgtgatgactactatcggctagctactccctccaaactcaaccgtacctctcggtcgacgcaagtgtcggtcgtgtccatgtcacaaagtaattactcccctccgtcccaaaataagtgcagtcttgcacatattcatgtttaacgtttgaccgtccatcttatttgaaaaatttttatgattagtatttttattgctattagatgataaaacatgaataatactttatgtgtgactaaatgtttttaattttttcacaaatttttcaaataaaacggacggtcaaacgttgaacgtgaatagtgcaaaactgcacttattttgggatggagttagtaagcaacttggctgccaggttttttgtatgcactttgtcaggcctatattattgttcagagtcatacgaagtacaaaacaatgagagctcctcccatcgatgtcatctactgatcgacaaagacggatgcgatgccagtgccgtgtctcaacctccgtggtttctttgtcactttcgcgctatacttatgtcctggcctacggattgatgattaagatgtagctttaagtacccacgtccagtgtatagggtgaaactgaccattatttgtgtagtgtatttatttttaaagaaaatgttgtgtaattattagtctaacataacattcagacaacgaaagttacctgagcatacaaacacttgagagtgccccaaatgcatatataatgtctccttttttgcggggaatgtataatgtccttaactatgtgcgtatttatagtgtgctatacagacaaggtgaaaatttgcgtaggactttacattatcatgaccgtcatatgaatacagagtgagcgtgtcacacagattatgctgacaataataaaaaaattgtgcgtgacaagataatgatttaaccatggcttatgtagattgatttgagagaaacgcccatagaaaatattctcctcaattgaattaacctatcctttactagacaggggacttacgtgttgattggatatagagacacctgtggcagatccataagtctctatctgtatggccaaatcaataattcaagtcgcacactcccataatccaccttcttttctttcgtaaaattaattttaactatttgtattatttgtatcacaatagttcggagttgaagagaagtatctaaatgacatatcttattttagaataacccatatttatagcaataaaataccacaacctacctatatgatataacgatacactcagagccgtatagatgcaaactacaactaaactatgttattttcgtcatgtatatctcgatatacctcaagttgggcaactcgtagggattttctaattttataaaattaaagcactcatgctcatgctccggggcctccccctgccacgttgccatcacgttaagcagaaaaaggacggcattaatcaccagtatacagtatcaagacgcgaataatcacagacggaaaagtatacttccacatcaacatggggagatatatatatatatatatatatatatatatatatatatgacaggtactcgatcccctaacgctactaatgaaatcaatgaatatatagctcgtcgttccaccacctttgattgcatatcaaccatgttgacgtgtgatcgacaagctccgacaggcacacgaatggaccaccttttgcacgtccacccgggattggacgcgttccggtttctctgcaccgcacacggtggattttgcgtggttttcgcagctttccatcgtgtgtttaaagactttgggagcacgcaccaagtcattagctggagtactcctctagctcggtcatctcgatcaaaggctgaagggtgacgtgcctagtcaatcacacttaatcaagtcattcacacctacggataaatgcatgcttatgtgtcttattactagtactatagtagctttttggtttggttgataagagaggtttagtaggtgtagctgagttgtagtttgtcagacccgtcaacattagtatgcgggaagggatcgattggtgaaagtgaaaacagtataattgtcgtatcgttttcgggcttaactggctgctagtgcaagtcgctgtatttcgtttttattgtggtagctgtcataattgtagctgaaagggcttgttgatcaataaaaaaaggtgtacataggcatgccacgggtattttttccattgtgcttccttttcttgcggtcatagtgttgcgaattcaacaatgactgtgaaatgtattgccgtatcgtgatattataaggtgtacaaatgcaagaaagagaatgatggtgaaagtaaaaaaaaatcattcttttaggaggacaggaaacatgtaaatcatgtccacatgttttgtagaatagttcacccaatagcggaatatatattttaaaagagcattatttcatttttttttgtctagaaacctatcttgtaaagaaagtgaaacgcgacaaggatttgatcaaatttgaggtgtctcgggatttgttactcatccatataatatatcaaactaaaacatgaagttgcgaatcgtagagcacaagagcaccacaataaggaacgacgaatccttaaattttctatatatattttttaatgaaaatttgagtaattgttataatgaacctttttagtatatttttaactagcatggtggcccgcgcagattgcgcggctagcatcattatattttctctcatataatagtatatatgttttctcattatattattcaaatatattaaaatgacaacataattttaaattttgcaataactttacaaaactactaatgtgtaatattcatattatattttatatatgtgttagttattaattatttttaatattaaattttagttatttgtaaattatatatattcctatatggactctagactcgtcttttaatatttttttaattccgaaatttctgtaaattgtatttctatatagactctatgctcttcttccaatattatttatttttatttctgaatttttattatttctaattgtatttctatgtggactctaaattcatcttttaatattctttaatttttaatttcgaatttcagttacttctaaattgtattctatattgaccttaaactcttcttcacatgtttttcttaatttcgaattttagttatttgtaaattgtatttttatacggactctaaactctacttttaattttattatgtttattctaaattttagttaattttaaattcctgtatggactctatactctacttctaatattccttatttttaattttaaatttatattatttcctaattgtatttctatatggactctatactctacttctaatatttcatatttttaattctaaatttcagttatttcctaattgtatttcaatatggactctatactctatttctaatattcattatttttaatttcgaatttcagttatttcctaattgtatttctatatggactctatactctacttctaatattccttatttttaatttcgattttcagttatttcataattgtatttctatattaactctatactcgacttctaatattccttatttttaattccgaatttcaactatttcctaattgtatttctatatggactctagtcttctcttctaatattccttattttttaattccgaatttcagttatttcttaattgtatttctatatggactctagtctcctcttctaatattccttattttttaattccgaattttaactatttctaaattgtatttctatatggactctagtctcctcttctaatatttcttatttttttaatttcgaatttcagctatttcctaattgtatttctatatggactctgctttttctttttctccgattaatgtgagaatttctagaccatgagagcgaacgtggaggctcctttttctatttctttaataatataatagattgttagattcaaccttgtcctacttttcagttaaagtaaacatcctgaaaaaatttagtttggttaaccatcgtaagatgaaggtattcgaatttaattttaagttttaagacattcacttctcaatcaatcacaatctcttcacatttaattctacctactctaaaacttattttttagatggaggtagtacatttcataaccgaaagcatgaaaacagtctacccaaaatttattcaaccttgaactatcaagacctttttatttaaactttaccttgtacaatattaaacttctggacaacatggttttctttgtaacggtttttacaacctgcacaatatagagcctgtttggaggggtagccagcttctgagaatctggaaaagctgggtttctagcttctgacttctaagtcattttctgtattatacaactacagtttcctagaatttgaatcaaaagatagattgtttggtggagcttctaattctagaaaaagttgcagcagctagaaactcctataaacagacccgtagtactaacgatttggtacacattacatgtggccctaacagttttttctccaaaagaacttttggccaagcccgcatcttgttcgtggcccccacatggctcccatctcccggtactgatcccagaactgaacacggacaccaccaccaccaccaccaccaccacaccggtcgcttggaccacagcaccacaccacacgacacgtcttggcaccacgcatcgccatcacctccctcccctgatccccccccccccctcccccctcttctcatgtgcgtcgcggccgttgcatcatgggataggaatgatacgatcggccgcgcgcgcgcccagcgaacgccgagaaaaaggcgagcggaaacgacgaaagctacacgtacgcgatgctgccagagcttggctgaggcggacagaatcggccacactgtgcgtgtgaacggtatcgtcgggggcgacggacggaagcggcagcggtcgtcgcgtcgcgccgtgccgtgatctgacgcgcgcgagcgagcaccggctgttggggggggggggggggggggcccctttagctttcgcggcgacggggacggacgggggcaaattgaaaaccatttgtggcttttgcgtctcgcgtacgtgtttctgtgaagcgtgggaactactaaccattgtggcatcatgggcgtccacgggccgcagcgcgcggcagcgacgtgagccgatcgatcgaccgcgagcgcgaggctttgtactcttgccactgtggtgtggtccgccactccgccgtatggagaatagtaacatttgatctgttagttttcaatagggtgatgtatttcattttgttttcgcaaaaggaaaaagaaattgtttttcactagcttgtttcttctcgacaagtgtggaaagtatctatgtctcgatgtgcaacccaacattgtgaaaatgtttctttttctagataactattcaaatcgtaaaataggttattattactgctgtttttttattattactactattattattatacttatcgtgccaagatagatatgccaaactttataatttctggccaagattaaaatttatgttgtcacaactctaccggtggaaatatgatacacgagttttatatcactcccggttcaatatttaaaatattacaccgtacaaatcaacgcgggaaaaaaatctacaggttagtttagtttagaaaaacttgaaaagtagcatttcacggttattaaggggtgtttagattcaggggtgtaaagttttgacgtgtcatatcggatattatataggatgccgtatagggtgtttaggcactaataaaaaaataattatagaatctgtcagtaaaccgcgagacaaatttattaagcctaattaatccatcattagcaaatgtttactgtagcatcacattgtcaaatcatggagcaattaggtttaaaagattcgtctcacaaattagtcgtaatctgtgtaattagctatattttagcctatatttaatactttatttaggtgtttaaacgtttgatgtgacagcgtgtaaaatttcaaggcgggatttaaacagaccctaaatttgtatttttggctttttaggctatttgggtcgaagctggcttgcttggtcgggctaggctgctctttaacgggcctagtgcctctactccgtcccaaataagcacagttttacaccgttcatatcaaacgtttgactgatcgtcttatttgaaaattttttacgattgatattttaattgttattagatgataaaatatgaatagtaatttgtgtatgactaattatttttattttttttaaataagatgaacggtcaaacattaaacacgaatatcacagctatacttattttagtacggtggtactgctaaccttcattcattcttcgccgggaaactgttcgttcattaattcacgatcttcagttgcggacgatgttctacagccttgtggctttccatcaccaaggtgaaaatggactgttgttttctctgtataatactgttggtttttgttttgtcagagtgctcaatcaaattgaggtactgtacgtagtactatactccactcctccgtccgtggagtagtcagctgggctcatgcagctgtgcgtactgccacgtactgacgacgctgtcgacgtgtctggcccggtcgttggatcgctggcacggacgcacgcaattatctgccctgcaacgggcaccggtgtagtactactacctgccgtgtggaccagaaattaacaacgatttcgatgccgtctcagctagtatgcggatctggcaccgcagcagccgcagcagcagcaagcggcgccccaacgcgacaaaaacaaacaagctagctgcgcgtcacatgtgccgctgctatctaatccgtgccgacaccatcatggaattaatgccccggcagttccctgctcaatccatggatggatgcgcgtggcccgaatcgctcccgcgaactggaaactgttttaatcattcaatcactcgaatagatgtttatccgagtaattagaatccatttcccctacatctacgtactccctccgtcttactacccgttccaaaatacttgttacttttaagttttttttatcattcatcttattaaaaaatatataattattatttattctatttgtaacttgctttattataaaaacactttatgtatgacttatattttatatttgcactaatttttcaaataaaacgaatggtcaaacgttgcgaaaaaaaaagtcaaagcgacaactaatttgagacaaacgtagttttaaaatataagggattttagatgaataggagtatgaatagggattttaaaataccaaaaatctaaacagactctaaaatactattattaagatatgtcatatcctttaaaatactccatacgtacttacgtagtattaagctattatggaacatggggagtactacgtacgtatgatgttgcatcgccgattccggggaccatatgcacgcgtgtatgcgaagtcactcccgtttacccgtgcgtgcacagggcaattgaatggtactcctatcttttggagaggggaaaagaaagggacgcttgatgaatgcactatgcaaccgtcgacttgaaattgttgcttttgaggccatctcacgcattacgtcgcatctggcctgcaggccgtgatgatggaccgagcgtacgtaccgacgctgcgatcgacgcacgcgtgcacgtacatttcatcaacacagccggaagtcccccgagcgaaatttccggcgaggcacacgtgagcaagctagctagatcccgcaccggccggccgacgggagcgtacgtgcaaaacagtgccgttttatgagatcgcggcacgcagcagcgtcacgggtgtacgtacgacgccttctcacatcgataaataaacttaacctccgtgtcctttcgagctagccgtatatctcatgatgggaattgtcagggtcgatccatttatccactgaacctatccgtaaatttgttctaacggatttatagggtcgctctaaaaatataaatggatcaaacggatcaaaccattagaacctaaggttcaagagattcgatccaaaatgacttcacatgtataaatgttataaaaatttatacaaagttgcttcgctatataataattcattcctacaaaattcaactaaatttaacaagtttttatagtgtgaacgcgagtttaaaaattttggatccgagttttacatgtaactagaatttttgggtcttagcaacgcatcgtgggccccacatgtatgaagggctcaaaatttacacaaagttgcttctctgtgcaataaattattccaccaaaattcgactgaattcgataagtttttatagtgtgaacgcgagtttaaaaattttgggtccgagttttacacacatataactagaatttttgggtcctagtaatgcatcgtgggccccacttgtataaagggctcaaattttatacaaagttgcttctctgtgcaataaattatcccaccaaaattcaactgaattcgataagtttttaaagtgtgaacgcgagtttaaaaattttaggtccgagttttacccaaatgtaataagagtagccgatccatttggatatccatagataacctattgatataatggactcatggtggaccgaccctattaaaccatggatcaacgaactcacttaaaacggtttaggttcaatccatatcctaaccattcccatcctgatgtatatctacataggagtatactgtggtgttcttttcttctaaaaatgaagattaagtttttttagcaaaacgatgtgatattaacgtttgattgattgggttttaattattaaaacttgaaaaatatattaagatgatattttagagcaactttcatataaaatattttcgcacgaaacgtaccgtttagccgtgtgaaggcacaaataatcttaatctacatcttggaaaaaataacgcgacctacgactccacggagcaacgaacgtttgcattcagggatagttcgatttgaccacactttgctagctgttgctgcgcttcgtcgacatcatgcatggacaatacgagcatagtgcacgtacgagagtacgggcatcgtcgcatcatgtgtgtaccagggccgcattgaatgtcacgcaatcacgagatcagatcgatggcccgtactgtacccggtgactgcatgccgccgtgtgataaggtttccaaagttgaagggacatgacggctatgacataaatatagtaattactccctccactccatttcataatataagtcacaacctctttttacatatttcataatataagtcatgcatgcatgtggacaattaactattacccattctccattaaattattactttttttaaatactctactctcatgttctctaattctattggatgcatgtattgtatttattaggatgattcaaattataagatgataataattttttcttagtctttggattaaggtggttataccttatattttggaattgagggagtaattaattgggactgtgttttggagctactcctagccaccattccaggtcaaaagtccaatgatatatggcctacatttcccgcatctatggtgcatataggacggataaatgacgcgcatacgacgagtatgataatcggtgctactactcctaatttatgtggttaaattacgagaaatgctatatgatggtatttcattcggatgtataggatgatactatctggtaggtatgctgatattccgttcgaacgtacgggtaatgcctctgagatatcgtttgatagtcatctaatttattatcccgtccaaacaggatatcgtcgtgtaacattttcctaaattattcatgacaatatagtgtccgggtgtactgttgatggttgaaagcttgaggctaggagtgtctctaccctcttgcgagagggacaactaatctttttatgatttttaaggattgtcgagagatgaatgcagtgcttgaagcaaaagccagaacgaatttatgcttgtttcttaattaatttaaacaagtgatctggatgctgatccaactcagaatttacaattcatctctgtttatgcatccatagttgttctagctagtagtggcatctcgtatatgccaatattgaatatcacacgatagctggtcaaaacatggattggaatttattttataaacatataggagtaatataaacaagcatgccgttggtttgtcatagtactgtccaaatattgtactacacagtacaaatttaagacacctgctaaagggaatcaatcatttcatccattcaacactgtcaccagatctgagatctcttctttcgcatggcacctcaatgcaaatcaaaatcaatatccttgtctccatatggtggcaggagaacaggtatagcttgtgtactcagccttcctcttttgtccaggcttaattcaatcattatatgtacatatctttgtccacactattttccaatgaatgaatgaaacgatccaaacaaattaattgacccaacaattcatgtcagtgtcactgaccatcttagctagcaggaccgtgcgttttgctatgcgcctatgccatgatataaaaataaaactttaaatgattcaatcgacactttttagataaaagagatttcaccaagcaaataaaaatattaggtttctacaacaaagtgtaccactacttaaaaaaaaaggaacgtacatgtcggcactatagatgccagaagtgctaaaaccgacacttataaaccttttcccacctgcacgggttgaaataaccaaaaaccgagagaaaataagtatcagttctaaagaaaaaccacctataatttattataggtgccagtttataaaaccggcacccatcttaagcggagccgagccgagccgagccacacctaccacacttaaatttgccttatctatctactgagcggccgagcccatctctctcgcaacttcatctctctctctctctctctctctctctctcccaatcgaggaggcggatgcaggcggcaaggcgatgccactactctcggaggcgagccacggggtggctggatccggcgtcggcggcaggcggggtggccggatccggcatcagcagcagacgggggtggctggatccggcgtcggcagcaggcggggtggccggatccgacgtcagcatctgttcccgcggcggatccgcgttgacagcgggaatggtacagcggcagcgtaggtgggcgccctcctcagcaagctaccgtggcagcggcgggcgccatccccggtgagctacgatagcagcggggctcgcacgtgcatgggtggatccggtgacgacaggcgccatcctcggtgagctacagtggcgggcatgcaatggcgaagttctcaaatcagtgatttgtattatatgtttgtgattctgttcttgccttgtgatggttgatgttgattcttgtggttctgttgttgatcttcaatctagatgtgttgattgtttggggattattcattgtatttcatgtatgcatgagtttgggggtttggagcttgggatctatcgaggatatgcttgctcgatgcattggctcgattcgatgcatcgagccgttttctttttttttgcttatgtgcgtctcaaaggtaccagttgtggaatcgtcaccaataacctagggtcatcagtgccacctccgtcgtgccggttggtacattcggcacctatgagggtttctgactggcaccaacagtactttctgcagtagtgtactcgctagtaacacaatctcacgggcaaaagatctaactatgccacaagctaaagaatatggtccccacatcgactgtatcatgttcaggcctaatcttaaattaacactaattgcaccactaaattaagttaaggcccaacaaacttagtccactccaccaatgcaatggtttcttatctttaaactatgctgatcacatatggatcagagacgtcgacttattcacggtcagagaaaacaaccacaaattagagaagtacagttggaacattgctccacccagtgccttcaaatcccatattgctaggaatttttcgaggcttatgaaaaacaaaaataaataaagaaacggtttcatattattttgcaaattatgcgtgtataacatgttagagttttgtgcttggtacaaatgaaaattccaaataaagtaccaaatgatctggccggctcacgcatgacaagtgagaggtcgcttgatgttaatacttcctcagtattttaatgtaagacgtcattgattttttaagatacgattgaccattcgtcttacttaaaaaaatgtaattattatttattttattataacttgatttatcatcaaatattctatttaatatttttatatttgcaaaataaactgaataagacgaatggataaacgttgataaaaagtcaatgtcgtcatacattaaaatacagagatagtaccgtactactccgtaaaaagaattaatcctagcaatgaatgaggattggtcttttttaggatggagaggtatcctctcttattataatgttataacccactaactgttccggttgggaataaggatgcccgaacacagccttagcatcttcatccactttattcgtggcaaattatgtgatgagacgaatcaattaagcttatggtatgtgccttttgcgatactagctcgatcgcttcatgcatgccttagcagaatcgcttcatgcaagatgtcttcatgcatgtcttgattcatccgcttcaattctgccattgtcttgattactactcgtctactcccatatgaggaattaaaataatcacataagtgctaacatttccaacataaacaaagcaatattatgtgcattggatttgaaagcacaccatgcatgtgtgcacacatttggacttgaaagcacaccatgcatcgcaacagtgctgtcggcagaaggttccatatcttctatttgggcaaaaatttgtaatgctaacggcactaaataatagtttcagactttcagtcaatccatacggtcatacggcagacttcaatatatatacacgccaattttcagttgttggtcagtcggtcatcttcaagggggttgagctgtatacttgatccgtcctgtatatgcgcccgatgactgaagactcaactagtagttaactaattttaagcatcagatagaaattgaaatagcaacaatcaaacagactgacgcctgcaaccacccaaatggaaatggttaactcgttagcatcatacacgtaatcaccacatgcccacatgatcattccacaagcctgtaccttcccttgcatgatactactataccaaatgaagttttagattctgacatggagagccaactgatgagtatttaaaaaggctaatattcttttcagcttctgacttcttactcattagctcagtctcgattttcagatagtccgatgtaaattatatctgccagaagctctctaagcaggaagctatcatgcacgcttcactgccgctgcttaatcttagacggaagcaagtgccaaaccatatcgatcatcagtaacaacttgttgggggcagaactattctgcaagctactcctggtagcttggctaacttggtttgcaaaccggtcccagctatcaaatagcactcgccatgtgaggctagcctacactttaggagagcccaatcagtcgccagatctatttaattagaaattcgagaccatttctttaagatgagacaacggattgatagtgctacccaagctcacaccactgctctacagcccccttgatctcgacctctccaggggaactgaaaatcttcaagcactctcagtttttatatatctcgaggcggccatcatgcacagggaaattggacgacgacgagacaagatatccagcccactagtggcaccagttctcgtcgacatttcacgttaaaaagatggtatgccggattgctaatggcgatggatcggtgcgtacgtactatccggccggccgggttgctgtcgactgcgtcgggtcgccgtcgtgcccatgcaatgctgctcctcttaggctgtttagttcacgggtgaaaagattttacgtgtcacattaaatatatggacacacatctgaaatattaaacatagtctaataacaaaacaaattacatattccgcttataaatcacaagacaaatttattaagcctaattaatctgtcattagaaattatttattgtagcaccacattgtcaaatcatggcacaattaggattaaaaaattcgtctcgtaatttacacaaaatctgtgtaagtagtttttttttctgtatttaatacttcatgtatgtgtctaaacattcgatgtaacagggtaaaaagtttttgtttgggaactaaacatcaccttagggcttagggcatgtttagatcccctggcaaaattttacaacatgtcatatcgaatgtttggacacatatgagaattaaatataaacgaaaaaaataactaattacacagattgcgtataaattgcaagacgaaacttctaagcctacttgcgctatgatttgacaatgtggtgctacagtagacatttgcaaatgacggattaattatgcttaataaattcatcttgcggtttacaggcggattctgtaatttgttttgttattagactacgtttaatacttcaaatgtgtgtctgtttattcgatgtgacacgccaaaactttacacccctgcatcttaaacacagccttaggccttgtttagtttcttttttttccctaaaaacgtcacatcgaatatttagatatatgtatggaacattaaatatagataaaatgaaaaaactaattgcacggtttgcatggaaatcgtgagacgaatctttttagcgtaattagtcaatgattagccataaatactacggtaacccacatgtgacacctacaaattttcttttcgcgaactaaataaggccatatctttttttttccttggcaatggcgtaacagtacaagtacgtagggagtaccagcctagctagctacctatggcgtggaccttctgccccgggctggcacgttggatcgatgcgtggttcacttaatttgttctggtgcgtgtacacaagtacaggcacaggcgcggcaaaccgtacgagtggtggtggtcggagaagtcgtgattagccacgctgaagtggagccatcggaacagcgggcgcagctagctagctgcaggcctgtagctcagtcgtcgtcgccgccggcgtgcagatgcagcagcgagagaggcactggggtatacgtactgcgcgttactgtgcccatccagtgcgcccgggctgatttgattagcctgaaaatggatcggtgtcctgtgccatcaaatctctatcaaaaattcaaaatccgcttgaaaaaactctcttgattaattagtgtcaaagactcaaagttgatgtgtcgatcatgaaaacaatgttgattgacctctcttctctctgccatcgcgattctcagactgtagctagcatcctgtagcaccgtcaacccgtggtaccatacagggagaggatcgatcgatccgtccctgcgtgtattcgccgggctgtagacttctagggccactctgggccgtacgatcgcgacatatatggatggccacggttcatcgttgatcgctcagcacaaccttactaggcggaaacaaaaatcttgggcaatgtttttcccgtgctgatcttgtacgaatgggtccttcatattagatatttactccctccgtcccataatgggatgagacccatcctaggactacgaatctggatcccatcctaggttgcaacattatgggacggagggagtagatgtctactgcacgtctgttgttccatcgtacaaatgtatgacgttaattaggatatgcatatctagttcagtacggagtagatgcttagatactccagctgtctaatggaaggataagatcatctctgtttatgatccttaactttaaaagaagcaactatatattctagaggggccgttgctcccaaatttttttatatctttttcgtcgctcctatataaaaacgatatttttacagctgtaaaatacatttgcaaaggtggtttggccaacctcctgtaacaaaaaataaatgaaaatggcgcattttcataggcgggcaataaatcatctatgccatgtggaaataactttcatatgcgaccagcttaacatcactatttttagaaacaattttctcgtgcaaccttcttatttaacatgatcatatgtaaaaactatttcacagttgggtgacctaagttaacgtatgaaaaatacctacttctaaagacacccatattttttttaagggaatgccattcagctagctttattgatcattacacattggtacatcgtttgtcaaagtgcatagaatataagcaggaggttcatcaacccaagtacaatactctttcctactaaaagctaccctggccaattcatgagcaactttgttttgcttctctattacaatgttcaatagatatgctatcaaaacctctccatattagattacattctccatattagataacatatctaaagacgtccatctaatactactacatgtggaaatggggttacttccaaatacaaatgttttaaatcatctgcctcttagatatttgtttgtatagacagccagtgtcggtgtgtaaccctaagaatactgcgatggcggatttcattgtgaactgcccatacagtctaaaggggtatcaatgaaaattatttttttgttgtagtatgtacacctggcctagctagggttgtactactacgtaatcaagtgcagtgtgcacgatcataaggccgtgtttagtttctcccctattcccaactttccatcacatcatatcacatcaaaaactttcatacacacataaactttcaactttttttttcacactcccaactttcttcaaactttcaacttttttcaggaattgaacacaccattagtactttgctaatttgggccctccaattttacatttaatccaagacaacgttctaacttctaagtaataaaattaagaacattcttatccttttttttccacaaaaagaaaatctccctccttcaatgagatctagctaaaacatgcttgtttaattttcatggccctgaaaataacacccacctaaaagacccatgaaagttagtaaattataagttagtatcagggtctcaaattattagatattgcctagcccagtccaggatttcccaaaccgccggggccggggttaccacgtcccggcggtaagcacggttaccgcgcggtaaccgtgaaaaactatacgaaaccgtacaaaattcatcaaaaattcaaattactttttaatttatttaaatttaaggaggttaccgcggtttttctattaccgtaccccgcggtaatgtaaaccttcccgtcctatgcttcctcaaacaactacatgcttagataatttccatttatctattgctcgtcgagtcgttgtacatggccttgattagccagcaagtgcatcggccctatatcccggaatcacactctttgaaaaaaaaatgagtaaattgcgcccacggtacacaaacttgttaggtaggtgcaatttagtgtaaaaacttgcaaaactctcgttttggtgcacaaacttgtataggtgcgtgcagactatgactaaatagaatagcaaatctaattttgctgagttggatgatgagtagaccgccaactaagcattcacgtaagaaggacatgtttgcctgctcgtaagcaatggccctattttatcagaaaaccccttctattgtttggtatttcgatcatgtataatttttaagtgaaacgaatctgagaggtgttcatagcggcggggagctgggaaggtcgaatccgcggtggctgtagtgatgggagtcgagcctgacagctacgccgtggggggagtcgagtccgacggtggctacaacgggtaggtcaagtctgacgacagtagctgcaacagtattgccgagactgactatagtgacagatggcgaggaggtcaagtttagtaggagagcttagaagttgatgctgcggtaggcatttgagtgccttgctttaggccaacatcagttatctcagactctgacaattcatatagcaactttgaagcctagctccaatgcttcagtgcagacatggaagcagcaaggaattaagccattgtgccgtcagattaacagcatgaacattaagtccactgaagcagcaaggaatgtaatgcttaattgtacacattgtgacaaaatctgaacacaatgaaacacgtgagtgcatattttgaacagaaactgagatcctgaataaaattcagtgaataacttgaatgaaaactaaatgcataacttggcatgaatttgattgtgcactagtaatgtatctcaaaatcgataacatggaaccaactttatgaatgcatagtataaactactgtttctttttcttgggagagtttttcttcttgggtgctgcacttctcttcctcaatgtggccctcccttgtttggttgatgtggttagtggtggttgaaccccttctctcctattagtagcaatgaaagcagactctggcaccctttcttgatgtttgctagcagcctgtaaaagattatgtactaattttatgatggttgctattagctgacaaaatgctagcttaatgaaggattgttttttctttgagaacttaatgaaggactgtcacctccttaataaaagcttccaccacagatgaactcagatagttagaatttttctggggtatgctgagcaggtgcatttcctgaaacaaatatatgttctgtttaaaattccttgttagtgcagctaaatatatacacaagcaaaatgagcatcaatagtacctgagtgatgacaggttcctgaaacaaatatacaatgagtttaaaattcatagttagtggagataaacaaataaacaagcaaaataagtataaatattacccaagtgatgacaagctcttcttcatcaacaattgatgaagtcgccatttgctgtataggttgcttctgaagttttaagtcagccttcctctttttacaactagttttgttgtgaccaccatttttgcagtagctacaatgcatctctactccatgctttgaaattttagtcccaccctctagttcttggggctgttttctcctagttttctttggcctccccactttcttctcatatactggtggcttcacctctataccctgcatcttctcccagtggatactatctctcagtggcattatgttgtagctataagcttgttcatagcacctggttgaatagcaaaatgacactacatcctctggcttgatcctttcatgtcttagacaggaaatggcatggttacaaggaatcccagtgagctgccacctcctacagtcacatctctttacattaagttcaacaatgtattgagatcctatgtcgctaacctgaaatgctcccatcccagcaggaaaaacatagcatgtattagccatctctgtatttttctcgaccttccgttttatttttgggcagatgccacatggccaattcctttctagttctttttgcttggtgtacaacctgttcatgatctgatttctaatcctctcaagcatagacaaaataggcatctctctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctcccctttatgtaacacttgaaaattttgatatagatgcctcacacagaatctttgttcagcatcagaaaactcccttctcacagctggaacaagcccctggaaacgaattataaagaattatagttaggaactaaaatgtgagttatgtatattatgaaaaaaatcagacaaagtcataccttctgcctatcagtcatcactgtccatgcagatgtattctcaatgccaaggtccttttttagagtgtcaagaaaccaactccagcttttcaagctctcaacttcaactactgcaattgcaatgggaaaaatacagtcatttgggtccataccaacagcagttaggatatggccaccaaattttgttttaatatggcatccatcaagacaaatgataggtctacacccaaacataaaccctctcttgcaagcatcgaatgacatatacaaagtatggaagcaaccaaaatgtaggttcaggtagaatgagctccctgggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcagtgtcattttgtcattatctctaaattcttcaatgtacctttttgcaagatacttagctgtgacggccttgatctcccactgtttagagcaggtgtgcttctctatatattcccttaccactaagcatttgactctattatccatanatnagacaacatccatggacaaccttcagcacacttagcttcaattcttgttttggtattccgtgtcttcttaatagcaacttggttctttatagtatattgatctattgctttcctaagctctacaacatctgcaaacattatgctaaccttaaactcaggtgtctccatgtctacattagccctaaaactcttaaaactgaacttgattttttcttcttcttcttcagaaatatctggcatcatcaacctttcatcttcagatgaaacatagtctgaaccctcctctttattatgcgctaactcaattttcccttcaacacaattatcaaacaagtcatcatccccatgatcaatctcataatcactatcaacaaaatttggatcttcagttcttgactcctcttcatcatcaattttagcgtcggtagcacgtttatctacaatcaactccccaccatcactcttagccctaattattttacttggtttcacaacagtacgcaaagaatctgaaccaataattgccacatcatataagtcaatagcgtcaactatgtcttgatgatctgcatacaaaacaaatgatcggaccctaggtacaagagcgaccatactattagtgtctgcatcacacttaacccttctcaacccatcacttaattgtttgccaggaagcaaccaataaattttggtgttatcagatttctcatatcctagttcttcaatgaaatcatcaacccacaacagtgaccaagaatctgactcacaatggtcaaaccagtttactctaccatcaacataagcccggtttacaccatttcccataaaaaagcctccgtggtgcatctcaatgctgaattcttcatcttcgtaatctacatatgttgtgtacagataattattcatcgtcagaacagtttactttaggttcagatgtttaagggtatatccatgtttaagggtatatccaggaagaaagcatagttaacaacagaaactagcagtacattaatgatcaaattgctctccaaaaatacaaatttgtcgtgatcacttctataccataaatgtcaacaaaaattacagcttttgtgtaccatgaactagctcctggcataaattaaaacaactaatagtccttcttgtttgcaatacctaataaatcgacaataagaggaagaaatctctacaaaaattggaattgagaaagacaatctcatttttgacctgataaactaaagtactcactgtatacatgagatcgtgcaccttcacttcgcagccctggcaccatgttgcctcagcgccggcggcaacgtcctgccaccgctgccctaaacgtggccggtgtgttgtctcccagaaaagccctaccgcctggatccaattcgcagccttccaccttgatccaaatatcaatctcctgatttatctccttttgttgctaactcaattggaggtaggctatcgtgaaactgatctctagcatgggcatcatcgtgggctacaacacaaaagaagattcggaggaattgaaagatgtatgaggggttatttgcaaatatgtgtagccagctcgcgcccccataacgtgtgtatgcgctgatgtggcatcctaatctcaagccaactcaataagattggtgatgaagtcatgtcttggccttggttcgcacgcactacgcaagtttgtgtaccgaaatgagagttttttaagtttttacactaaattgcacccaccttacaagtttatgtaccgcgggcgcaatttactttaaaattatcatgttcaggatgtacacaatagacttcaatcccgctatctcagacaggtatctaggctcaccaccagcgagctgcaatattgtgatgacacatgttacccacgctcaatgatacccacaataatctaaagatttatacagcctcattttttcacttatattaattatacttatcagctaaaaattaaattttttatccttaaatttgaagttgattttagagtttttttcatctaaatttattttcagcttttatttttagatcgctaaagttttattatatacagtttggcttattcagccaaatgatgatgccgtatcacttgtcactactcgcattatagacacaattaatccctcaagaactaagctgacatgtcgaggcatcatgggctgcagagagcggcgtaagcatcaacacccgtcaacccgcgctcttgacacaattttttatgagtttacccagaatttcggcaatatattatgaaattaattatacccccaaagataagctaaccaaatctcaatccattccgggccttgtggttttgcccacttgcccttacaattaaaaagattcatcatatcttccgtacattcgtatgcacaactgcacaagcagtcaaccaaagcgtactcttctttaatatcgccggtaaactactagcgtggctactttattcaagtcataaggcatcacaaacatatggaccacacaaattgatctcattacatttgcgtataaacagggtcaacataagcccataaatattttacaaggtttaagagtccatcatttagaaaggtcgtctgtagtcttctattagcaccgctacttttgagggcttgttgagagtgtagtggggcttcgccaccaccttccctctttatagaaacaacattttagtagtagtttttcttttaccttagcagtctttttgtttttctctttgttccttgtcctcaggcaatgaccgtccggccaattgtgttgcgtaacaaaaactttgatttcctctaatataccaacgtgcaatctttttaagcgttcgcgaaaaaaatttaccagtttctaaaaacaaacggttgttactgggagaatcttcgctgtcaagcctaccgaaaattaacgctaccgaaacaaatctgaaaacatgttttaaaccatttaatttagctatttgtggttgttaatccagatgaattgtctagtggtagttgatatatattaccaagtacgccaatagcactacgattaattggagagttacgtttgttagatgacggagcagccacgaattttgtagctagtgcaggtctcgcaaaaccagagagaaattgagaacccatgtgttcccagtcaaatgcatgcacgccaccatggatgctctgctcaatttgccgccatcgcaatttgcatcggggtcacttgttaatcatagtactacagggagaataatatgcggtttattcggtctgaagggaaaaataaaggatttgtattattaagaattaatttctataaatgtcatttgatttgtaggaatgaagtactacctctgtcccataaaaattgaatttctacctttgaacatttatccaataaaatttgtatttctacttaatatgggatccaataaactgattatattttcttgtaatcttcttttctttcatcccatctctaactcattgtcttgacataacttttaatcaagtttatatatggaatatgtgcatgtactgtgcttattaaatagggttattgtagttatttatctatcccactaatatattcttaatttcctaaaaatttattttttatgggacagaggtagtatgtaaaaactaaaggattttttcctttccttataagttgtattgagaaaacacaaaggaaaattttcatccacttaaatcttttgaaaaatatctatgaattaatgtgtacatatctttgtatttcttcacttttttattcctatgagttaaaatttctctaaaccgtacaggccctaaaacatgattaggggcacgtctattttggcctgcttgatccattggcgtaactgcagtcgttgtctccatcagcacgctataagaataaaataagagaatttttacggtacaatatactatcagtatatactggcagtatgtagaagagcatgttaggaattttataggaaataaaataacactttagtaatttttggtttaaattgaatctaattaggagtacctggttctaaatcttatcgtgcactaagggaggagcattctgagagtcatttgatgacaaagcacgtgacgatagcacgatttgataatagaataacgaagaaaagacaaaattaccctttcaaactttacactgcaatctaatttaaaaaaatcaaatcaatgtacactgttagatcatatatactttcagtatatactagcagtatattgtaccgtaaaatactctaaaataaacacataatacaataataccgctactaacacaaatacgattaagcatcagcttagcttgtggcatagggaattgcacgcacatgatcggtgctcccagattaagttattgcggggacaagttgtatcatactttcattcaatctcaacgtcgaaagccgtacggatcttcaaggccggcactagttgatagaatctgtggcacacatgggctggttgttccctgcttactcgatcgcttgcttgcttggttggaccattttgttggtcctggaccattttgattactatgcaaatttgcgagatggagacgcatacacatatgggggcacctaaaaaggcaaggctggactaatcaaatataatggtttggctatttctcctatgcccctgcatagggacaaactctgcatattgaatggagtttggattgatggtggggtggccctgaaatgagaagatgatatatctcagatcttagctggacgtgtcgagagatatgtggatcgctgattgagaagggtgcactcatgcatgcactagacactacttgcaatgtttagtactacagtgtgtggacaatgctggcctgccggggcactttcacatgatgctgaattaactttccttgtacgaagtggtccaaggctaaaaataacgagcactcagcagtggatcatatcatatactccatatgctagtagctactagtactagctggagtagagttgcatgatggatgggctgaaaatgagaaacgtgtggtgatcgagatgagtaatggagctgtccagtggtaccgtccatatcagggatatcatggcacagacagggtgtacaatactacattgacttgtattacaccataagaaaacggtaatggaccaacgaccaaaaaaccctgcccatcacatgacacgtcaggacgtacgcatgcgaagttatcatatccttcaaccgcttccattatcatcagagaactgtacgtgctgcaaacacacactcatggcgagctgcaaatagccaaatactactcctggatacagactgtcgtcatgttagcgaggctcgtgaaatcagagagatggaaacatctggatcgattgatcgataggtattcagtgtcatcagtactcaaagcagcctaattgtcgacgatagacattgtcgcatgactcgcatgcatggatcatcattcatcatgcagtacgtagtggtgcggtacccttttgatttgcagtagcaacacacatgcacgcacaggcgcacagcaagcagcattagtacggcgatcttggcgagagctaagcttttgcatccatcgatcgatcggcacgggcaaaactgtagactgtactacgctagagaaacggacgcgcgctaagcgttcattgctggccaccgactcaattcaatcaacgcaaagggtacgtaagctgctgctcgccagtcgcctatagctagccgctgctagctgctctcctgctttacaggtttgcatgagaagagagaacactgaacagatggagatgcgatcggtcgatcgacgtgaagccaagccgccagtcactgctttgtcgatctctttccctccctcccagcagaaacgtgactccggtcgggactgtgttactgtttactccatcattgttacaggaaggaaaaagaaaaagagagaagcgaaagttgcaggaatcatgcatgcaagcatgcaatgagatcgagagagaagccggcctttggactgtttgcagcacgtggtcggtctttgccttccgaccgatggccaatcacatgcatggacagcaggcagggtctgatgcatgttcggtgcgtaattcgtgatcttgtacagtgttcgctagtacagcattcagagttcagattcctccacaactcggtgttcctgatagctaggagaagcccaaatcatggatattcatgcatggttgattggttgaaaatgtaggtgaagccattcatcgacactgtgttcggcgccagcgcacagtgaaaaaaaaaattctgaagcgcgcgcgattcgatccgtgcacgtcgtggcgtctccgcgcgcgcgtcgtcgtgaggagtcggcgtcggcaccgatcgtacgcgtacgcgcgtgtcgctgtacgttttcaggcccatgtaggcgttggccgcgcgcgtcgcgtgcggcgtggttggcgacccggccacttgggccgcgtacgacaaggctcgatagatccgcgcggcgggcgggcatcggtgtcgtcgatgagtgatctgactcgatcgatcgatcgtggtggccgggctggcatcgtcattgtgcagggatatgtgctgctggtttggctcgatcggacgcaacaaacgtacggttggtgtcacgtactataaggtggcatgcacgattgcaccccgcaagttgccctatcaaacgactagtacaactatcaatcctgccttggcttggcaggcatattgatgggtggatggatcttgtcttcatcgagtatttttcatcagaattgtcacccatgcaaaacctttgtgataccttgactgttactactaccagattttgattactctacgagtgtgtggtggggccggtatgtacgtaggatctacatcacgcatgctaatcaattcgtccactttatcatggcgttgtagtggttctgattagatcctaaccgctccgtgattagcaaacaactcgggaacgacggcatgtgcacatcatgcaaacagcggccactgtccaaggaccagcttacccacgtgatgacgtgcactgcagtgcagtccgcagcaggtcgatcgatcgatctccccatgcccccacccgtacgcttttgtttgccgcgcgcacagtgcatcgtcgtcggctaggccacgatttttttttagaaccagaaatttattgcaactaaaaacagagtacaacatattcgatcatacagctttctgatctctgaagagatttttcagagagagttggcaaagcaacttctgttaggataagcaagacacgattgataattctagtagccgtctacacatatggagacatggagtcgtaggagtagtatcttattagcaacaacggtagctgcgcaggcaacgcttgtgagttgtgcgaccttgcaagttgagcgagccgtgggccggccggggactctcgctcaagaacaaagcagaggagccgcgaatccatgtgtcaccagctaaaggatccggatgcctatgtccgcttctgaacgtacgggatcaggacgcatttaataccatctcgtcgtgctctacggccagcgagatacacacggcaatgtccccttcttacgtgaacgtatacgtgagtaggaaaaacaatagacaaagattttttttttctttttactgcaggggaacaacaagaattactacggagtacaattatttccacccattatcaggttcatttcaaccaggaaatataatattccatccgtcttagaatataagaagttttaaagttagacacggttattaaaaaagtagataaaagtgaatggtggagagttgtgatagattgagtagtggagataggtaggaaaagtgagtggtggagagttgtgattggttgaaaagagaatgttggtggagaagttatattttaggataaatcttgagagttaaaattgttatattttgagacggaaaaaatacacaaaccatggattgcgattttgcatgcaccctacgtgtaaccggaacgaccacatcagaaatgaatcgttacggttttggccttcgtatggggaaatcgggagagagagagagagagataatacagggtgtcgtgtgggcccaacgataatatcctctcgcgcgcgtcgcacggccggatccgggttgggggcccaccggaggggtttgtccacgggggaaagggagagatggcgatgcggcgtgcaggtgcgcgtgtgtggtggctttcaggaatcagtaccgggaaatgggagccaagctgggggcccacggcctgcgcccgcccccacttgtgctttcggacaagcgaaaaggttgttggaaatggctacggccacaccgcaacacgacacgatgaggtgggggttggccaatggccaggccatggctggcttgggatacagtaggggagtaatttttggctgggactttacagggaccaaatttatttcctgcacggtcagaaaattactgcggggtcttggcatacaccaactgcctttgtactactgatcccacagctttacatttttttattttggaagataaagtgtactatgtaatttcacatgcttttgtttgtctcaatcaacaatatcctattccctcattaaaaaagtgtctataacttttagatttatcccacaaatagtgtgttttaatatgtacggtctattaaacttgttaataccattttattttcttttcttttctcaatttagccatccaaccattactatatatcctttccgttttgtttatgcattcataaaggttatgatatttttgtggcctcttattttagagacaaagagtagtagctttctttttttatgttgccttcttgctatttatctattttattaagtaggagaatcgtccatcgacgcgatgtttttcttctttccagtagctctttgaagagtcgctgttgtagctgaaacgcaagattcgggccactagaagcgaaggaagcgaccgatcaacctcggtgtcaaggatagaagccatttttgttgttatctgcaagcttaagcagccaccacctacggggcataaatggcaccggacaagcaaaaacatacagcgaccagcggagagcggcaggtagcgacgcccgccgaaaacgacgtgacgaattttccgcggtcgcacgcgtcacgtacgctttgttcgccgatcactttcgccgcgaggatacatcaccacttatcacatgatcgacacgtccatctgctctcttctgctactagtactggtaataattaactcttcgacccggccgtcccggttggattaattagtcaccttaaactgacatattaagaaaatgattaacacatgttgttgctttaattcactccctctcgccttctagattaaactaggcacgatcttttctttcctttgcttcatctgtgttcagttcaacgtaaagtttagattttggttaaaattaaagataatatgatgaaaaagtacagtttagattttggttaaaattaaagataatatgatgaaaaagtactgaagtttagatacaaactcagtattactccgtggcagtacgagtagccggtaaatgtactggagtagtactgtacaagctagcgataggttccggcacgtacggcgtcggaaaccacgcgtacaacgccgaatactatttggggtccgaaacgtgatatgctccgtgtcgctagcgtacgcttcatgtcgcatcgtcaagctgtgcctgttgcacctgcacgtcaacgtgatagatggagtaatatttggatgtactgctataccatggtcacaaagtcatcgcataagctcgaaatataccgataagacatacccttatattttatacgaaagatatttcagatactttatcgtactatataaaagtattatatatctaatgatatacgagaagttatcttttaattaaagcaacactgtaaatttagaagaaaactgtattctcggaaaaatgcgttagaatcctattagataagatcttcttagtctatattttggcctaattcttcggattctacttggaaaaaaaatgatcatcgctataaatataagacctccctcgtggagaagagcatcgaattacagccataaccagagccacattgagatacaattcggaggaagccgaagtcctagtcgccgattaaatctttctgagtcgttctcggggagtcttagtcaccgattaaatcttgctgagtcgtcctcggtgggttctagtcgatggattagatcaagtcgcttctttgtccttcattgtaatccatgtgaatcctgctagcaatacatataaactgcaagtcatcttgagatttgaatcgatataactttttgtctcttgtctacttgatacaatcttgtgtatatcttgattctaacgttccatatactctataaataccgtgggaaggtataacccgtcgatagtttgttgtaaaggatcggagaaaaaaaaatgcctataggacttaaatactactccagtataaaaattcagaaagcctcattgtcgttccgggccgcccgaaattactgttaccatctcacacgattttttatattttagaccatttaaaaaacttattttatagacagatatagaaaaagttatttgaaaaataatcattttcgccgcgccaacattattaagccatggtctaacatgatgacgccaataactttagcaccgtggacatattttttttaaaaaaataacctatttataacaaattgtatttacaaatagacccttggcaccaataatactcgcactgaggatctaattttaaatatctttttaaataaaagtagatcattttcaaaaaaaattttgcatataagtcttcgatgttaatgatattggcaatgtcccctattacgtaagtgacttagattatacagggatgtggaactgcaatttcgaatgtcagttttgcaactggacccagggcaggggcgacatgggaggcgactcagccgccgccgcagcaccacccctcgctgccctccttctgcctcgccgctgcccgagcgggccgccggaaaccgtgccgcggccgcaaggacggcggtggcggggccttctcccccgaggtcgcggcgttagccctcagccctgacctatcttcggggcgatgacagcggcgttgggcgacggcgagcgcaaacgacatggcgaggcggcgctgccggatccggagtctgctgcgcggatctggcgcgagggctgccccgagccggcggcggcgcgcgcgggggcggcggggtgcccagatccggtccccttctatccggatccagagtaggaggccgagccccgacccccaggcggcgaggcggcggggtgcggctgtgcagagctggcgagggcgaggctgtggcgtggccgtacggaggcaaaggcggcatggcatggccgtgcggagacggtggcgcagctgtgcgaaagcggaggcgcaggcgctgaggtggaggcgcgggaatgagccggctggtacggcgctggcgggaggaggagcgtcggctggctggctggtcggccggcggcggcggaggcagcgcgtgcaggaggtgcgactggcgagagcagaggcaagtgaggctcggccggtggcagcggaggcgaccgtggtgcgtggaggtgcggtcgaggtgccggtgcggcgcgacgaggctgcccgcgcgtggaggcagtggccggtgcggtgggaggagaggccagtggcccggtgaggcgcgactgatggcagcgcgcagagactggccggcggggggtgccggtgcagtggtgcccacgctccggcggaggttttggatggcgatggagcaatggtacatgtgtggtagatcgacaggtggtggatggcaggtgaaaacccagcccggccttggccggacaagcatcgatgacgttcgagcgtcattcccctcctgagggcgttgtcgtgccgtctcgcccctcaaggatggctgccgagcgaaagctcagtttcggctctctttgaaaccttgacagatgacggtggcggtgttccgtcgcttctctcgttggagacgtcgtctaggcgtccccttgccgaaaccccctgagcaattggtgcaagcacactctagattctcatcctcttatggcggcgtcctagtttctacaagttggccacgtcgaagggcctaggggggagaggtgttccatcttctctctcaccctctctccctgaatcctgaagtcttggatagagttggctttgtgttgattgtatgggtcgggttttggatgatctcggcagtgttctgttgttggcctagcgatggtcggtcacgcttagcggcagccggtccggtgctagccttctcctggatctgtgtgttggcgctgtcggtgtgtgggtggtggtataattttcttttttcctggttacgaccttacagggttgtaatcttgtaatttttttctgctctatcaatataacctcgcaccgtctagtgcgagtcgttaaaaaaaaagattatacatggatgaagttggcaggtaccactagcaaatcattaatttccggagaaaaaaatattgtgtttgtcattgccgagtctcaaaaacctgcgtgggttttttttttctctggtccccttttcagattattaatactcttctcttcgtgttccagatgtttaacgtgtactactgcctgccagcgttatctttagccctgacgcgagcagcacagcgtcatacgactatgcgagaaaggtagcgctgggcaggcaacgccgatgaaccccgcggtttttacctcccggggaaatgcaaccatcataaacggatctgtacgtatcatacccatgcttatactgctctggttggttaagcccgtggtgacacaccagcatatgcggtcgctgggcctgggcccgtacgtggcgcgtgccagtgcatgcctccctcggcgagcaatctgcacggctggccggcacggcacaccagtggctgtcactcgccagtcaccaccactccaccagcgagctactagtccactgttgctacggggagcgcggcggccacgctgcggcggaggcacggcgcgcgctataccggccccatgcacgcgcgacgagtgcgtgatgtgtccctctcctatcctatcctatagcccttgtgtgttcgtttgaccctgactacccgatagcgcggcgtgccggcactcgatcggctgctagctcccaccaccaccgctaagatggtgcccgttgctctcttcgatcgcgcgcgacgagtagcgtagcgacgaatctctagctagctcgatccgatcgatcagtaacatccatcgcgcccctgcaatctcatctcatcgatcagatcgatcgggcatcatccacccaccgccacatgatgcgtgcaccggccggggagagcatcggggaacagtagtgtggatgaaacatgtctgtagctgtgcgcgacaggcatggcctggctgaacgaacggtggtgaacgccgtgctcccgtgctccgggaaacggtggcaaaatcgcctgcagaaaggccaacgtacagtgcgcatcttttgttactgcatgcatgggacctactagtaatttgccagaagaagacctttacataattatggttggagccaaacacttatctaagttagttaaatttgctaaatattaggcgtgaaaaattatgacaaaatatgggtggcaaccaaacaatcctttaaaaattaagaaaagactaaaatgtcccttatctatacattttataaagttacagcccattgtaccttaatgcttaaaattcaaatatgcgactcattacacactaaagccccctttgattcaaaggaaattcataggaattttagaggatttcattcctatagtaatttttcctatatagccctttgaatctaaggaatggatcttatggaatcctatgaaattcctatggaatacctaatgcaatgcaagttttgaaggaattctaacatgaggtagaagctcatgaaaactttcctttgagtctttatctcttttctaattcatgtgtttttcctgcggtccaatcaaacggtcattcctgtgtttttcctgtgttttgcaatcctctattttacacttacattcctatcaaaatcctacgtttttactattcctacgttttcttgttcatgcgattcaaagaggccctaattaatcctatattttttcttattccttagtttttttatttctacgattaaaggggaaggtatttttatcttgaggcatagttagtatccagctaacaagatgctagccatacggctcatggcagacactgacccgagcatgattaacgggtcttgccggaatgcgtcgggtccgggcaggcacgatccagatctctacagcatacatactgtagtatataaagccgagtcagctcatgcctggcgcgactacgcaagcaagcccataccgcctctcactgcccctgtggacaggagtggtagtagtactagtaccgtgcttgccgtggaacagcacagcgttagcatgcatgcatatgatgcgtaaggagaagcagtactactactagtagtagagcacgctcgtacagcgcaaaacttgttgcgactagtagctgtgcgcctgtgcctgccccatggagccatcaatcccagcagctgcagcagaaacagcagcatctgatgcatggtctgaccaaggctgactgttcccccacaatcctgggccctgctgcacgctgctgctactcctccctccacctctctatactccctgcaaaaaactgcgagccctcgcctcgcagtcgcaggcaaaagcgagaaagttggcaacctgccactgccaccagcaagagcaacgaggacggaggagaggagagaaggagcagcgctactatcgctacctcgaccaaacgacacgcaacaaagcagcaaacaacgatcgatatacacacacacgtcgtggtacaagttcatgcattgcatggctatctcatcatgctgtggatctcgtctgccaaagtgacagggagagcagtaatgctggttgctggatggatggattgggatatgggggtggtcagtggtggtgtagtacagtgtaacgctgcaataattgcagagatttgcagttgcttgcacagcatgcagcatcctaaaaagtgctgtgccatgtacggacgatcctaccgaaagggctgtgtggggagaccggctaggtgcacttatactgcgttgtacacagtacactcattagggttgttaatgctaaacatcaaagatatgcttaataagttttgcataacgtactattaagcatatgcttaataaataaatggttcaatcggattttccgtctaaattatcataaaagcatgatttgggtgagtttgagagataggggattgagaagatacgtaaaacgaggtgagtcattagcgcatgattaattgagtataaactattttaaatttcaaaaatggattaatatgattttttaagcaactttcctatagaaaattttttacaaaaaacacatcatttagtagtttgggaagcgtgcgcgcgaaaaacgagttgtttcctcaacttatctaacataaacgaacgcagccttacctctcttaactctaagggttcgttcgaaacaggcagtagcagctctgcaggagtcagcaagcgaaattaggctagaagggctgcagcgttgcggctgtgcaaccatagcccagctaaaccgatcagcccctaatactataagatatttgataccactaaacttctaaggccctgtttggttcatagggactaaattttagtccctatcacattagatgtttagatgttaatttagagtattaaacatagattaattataaaactcattccataaccttggactaattgacaagatgaatatattgagtctaattaatttatgattagcatatgtgatgctacagttaacatttgctaattatgtattaattaagcttaaaaaaatcatctcgcggattagcactcatttatgaaattagttagtttttcttagtctatgtttaatactccaaattagtgtcctacacatccgatgtgacagggactaaaaaattttagccccatatccaaacacccctaaaaccgagcgaattgcctccggatgaaacatagtatgtgattttgtcctatgtcatcttaagtcattttagccgtgtgtacatccaatcatcaatattgcataatagattgaaataaatctatttgggcccacatgtcagacatttatcctcctatcttcttctgcctctatctctatctaccgcatggtgtctttgagtgctatccacacctgtatttctcgtctttgtttgcactccttcaatggcgtccctgcgctcattgctaataatgttcttgatatggcggccacagtggccgccacaaatggtgcacaaccccacaaggccatcgtcctcataaagccacctcaagatagtgctcgaggtgtgagagctcgacttcaatctcgagatgatcacactacaccattactagtggaagctcgttaattactgtctcgcaatctggatatctgtgcctgtgacaatacgttatactcgctcttgaaaggagcttaatatcgcatagagaaggatgaataggcgttacttgaaatcattagcatcgaagtcaaatctactgaaattacaagtcgtaagcacgggaacttcaggtccactttcgttgttttcagacagagaaagcagtcttgaacctcagttacttgagaccggaagttttagtcccctgagattgtttctatcttttttcactcaaaatgcccttagggttggatacgctgattttattgtttgaaaaaaatattctagaggtttttattgcatatgcttaaatcttattattgtacctcgaagggcaaaataaaaacgtcaccgttagtaactgtagtggagaagtatcacctagaaaattgatcaaagtgaaaaggcaaataaacggagggagtaatactagtatatgcttatgctgccctcactaattagtactccctccatactcacaaaggaagtcgtttaggacatcgatacggtctacaaaatacaactttgacttattgtttctataaaaatattcattgaaaggtgatatatgtatacttttatgaaagtatttttcaagacaaatctattcatataatttttacatattcaaacttaacaacttgagagttattcatgatttatattcacaaggtttgacttaaacattgtcctaaacgacttcctttgtgagtacggagggagtatagaataattccagttctctattctctcaccaagccaatcgtttgattcttttccctttaaaagtactacatttcgtaatatctttttgtacgaaaaaaatataaattcaggattggctatgttacaaatctatctatgtttgttcactccaaagccacattgtatcgattattcgaaaccttggaaggccagttatacatatatttaaatagacgaggaaaaaaaatttatgctacattgaggtcacggtgtacaggagcccatgacaagaaaattgtagcctgtcctattgtatttttggctggatctaccattttggagttgtgcatgaggtagattttgtatgagacccgattcctttgaatttccttctcttctccttaagggctcagtagattttggggaaaaaacatagaaatttggaggattacaatcctataaaaaaatttccattcaagccttttgaaacaaaaggacttaatcctatcctatcatttgaaattcgtatgtaatggataatcctatagagattttaaaggaaatttagcaaaaacttcaacctcttggaaacttttctttgagtctatccctctcatccgattcccgcgtttttcctacgattcaatcaaacggtcattcatgtgttttttctgcgttttgcaatcctctgtttttcacccgcattcctatttaatccaacattttttctcatttctctgttttttcattcatatgattcaaagagatcctaactttgttatcacatcaggtgtttatagttatttttatttgacaaagcaataattgtcataggctgctcatcttgcatggagtattgtgggctgatctaagggcttgtttagttccaaacttttttttgaaacttttaacttttttatcacatcaaaacttttctacatacataaacttcaaacttttctatcacatcgttccaatttcaactaagctttcaattttatcgtgaactaaacacaccctgattcagcgacttcatctataaacacagtgcgcaactttatcagatcatcagcacactgttgccgtaccgctttgacggtacacagggactttcaatgcgctcctgctagtaggcccgttcgacaccgcacagtgccggactcgtcgcagtcgcaaccgtccagcaccgcaccgtggcatgttattctgtgaactgcacccaccttatttcccacaggcgagccagtggccccggccgtggaccacgcgacacaagcacacaggagagcgcgcagacgccgcgccgtggcgctagtaccgcgcccaccggcgccgcgcaccgtgcagcgcctcccactagctacaccagctcgcgtaccgcgcgtataggctctggcccagacttcagctgctgctggtggcggtggtggtactcatccttggccgtagcaacaactcgtagcatcccatggtggtgatggttgcgtagcgttgcgcgcccggctcgcaaggtccacactatactaccatcgagcgcgcggcggtgtcacgcgccacaacgtaacgaacgtacgcgccccgaaacggagcagggaggtgtattgatgggacgtgtcaatttaacccactgtgtgcagcagtagtgatagcatgagcgagtagacgcactgtaggctggatcgggcgcgtcatgcgtaagtatgcagaggcagggcacgcatgtggatgtgggtgcgtgtgacccgtccgccggctggacaactgtgcccggcatgggagcaggcgataaggaaggaacggggaatcgcactgttcccacggcccgagagatcagtaccgtagcgtagcattaacgtgcgtgcaccagcgctacgtgtctctggcgacgcgggcccttcttctcgcttagctgcacacgaatcttgatcatggcgaccttacgcctcgaacagacgtggttgcagtacggagaccatccaccatgctacgactactactgttcccatttacgcgccccgtacgagccatccatcatatcgtaacatattgattgatactgcgagatccatacggccgggacggatggatgggtggctgggtgtggctcagtgctttccgaggctgcccggcaggtccggcaccagcaatggtactgctgctgctgctatccatactagcgctagtcctaacgcatcagtgctcttattaaggatggtgcggcattatgggcgggatcgcgaccggtcgggggggccctgcgatgcatgcatgcatgcacgcgatgcgatcagccacttatgagtggagaggaggagcgccgatacatgcacattgagttgcgtggactcgatccattttaatcgtccacggctatgtagtgcccgtaggagcagttttacctgacgcgagcagctggcgcgcgcctggcggtggacgcatgttgtgtgcagtgcacggctgtttaatgccgctttctgagctcgtgattgttgcggcggtgtcgcggtagggcagaggaggcccgggccaccggccgcgcgcccgacgcgcccggtggcacgtactgcttctactggtggccagccggcgagcgacagtggccaggaggaggcagtactacgttccccgccctgcggcctgccgctcgtcacgctgttcccgtttggcgacgttaatgcgcgggcgcggtggtggcggtggtgtggagagagagagagagagagacggtcatgtgtacagggtggtggcatccgcgcgcgccgagctgaaccaaccgcatcacgtgcgtgcggtgccacggccgtggtccatgacctgccctgcccgtccgtccggcctgagcgagcgcgatggtgcagcacggtcggtacgagccatcaagcgtgcgaggacaaacgagaccgcaccgtgcgagacggaccaaagagggcgcagccgcgcaggggggccgacgtaaatgacgccgtacgcacgcatcctgcctgtgccggtgaccgaggaagcctatggtgacggtttttattaacctcggtggttgtagtagtaacaatatttaaacgtccgtacgactcgcggatcttaaaaagaaagcctctccagtaaacaaaccgcccggttgaaacggaatcaaaaggcccccttgagggctgtagcgtaaccgtacgacgataaagtagcgtgtaaccgtacattgataaaaggagtatcatttgtgagccaacgccctttgcttcggggagtaatgagttgatgtcacgttggtgcggccaaactagtccagatccgggtccggggggccatcgtgatcacgcacttggcgtttcgggagacgtattcaaacccgggcgccgagcaagcatggacgatgcggcccggcaatcaatggtctgcccacgatggatgagatgggttaggttaggttgtgtgtgcgtggggacgtctgctgtgctgtgcctctcggcatctccttggcttgggccgctgaaactgcatcgaatctggagaaaagagagtaatatacggttcctatgctttagtccactgctcaagtagacaatcttgcattaataattggttcaggtaaacaccaaacaatataaaaatttataaatgcagtggtagactagatctttctgggatggcatgatttcttcctaggacgtctagtttatccccacaatacacgttgaaccggatataaatcgatcggttaggacttgggtggttcataaattacctcccccaacagcctaggcgctgaagatagcgagcataaataaagaaaagcggaaaatagagtagcgtcaacctcccagaggcgagtgggccacctttaatagtactccaccgagagggaccaccaccaccaccacaaggcagcgagcagcagcagccccactctccacatctcacgtcacaccggacgaatcaatcaccacccccgcaccaggcaacaaaaaccgaacagggaaaaagaaagggaaaagagccaaaagatttccaccgtaaacgatgaccattattgaagccgaggaaaaaagagagagagaaagcgataggccagagtgggggccatagccatccatccgttgggttgcttgctgctgcttgcctcccccacgtccaaaataaaacgaggcagacagcttttgtcccctcgcaggccaccccacctcccaacgtgtcttccatccacgcctcaccgccgtataaatataaccctccctccccctaacccatctgcctccacgactccatccgttttccatttccactcctccccccacccaactcaccatcgccattccttccctccttccaccgctccctctctcttccatggccgtgcaggcgcagtacctctcccacgcctccttcccccacgacctctatggcctcaggtaaacgcttcgttcgatcgatcgacacctcggttggttttgatcgatggcgtggtctgatattggtgtggcctgtgcagggctctggagggtgcgacggcggcgggttctttgttcttggacgaccacggcgggtgcgcgccggcgactccggcggcggccgcggctgggatagggcacacggtgctgagcgaccttccccggagcgagcttacctgcaacgacaataacggcgcgggatacggattcgtgccgaggaagagggcgcgcctggatgcggatgagtcggccggggcgttgatggcggcggcggcggcgcagcagcagcgcatggttcttccgccccatggccttgtctttcccggggatgtgcagagcagggcggtgggttgcggcgccgcgtccaccagcgggagggctggcaatgccgccggcctctcgcaggggctcctgtctcagctctatcatcagggtgtcgagatcgacgcgctcgtgcgactcgaggtacggccttgttcgagattttgatcgagcgttcgatcggttcgccgtgatgcgcgggtgtctgactcgatcgacgtctatgttggctatgcagagcgagcggatgcgtgcggggctcgaggaggctcgccggcgtcacgtacgggcggtggtgtccaccgtcgagcgcgccgcggccgggcgtctccgtgccgcggaggccgagctcgagcgcgcgcggtgccgcaacatggagctcgaggagaggctgcgccagatgaccgccgaggggcaggcgtggctcagcgtcgccaagagccacgaggccgtcgccgcggggctccgcgccaccctggatcagctcctccagtcaccctgcgccgcccttgccgttgccggcgcggccggcgccggtggcgccgagggcgacgccgaggacgcgcagtcctgctgctacgagaccccgtgcggtggcgacaacgccggcgcggatgacgcggcgtccaagacccccgccgccgcgctctgcaaggcgtgcggcgccggcgaggcgtccatgctgctgctcccgtgccggcacctctgcctgtgccgcggctgcgaggccgccgtcgacgcctgcccggtgtgcgcggccaccaagaacgcctcgctccatgtcctgctgtcctgagagccagcctggcccgcgtcgcgcgtggccaagctcctcgtcgtcgtcgtcgtcttcccccaacctctcggccgctctggcgcgccacggcggcacggcacgtgcgtcaccccacccatgtgatcttggcggacactgagcttttgttgcacgccagtagaagtcacccacaaagttgcatctagtttaggttaaatcctcttttgttattacctgtaggtttacctgtcaatgtaatcagctaaccctactttgctgtccataacccttcacccccttctacatgattagccccaacttttttgtggtaaagaaaacccccgattgtattctcgatgaaatacatgcatgcaccaggtctagccttaaaagaaaagcagtgtcgacactgtactgtagcactccaatcttgtgtgtacctttttggctggtttgcactattccttttccatgtgaaaagatgctgcaagccgagaatattactgtcgcacaaaaatctactcgtacagcgccccggtgtagaagatatcatactagtagtggtagctgcactgctgcggtgcagcgccaatgttgtcatgccgtgcttgtggttgagccgtgatcttgactagtcttgcgctgtgtgcccccaccccacgtaaatactgggcgcctcggcatcgtgtgatcgcatcggccgaacccgggtgatccgtatatgcgtgagggattacttgggctgtgtttaatccaaagtttgatctaaactttagtcttttttcacatcatcttcaatttcaaccaaaatctaaactttacacactgaaataaacacaacctgttcgttgtactgtgcactgcagctgcatgcacggccactgcttgcccacagcgcataaatggcatgcaggtacatgtggtacaaatctctgtcggtacaaatttgactttgtccggaagctccccatgtgacggactcgacggaaacggtggcaaattttaccgtgtggctaattcgatccgtggtcgcttttacttgtggtaacagggattatggtgagatgtcgagattttgagaaagtttgaggcctagcgatcacgtgtgtgcacgcatgatgcttggtcgcggaactgaaacgagcacaagtgggtgactgcgtcgcgtcgcgtctgatgtgtgcgtggaacgccgaacgcgcctgccgcgctgccagcgagagcgaaagagacgagagctgaaagcagcatatggcatcctttgtgtgtgcgcgcctgggcatgcaactttcgttttgcagttgcaggctgtcgtagtagttgcgcgtgaaacggcagcagatgagggattagattagactagattacgggtagcagttgcctccacatgacgagaagatagacttgtttggagtacttttaagccttatctctgtctacgcctgcctactctcctctgcattactcgatctactaacctttctctgccgtcgcttaagccaagccctggcgttttcggagaaagttacgtgtactgatcgcactagtagatcagtgacaagaggggtttatgtaaataaaacatgtacgattccagaactgacgacggggatgagaggggtagagagatggaaagcgagaccttcaagaacgtctttggaagtcggagctgggctatagctttgcttcgctttgctagcttttccatcctttgcatttgcttttgcatcttgtcccttgtgatgcgtgacgcatcaaggcagcagcggcaagaaacgttcaacgtatgtacaccttggaaacttgggacgggatcgacgctatcggctcgcaagctactctagccgcagcagtcgtacactcctactagtaggagtagcttttcgccctttcggctactgctacgctagtctatgacgtgtatcacgtactcctactggtcatacacgctgctagtactactactactaggaggagtaggagtagctttcttcctatacttatttcaagtccctgttaaatcggatcaagtccctgttaaatcggatgtttgatattaatttgaagtattaaagatacactaagaccctgtttagatgggactaaaacttttaagtccctatcacatcggatgtttggaaattaattataaatattaaacgtagactattaataaaacccatccataatcttggactaattcgcgatacgaatctattgagcctaattaatacatgattagcctatgtgatgctacagtaaacattctctaattatagattaattaggcttaaaaaatttgtcacgcgaattaggtttcatttatgtaattagttttgtaagtagtctatatttaatactctaaattaatgtctaaatagagggactaaagttaagtccctggatccaaacaccacctaattacaaaactcattctataaccttggactaattcgtgagacgaatcttttaagtctaattacgctatgattttgaaaatgtgatgctacaataaacttttgataattatggattaattaggcttaaaaaattcgtctcacggattagctctcatttataaaattagtttttttattagtctatatttaatattctaaattagcgtctaaacatgagcttaaaaaagttttagcttatctctacgccgattttcgcgcacgacgggcattaactgtgcagtacgcacccagctcacaactcgatcgggtacagtcatcgagcaaacgagatcttctggccggcccgctctattgtttttgccttcttttgttcgcctgcactgaactttgtcatcactggccactgcctgtggttctcttttgcgtactgccttttgtcgccgcagttgtcactggtcactgctgttctttcacgtaaactaatggaaactccctttggccccgaatgtgaaaactggagtaaaaatgtggttacaagcctcttgccgaaatttcctttgaaggatcagtgcagttccgcttttctttctcgctgaagttaacggatactcccacattatatcatatattttcaccaattcacatgtttttgattgtaccgaagaattccactaagttcctgcttttccctactttcacgcaggccatctgtgttcaattacgttttaggcagggtagtggatctccaacctgtaagatatggactcactaatgcgtccaagaatccagatataatagtcctatcaaaggagtagtcaattataaacccgagcactttgttgccttgtcacctttgtagttacgctgagcaaacacgtgacaatagattcgatcttaagatatggttccctctagcttaatctaacccaagttgccagctccatctccaatgttattttagttgctactgatactctttctctgaagtggaccgtatgttgttttattggaagaaagcctacagtggacttggaaaaaagaaaaggcatgatgggaatatgttattagtagtacaatcttgtgaagtccacatcattggaatttggatgcacaacacaatttgcatctcccctagctttacctagagatcacacaataaaacaccaaactgtactacagagtactaaactaaagaaggtggagtagaatagaatatagcagctataattagctagtgcccattatgggagactattatcagcagtagcaaccttttgttagacagtgggattaatcagggattaggcactgatgacaacctaaaaagaggtgtaaaaaaacttgtgcggaagcaacgaatagagtactctagttggaggtcgtcctgaagaatcccagaaatgcagtgcctggaaaaagaggttgtgcacgcttttccccgcaaagaaaagaggaggaaaagtgcttggaatgtgggcctcgcacaattccttggttgggattcttgatgggccgttgaaaaattttgcgtgtgctatccatcctatcaaagcatccacctgcgtcgatccgtgctttttttggggggttgctctcgtcgagtcatcgggacatattttctcccgtgaaaaaagaaaagctcgtttgcttcctcgtgaaaaagtcgcctgctattcgctggcgatatggccgaattctaggcaagaacacgatccgcaggagcagaatcgtccgtgcgcttttttccctcttcccctttttcccagtgatagaaaccacatgagattgttctcacgccaacttgtgatgatggcctcgacgattccttgcgtttcaaccatgatcattgcagctaagctcatgaccatgtttggagaactagtcaagaattattttaaaagctattttttagcacaagaaaatagcccttcaataaaatagctcttatttgtttggatcccagagttattttgagatctattcggcctttaatgcagcttcccatgaagaaagaggaagagaaaagacactttttcagctccacccgaaatagctccaattagcacctcttgggtgtaatagtttttttggtgggttatttccaaataactcattcttttagatccttttggactatttggactatttaaggaagggctaaaaaaaaatatccttgtattcaaacagggcctatagcgcgagagaggatcggtcgatcgagcttgtctggtcggccgcgaaaagcagcggcggcgagcgaggcgtgagtggcgtttttttttctttttgttgccccccttcactttcggttttcaccggcagaaatggcgaatccgtctgcgtcctgggcgatgatggctgatggattatccgattggaatcgatcgatcgtgtcgcggcgggaagcgaattggcgtaactttcatggggaggggaatccatgattgtattgctcgatcaggtgggggaaaaaaaggaagagtctgggtaataaatataagtggatccttctctaaaaaaataaatataagtggatggaatcagaatcatgttgagatctccaaaggtggcgatggaaagtggaatacaggcattgggaagaggctttgggaacttctgcatgatcacgagtacgcgcattctctgattctagaagaatccccccgctacagaaatggatgtcccaaacacgaaacgcttcatccctaataagggcagtcccaacccatagtgtccataattagtgtctatggtgccatatcaataagacacacaatagaaactacactctacaacccatggtttcttaaagtggaccattaataaatacatcatctctcttctttaccaatcatatttattcttcatctattatgaagacaccattatctcccaatgcaaaacttgatagtgtctagtgtatagtttcttgtgttgaagctgtgtcttgcatgagacccagtttcttcctctcttcactctctctcttaattaatatagtgccacataagctaaaagtcctacatgacaatatagttaatgccatagacaccatcctaaatggagggttgtgactgccctaagacggtctcaataaaaacgttttgagttttgcctagcatgtgagtttgaaacggtttcgagttccctaattaaacggttgccattgtgaattgtggttaaattctagaaaacaaaactataaacttccgaccctatgcaccaacaaatgatgtataaaaccatatttatgtacattaggatttgaacgttgataaactaagttacgaaatgtggttaatcaacaatattcgaccatttgaatacttcctctatttaattttatgagtcgttttcactttttttcatagttaaacttatttagatttgattaaatttatagaaaaaaaatcaagcaatattttttttacacaaaatgaacatattatcaaaatatatgaaatattagtttggctgaaactaatttcgtgttgtagatggtgctaattttttttttataaacttggccaaacttatagagatttgagtaggaaaaaaaaagtcaaacgacttataaggagtagcaatttttttgaacatgttgacgaccaaatttgatattgagataaattaatttatactataacatgtacaattttgaggaccgtcagtatgggatcggtctgaccaagcagaccaatcagacatgatggccggtttgataaataaactgcatggcggtctgtgagcaagtttaataatatagccaactactagctctaaatcatctataactaatctaatagcccatttatacaatagttaactataaaatatactacaccattaatatttggtcccacctcttatacacatataacgtattggagtccgtgttgtagctggctacaaatctgtagcccactttcttctctctcttcttttttcttcttgatatgtggttatagctagtttatagcctgctattgtacctgctctaactggcatagatcgcgtgatatcagccgcagacttcgtctcatagtataattaaagcaatttctatattttttaacttaggctcttagtcattttttttgtaaaccattggaatgaggtttttttagtcataattgagttctaaaccactagaaggtggagaggctcagtgttgcaagcccaaaccctttataatggcaaccaatcaacccacacataataaatcgatcgaattgttcttttttttcatactagtatattttgctctagttttagcccgagttagtgcatcttcattggtttatgctgtaaatcgtccgtccttcatgaattagaatccgttcattgttttgttttggaaaccttccgttttattcacattttaccccaaattaatctaaatcggtcctgccagccaagttaatatccccttgattaaaagtctctcaagattaatacggttagtgactatgcacgcaccgattatttcattgtcgtcgtgaccagcgcaaaaaaccatcaacaaaactttactgaattttattttgaaccgttacagataaagcctcctaagcatttcctctattttatattataagtcgtttaagtttttttctagtcaaatttctttaagttggactaagtttatagaaaaatatagtagtatttttaacacaaaacaaaatattaccaaaatatattctatgttagatttagtgaaactagattgatatttgagatgttgctaaaatttttctataaacttgatcaaagttaacaagatttgactaaaaaaagatcaaacgtatgaaaagatggagtagtagagatcattactagctactctcgctccaaaataaatgcactcctctaattttaggagtatatactcccttcgtcccaaaatataataacttttgtttggatgagatgtattctagtactcatccaaacaaaacttgatatattttaggatggagaaagtacttattttgggatgaatggagtagtttttttttctacaagtattgaggcattcatatgcaattatgcatcgagctaactcacgacgtccaacgagtccggacagcacgccacgaatcaaatgcacaatgatggtggatgcaacacgagtgggagttttaggaccaaactgtgcgcgccacatactgctactagcaacgctccacttgcttgacaaagcctgaagaaaaaagcgcgtttcctgatgtgatctttatttaggtctctctctcccgcatctttcatgccatgacatgcgatgctatgaatgagatgagatgagaactcgacatgcatccaaagggaaaaaaaaagataaaaaaaagagaggagaaccgagaacctctctgtgtcgtggtggagcacactgcacaccatgactcgactcctctgacccccaaaaaaaaaatggcaacaaatcctgcgtttgaggccaaaagtcgctggctcgctgctgctaaaagcgagagactgtgtgatcgatcgataaatatatatccgtgagtgtgtctgagacggatcgatcgatcgatctcatcccttccatgattccatgcgtctttttccaaccttgtggatgctttcgatcatgcatatgcccccactgaaaagctacagatatctgaattactgaatatatattgatcgatgcgccggagggcggagaggtgcatgccggccacaccggtcaccatccaccaccacagggaaatgaaaccgcatcatatgtatccatggtggtcttctttatctttacacattgcctttggctaacctgtgctgttttgctgctcgaacctttctatctacctacctatactacgcaggcagctactagctagtagtactatcaatcttagtgagggcgatgatggagatgtgtgttgtatctagacagatgagaatatcatatcagtgtcacctttgtgctttgttggcatcagtagtatggatagacggatccattttggatggaaggaactcaattcttctcgctctctccctttttttcaattcctctatttgatgatggagagagttttgcaaggtgaagctaaaggtgtccaccatgtagtgtaaagctatacagctagcaagtggaggaggaggaggcaaaagtgtagagggtcccatggccatggatgggttcaaggatggatgccattgttgccggtggcagtggctgagtggccctagagcgagcagccgggacgccattgctggccagtgggtatagctttggtcagcttccggaaaaaaaggtgcaaaagctgtgcatgcatgcgtgctgccattggtccggccgagatctcctggctccatcttttgctgctactgtgttgactgaacaagttacaagtgaacagtgcctcttgtccaggattgcaatatctttagcttctctcaactcactttccctttctgaaagcttcacggtctcctaaacggataaaacacacacgcatttggagaagtttggcatgaggctgctgtttgctgtccaaattccaatgctgttaaataaaccataaaaatggaaaaagaatagaaacgaaaaagagaagttgtcagtaagaaactactagcgcaagcatgtttgcaactgatggaccatgacaaacctggcacccataggaaggtaaaccaggcccaattcgctgaggttaacgaaggtatatgagtatatccatgcaaggaaaaagctacacgtaccaaaaaaaaagttacaaacttcttattaatgctgatgtggcatattaagattgaatctagcttttctataacttccaactagaatcaaatggttgagagctttgttagtagtaagaattttgtaggagtattgtggatgttgccattggcattcggcaactgcactactatctttctctttactttctgctttattttctccttcacttcacctttccgaaagcttcaaggcttaggttaaaaagcgcacacaaacaatcacaaattcgaagtttagaacacttgaagccatgaaggtcacctgtcgctgtcgaacgccattgatacaaggaagattaacggaaaaccagtaaaggagcaaggaggagaccatgagtgttcctgtggtatacgtttagggtccttttcaattttctgttcattgaaaattatgaattggatttacaagggttgattgggaaattgtgagctggagtagttcgcattgtgtgtttcacacactgaagttcaagcggtctgacttgaaccgatttgtagcacaaaaaaaaaccgaattttgtgatggatgcacaatggaaaaaggcccatataaactactgtgggccggcatctggcccgtattgtcacggcccatttcctctctggtggtctctctcgtcgttcccgagagaacaaattccagaaatctccatgggcgattgcaggagaagaagctgagcaattcgattccttcctcccactcccactccacgcaggctccgcagccaagatcaaggcaacgaccgggaagaacaaattctcgcctgaagaaacgagaggaagcagcaaatcgccgccgattcgctcgtcggaatccccaccatccaatccaccggcggcggggggccctcaccctaggggagggggtgggtagcgcggctggtggccggaaccctatcctatccgatcggcgtgggcgagaccacctcctctttttgccgccacgcgcgcggggcggcggccgtctggttttgcggggcggatgccggtgggcgcgcgcgcccactggtctggcaggcatcggcggcgcctcgctccgcgtgccctcgcgctcccggcggcggcggcggccgttcagctacttatgtagccgcttgctactagggcgctttcgtcgctcgcgtcgtcgcgcgttggctttggttgtgtggttttgaatgggccagatggtgagttcggcggagtgggtttcctgagatcatattgtgtgtgctgttctttactgatgagtttgagctttgttctgatttccctgaaatgacaaacggtgcaggtttcggatgaaaattttgaagagcaggccgctcgtaatggtaaatacgcagggctcacatctttacctaccaattctcagttgcctagttcctcgtttctacttacaaagttacaaagttgcaccctactatttcagtcgattatctgaatatctgatagaaatgtggttttctaatgtggcatttcctcgacaggtggaattatcaagcacggaagggaaatcctgttccaggtgaaaatctgtctaggcacaccttttgctttcatgctatggatcaaatttgccggagctgacaaattagattgtggaatcaccatatatgtgttctgcaagcacagaaggaaaccacatacatactagtagtttgtcaactgacttgtgcaattattgcggagttgttatttatgtattgtcataactcataatccaggtggagtttggtaaggcttgtttatcttctggtcttgttctgtagatcattggactacctgactaatgccttccctaacccaaaaaaggaatgaacaattctgattatgttgttattttcgctcactctgtcaggcttttaactgggaatcccataagcacaactggtggagcaatttggaggaaaaagttgttgacctagcacaatcggggtttacatcagcgtggctgcctccaccaacacagtcattatctccagaaggtaagctagtcaacaatgtattgtgtcactcgtagctagttacagaaacaagtggtctgaatatctggtccctttattctgacaggctatctgccgcagaacctgtactgcctcgactcttgttatggttccctccatgacctacaagcattgcttcggaaaatgaaagaacacaatgtaagagctatggcagatgttgttattaaccatcgagttgggactactcaaggatcgaatgggatgtataatcgttatgatggtatcccagtatcatgggatgaacatgctgttacatcttgttctggtggaaaggtaatcgacttgtttttatgcaatgtaatcctattgttctcagcctcataattgcatcgtatcttaatggccatgttttgttaataaactattatcaatgtctctacaactttattaccagggcaacgaaagtaccggtgataacttcgatggggttcccaacatagaccatacacagccatttgtacggaaggatattattgactggttgatctggcttcgagaaagcattggttttcaagatttccgctttgatttcacgaaagggtaaatagtcaactcgataggttaacatcatctgtgataggggacctccaaattgctttgttaaaacatgctgatcagccacaattttctgtttagtgcagttatgcagcgaagtttgtgaaagaatacattgagcaatcaaagcctctttttgcggtgggggaatactgggatagctgtgaatatagcccccctgattaccgtttgaactacaatcagggtaagagatttgtaatgacattgctactgattgcttatgccatagtgatgctgtatctagcctaagcgtatgttccttgattgacaactgtgaacactagcatgctgattttttttacttctgtaatttacagtactgcccgtgtgaagttttgtgatttttgaattattaaccactgtcatggtttcctcttttgttgctttctactccttgtgctattgtcgagatgaagcaagggacttagatatcttttgtgaatgcatgacagttacattagattgagtctgtgtagttagcatatggtttagaccatatacaaatttcgaaacagttttctcaaccatgaaaaatgctccttgctttactttgatatggacatttggcgtatattttttttccataaactgaacaattattttttagcagataaacacaggcagagaattatcaattggatggatagcactggaggactttgtgctgcatttgatttcacaacaaagggtattcttcaggttagaaatagaaaattgttctattccttttttggggtaaatgtctacaggttagtttgatcagtttactgttgttttcaggaagctgtcaaaggtgagttgtggcgtttgcgtgaccctgaaggaaagccgcctggtgtcatgggctggtggccttcgagatcagtcacatttgttgaaaatcatgacacaggatccactcaggtataacaattactttatcttccttctatgctcaagataagcttaaccgtgctaatatttgcttggaaatggtgaagatgggctagcaaacagaactaattaaattctcatgattgcagggtcattggccattcccatctgatcatatcatggaggtatgttgtaagaattttgattgcttcatttatgacttgtaccctgcgattgaattacaaaactaattaccattacgatgatgactatgttcttataaaggttgatgtacattgtaacggccatggcaacatagaacagcccctataaaaacaacttgatgtcaataggaaaagcttttaactcagttcgttaatcttggagatatgcgcttatattgatactggaatatatatattttatgatcaggcattcttggcctcattcttttgtgttcgaacatgttgataaacatatggtatctcagggatatgcttatatacttactcatcctggcatccccacggtgttctacgatcatttctatggcaaagatgattccttccatggtggaattgcaaaactggtattgtcctgaatccttagtgctcaattgcatatctttggcagctgccagcactaagtttcaaatgttctgtactcagatggagatcaggaaatgccaggacatacatagccgctccgcagtcaaaatcttggaggccagctcagatctgtactctgcaatcgttgacgataagttgtgcatgaagatcggggacggctcctggtgcccgagcggcccagagtggaagctggcggcctctggtgacagatatgctgtttggcacaagtagatataccaacatatagcatttctttctgctgaacatgagatatgctatttcttcagagcccgaactgtatatgctagtaccatggtaatttaatcatcttcaatgcaataccagagagcaaaccacttgcaatttatcacatgctcacagcagatagtgtaaactgtaatgcgaagtgtaaactgtaatgtgaatacgtatactgtaatgcttgtgtgcatataggaataagagagtgtttatttatagaaagcattcttggaggttgaattctctttctttttgaacttcttgcatgtgccttttttatcatctgcatatatttgagtgcctttgcagaatttcatcatctgcaggctgaccgccttcactggacctggaaatcttccatgggaaggaggactccgcttccttccatcagaagacgcagattaaactggcattcttgcacagaaacccctacatttatcacacatttaacccattgttttctaatatttacaatcagatcccttgagtgagtcaatagtcgattctgtttcagaaagagaagaaaacttgaattcttgaagtgctcgtatggaaataaatggcgggaaaaatacataaattcaggacccaattcccgccctcgccgtcatctcctcctcccctcccttcccatggaggcggagccgccgccggagaaccgccacgacgaccaccacccctccacttccggcggaggcctgggctacttccacctccgcctcctctgccccgccgcgccactcctcctcctcctccgctccgaccgcctctactccctctccctctcccgccgccgcggcccccgcctccgcctcctcgcctcccctcgccgccgccacggccggcgacggcgggccctcctcctcagcacatcgggctgcgccctccgcctcacccaccgctcctccagcgccgacgccgtgcgcgtcaacggccggcccctcctccgcggtgggtgcccggccgatctggccgtcggcgacgaggtctcgctactccgccgtggcaccaggtatggattcttggtggagaaattcgtctcctgcgaacggcccaaattggcggcggcggagccctgcggggaggttcttgtgctgcgggccgagtcgctccggaagcggctgagggcgatctcggagagtcatgatcctctctctttcttgagggattcacattgtgtggagaacggcagcgatgatgttagggtgaaaaaggcgagagaagaagatgttttcttgcccctgaacctgaatgctccaattgaccctgttgccgtggagggtttactgcgagaagactgtaatcttggccaggggaaattggagcactgcactgattcagcaattgcaaaaaatgaaactgatgaattgattcaacggagcaaggggtcctgcgatggcaatacagagcagaaggaatacagcaatgagaacacagagcagcagcacaatgagaatgagggttgctattcagatgggagcacattcttcctgaatcgcctcattggtattgggtctgatatgagggtggagcaacggagtggagtgacacttccacagcttctgcatcccatggatagcttggagcgagtatttatcgcaacattcacctccgatgtttcctggtgcgtcttctctctgcttgtatatcttcctttgcttgcaacattgagagatatatgattgaattattgatgggaatacaaatttgtgtatggcctaaggtttctggattactgtaaggttccacagaacctgccggtgacgatagcatgccacaacaaggagaggtgctggagtgcgagtcgcgaaagtagaaccgctgcccctttcggaagttatcctaacctactattagtgtaagtagcaaccttgtgttttgttcagtagttgtctgtatatatatctcatgcttctgcgaaacatgcatgataatgaaacactgatgctaatgttaattttcccctcaagttacccccaattcccagaggagatagcatttggaaaggataggaagaagcaaggagtggcatgccaccatccaaagctcttagtgctacagaggaaagacagcatgcgtgtcattgtcacttcagctaacttagtacctaggcaggtcggtatctttctgtactccatgaatgtgcttgttactagaattcagttcgcacctaggcaggttctgcatttctgatgcactctttaattgtttgttctgtttgtggtgatttctgctgttattctcggtgaaagtaaattatgctttgtgcagtggcatctcataacaaacacggtgtggtggcaagatttcccttgtaggacatccacagattattcagctctttttagtaaagttgaggaatcaaaatcagatttcgctactcaattagtttcattcatagcattccttatcaatgaagttcctagccaatcatattggataaatgagatagccaagtataattttgaaggagctgctggatacctcattgcttccgttccagggatatatgcacgcaatcctcactatctggagtccaattattgcctttcagtaagtcttatttcagatagcatttgttgttccctccttttactgaagccatttcactaagcatcttaacatactaagttactaactataatttgcaaagattatcaggcaaatatactatggctaagtggattatattcctaatctaaactagacactactgctgttctttcttgaaatagttctaatccagccctattatcttactagccactatccattatttatgcagagaaaacagatattacacaccaaatcggcacataggatgtttcttggttctgtccaaacatccgtagttggtctgtcccatcggtttcatataccatctgatgctggttctaaactgaaagccctgtctgtacttcttagtaaatgccatgtgaacatgcatggaactacagaagtgatcttgaagaggaatacaaatatacctgcagatgctaatgctgtgagtgtcctagttgctgatctggataaatttaccgaggaaggtatgtactatgtacacctcaaggtttacatcttttgctaaacaaactcacctccaaaaatattgtgttgcatggttcatgtggcaaacaaatacttgggattttctgttatggtagcaaataaccatgtccaatgccctgaaatagattcagtccatcttggtttcctgcctagagaggttgcaaagtgggtatctcccctcagtgacttggggttcttcacattttctggatttatctaccccagagaagccctggaagctgcatatggagcaactaacacaaaagtgcagttgcttctctatgtatcaaaggtatgtaaaagattcttacggatgccttttcataagtcaagagtactactgtgaaattgtccatgcatatcttacagtcataaaattcagggtccagagttttctcaaatttcaagactgatccaggatgaacattttcctcttctgtgctcattagtagcatccttaaagcggtcccttggactttggcgattagaagaggtttgcaattttatatgggcaatatatgaccttgatttgataaattatgctatgcgtaaactgaattacagttctttgagatgattattctaccatattatttgtttttttttttgactaaatcaccggggggggagagattccccacctgaatttgtcattgcattaagaggaaataagttcattacaataaattgagagattgtaagggggaggagaaaatttgtttccaaacagatattacataacgatcttcatcctttaagttctccgcccaaagagctgcctcgcttatgcaacgttgcaggcaggatcagatggaggggcttttctcgctgaaaacgacgtcatgtcggtggttccaaatagcccacatgcaaagcaggaagaaaacctggcagtgaagcgccggcactcttgaacttgggcccaaacgatggaagtgcctaacgtcttgaacttgcggttgaacgttaatcatcgcccagaaagcttgagcgaacggacatgaaaagcacatatgattagctgtttcttcctcctgattgcagatgtcacattttccgtcctgaacaatggttttcttcagcaaatttccctttgtggacagacgattgcggactagtaaccatgcgaaaagtttaactttgagaggagctctgcaattccaaattagttcccaattaggcgaatgcaaaccagggggcagtcgtgcctcatagaatttttttgttgttaacctccctagctttgtactgagcctgaaaaaaaaagaccactagcagtagtttgaaggtgattgggataatccaaattcatactaattgctagctctattgtgagataatccataccgcctgttctatttacttgcattaatcgagtgtcaactgtattttccattggttcaaacaggtgttgtcacatttcaaatggcctgaaacacttgagactgattttttctacagtgagtaaaacatttttttttcttagctggaatcaattgtcatattcagggattccttacttcagatttaaaatatttgtaggtgcttcatccattgggacttcaattaatccacaattcattgcaagctttgcttcagcagctggtaaacgatgtaatcaggatttggactccgaagagtctgatccagaggtaaattttaactgtttattgaagcatcccctattctaataaacccctgcccttttttgaccaattcttcacgcacataacttttaccaattttcattggttgtcctagtggggttgctggacagcaaaccatgagctaaagaagccatctatcaatttgttgtttccaacaattgacagagtgaaaaatggggcttgtggaattcagttatccaggcatttgctttctcttcctgaggtagatttctcttcttgtaacttactatttgcatattttaccaataagagagatcatattgtatgtgcgttatacttgatgtgcttgtaaggttgtagccaagtcttcttttccattttgtgcctaaagctgcatactatccttgtgtgctttagttcagtgaattaagatgttatgcatatcgggataagcaactatattgatctgtttagagaagcgacgttaagcatattgctaattcaggggatacattcacagctgctgtgttgcagtgggagtaactctttccttttggcagagaacatggcaaagactgagatctactggcatatttcgtgacgcaatcccacatccatacgagaggatagggcatcctatgcatgtcaaggtacgatgttatacatatcttgggggaatatcatggtttatactttgcaacattgtttagtgacatgttaaatcatgagttcatgacaggttgcccagagacgcttcgagtctcgtctaggcagacactcattcggctggacttactgtgggtctcacaatttcagtccagcagcctggggacaacaacttcctccaccaaaagcaaatcctactgaagccagagccgtttcttctggtccgaggctacacatttgcaactatgagctcggcatcatcctcattattccaccatctgccatgtcaaagcagatcagtggaaggaggcacgagatcaatgacattgtcctgccattcgtcgtccctccaccgcaatataagctgggcgataggcctgcgacatcgttagccatgcgagaggccatggctgaagctagaattctgcagagtaacgatttagtactggacttgtcacaggatacagacgaggatatacctgatgaagatgatgagcatgtgattgagctgtctgattgctcccctgaagagaaggaagaggagaagatctacgcagagacgctgtgggagcaagtagactcttcacaaagaccaggctggccagtgaagttgaagtccagatgtttcggatgacaagttcctgtcatcgcatctgatttcaagtgcaggcagccgcacgagatctgacgattctttcttactgaagatatttgattcgattgtgatttgttagaattgtattttacaatgtgtagtatgcattcgttgtcaatctttcttgtaagtatctcaatacatctatacttgaacttcacagcgtatatagttgaagtttatttcaaaaacttttattgagctctaatctgaaattctgaatcagtctgctagtgctagggggtacatgttttacaccacagaagaatcacaaccgtccaaacagttctggacggtgtggatgcttcgcctggaacttgtgttcaccaccccaaaaaaataaaaataaaatccaccgtgtcaatccccacgccacaccagaggccacacgccacagccacaggaaacacacaagcaggcgacgtggcagccagagaggggctaagcctccaaccccacactcacagccgcgcgccgcaggaaaaaggtggaaaaccaccgcccacgcgggacgcgccgccgccgccgctcgccgccgcaccctcacgcgcagaggaggagcccccccgccggagcacctccacctgtttactctgagtgacatgtccccctcgccgctgctcgcccggccgccggcgccgtcgagcccgagcacgtacccgtccctcccgcctcgccggtgcgccccggctgtagcttccgcggcgctccgcgtggctccagccaccgcctcccgagccccattctccaggtaacccccccaccttctccctctgtctccttgttcactggctcactgcgaaatttgggctagagtttacagtgacgcgggtttctctttgatgccgcaggctggtgaccaagcggaatttcgctgcgtctgatattagagaagactactccactccgattgacgtcgttgccgatgtgaaaaccgagaaggcatgaacctgagcagctgaaattctatatcttgcttgttaggtagtgccgttttactccctcccccaacattctgaagcgtttctcgatgtcttgcagattgtggtgttgggagggagtggattcgttggctctgctatctgcaaagctgctgtctctaagggtattgaggttgtgagcctcagcaggtaccacaaccttttctcgtataccttgaaccaatcaccatatgttgtgtaggtcatcactactgagaaatgcaatttttttcatcatgttcctatatgtttccaatagcttccagtctagtcttattacctcacatttcgcaccttagcttgcttattttcgtaatcggatcaaccaacttggtctcgcagtgttaactttctgaaggtctttcttgcatgacttcttgactcttgggtaggctgtccagtgtgagctcctaaagtcttcatactcagcacaaaccatagttttgtatacacattttttattgagggtatgattattggcatcaggggggttagacaaagctttgaaaattggtgtgagtccgagaaaaaaaagagaacatgtatatactatatatctgactaccaaatctgcgttctgtcacatttgcttcacagtgtgtgttcatggcaggtcagggagaccatcttactctgatccttgggttgatcaagttacttggctagcaggtatgctttagttatgtaaatcttctgggttactggatccagcttactaacataagttcactctccaagcctagtagtgttttgttgttgatcgaaactggatatgctacatgtcatgatgctttgacctgcaaataatggctttatcaagtagattatagcgcaacttacaggaagaatgccaatcaccagattttatccagagataatacttttacagaaatatgtacattatgtgtaacagaatctgtggtactttactaactttatgattacgccattctttttacctttcgctttgttggccgatggcatgtctacagtatttctttctgcttgttgctgagttctgatagatgcatatattgtttgtttggaaacaactctgcacctaagtacttatcattgcctctttgttttggccatgattactggatttaacattattctcacagagaccaaacttgatttatggcctcagtaattccaccttaccatcttgttcctgtgacttagtcagatgactatattggatttccaagagtgtgatttatatactgtgtttattttttgctgctctgttcatttaagcatcttactatgttgcaggagatgttttctatgcaagatgggatgaagtgttagttggtgccactgctgttgtgtctacccttggaggattcggtaatgaagaacagatgaaaaggataaacggtgaggcaaatgtaacagcagtagatgctgcaaaagaatttggtaagtaccgcattatgacagtggtgtgccaatttgtttgcatatgcatatgacatcaggtgcatattatgcaattccatgcttaacctaagtttctttgagcagtcacactgaaagatactctttccttcgaattttataaggagaaattttacagtcattgataaagtacctcgaggtacctaaattctactctaatttttttagtaacttgaagtactaagtaattggagataccaaattctacactagaaaatgtagtacctcctggtacgttttcagtgatagtaaaattacccttttttgagggttctttgttttgcaatcatctgcaaattataatctgttcatgtattttgttgctattctcttctactattatttatttcgttctgttctgtaaaaaaataccaggactaaccacataaaagattgtcttatttttcgaaagaacctaatgatacattagtcattctcttctataatcttctcaatctcacaaatttcttaatctatgcatgggtcaaatcagaaaatatgccttgtaaaaattgactgaagggtgtaaaaattgactgaaggggtagtatattgtgctgtatgatgcaaatcaaaccaactggattttttaactcaaaatattcactcaaatgctctgataagtaccacacttgacaactcactgtaatgtgtctacgaggtgtcaacaaatcaaaatgaattactctatgttggtactatcattatgagaatctagagagaaaattgcagcaaatgtacccaccctattataaagtataggctcctacttttacttagttttgcaatttaccaagtttctaattactgtaaagctgacacatgctttgattttattgtagtttaaattatataaatttgtaagcctgaaacttgaaggtagtctggcacgcgttgtgaaataaatgaattttgctaggaaatttgttgtactgattactatgacagattaaatacctcaaacagctggaacttatccctcgtacaactgtgccactgtctcgttaacctactctttccttttttattgaaacggataaaataatgtaacatagcttctttggtgtattcttctgcaggaatccccaaattcattttaatttctgttcatgattacaatcttccatcctttcttcttaactcgggttacttcactggtaagagaaaggctgaatctgaagtcctctccaaatacccaacctcaggttagactatatttatgcctccaaaaaaactcactttacatttttgtcatgtttctaatctatatttttttaatcaggtgttgtactgaggcctggtttcatttatggtaaaaggaaagtagatggttttgagataccactcgatgttgtaggacaaccattagaaaagctactttcctctgttgaaaatttcacaaaaccgctgagttcattgccagcttctgacttactccttgcacccccagtgagtgtggatgatgttgcctatgctgtgatcaatggagttatagatgacagcttctttggtgtcttcacgattgagcaaatcaaggaagccgcggcgaaagtaagagtgtaaactgggagtctttattgccaagatggaagattcaaacatgcggctccttattaagagatatccctgttctgtcttgcactcttgcagtcttagatcatacattcaatggttaaagttaaattcaaaactttgtacagtgtatgaatgtggtgcttgttccctccaagcagagaggaagaatgggctttgatggcaaaggccaatgcgcttcatttcttacgagatgcattgccaaatgaatgttcttctggagtacttgtttaaggtggaagtaatcactgattctctgaacctaaccccgtattcaggttgacaccatatccatatgctcatatgcttaacatggacagtaaaaaaaaatttagataggttttgtgttacgagtgcccctagatatggtgttctatgatttttttagataggttttgtgttaagtgtgagtgaacttgttaacttatcactcgactgtgccgagtgctcttctgagcaacaagcacaactaaatatacacatgtaattaaatgaaaaatactcaaacaagcaccatgtaacaaatgctgttgattttttttggtcatttcaatgatacaccaatgttacatgttcatgtgat

SEQ ID NO: 63601 - DNA, 1579 bp, Oryza sativa
ttctgggtagcagtttccacattttatgcgaccaatgttaatacactagtagtatacttgtgaagtgagttttactctaattcttgcactttcagatttctctataaaactattccaggcctgttctagctgatagacaacagatgaaactaagtttatgacaattatttgaggatacaaatgaatgagttgactatcagaaatttgataagttgattttatttttttctaagaaatgttgatgaagaatgtttttttttgaaaaaaaaactgtttaggagattaggaaacgtgtccacgataatccataatatgtattgtcattagaatgcccgtaatacttgcattttgacaatatgttggttggcactaggtagtcagcttgtatctggcaaatccgaccaacagtatgttatgcaaaagttttttttgtttgttattatcaacatttgtttgtaaatccaactggtgtgtgccagtgttaaaacgttatagtcatgcgtggtattttgaagaggaatgaactgacgaagttccactgttattttatcgagaaaccgtttttttttcttgcaattatcaggcatctgcagctgtatggctcttgaattttgacttatctgcaacttaacgaatctaattgcagcaactggtttataaatgtctcgttgctggtcagaataatcaggcagctgacgtatctgtatggctgtatcagaggtgttagtccacttgacgcttgctcattttgcaagtactagtaggggctgtaggacaagtcaaagaaagcctggtagataaaagaggttaccgccaaatatttcaactcaaatcgaaagcaacttgatggaagcactgcatgaagattttcaacgagatgtctaaattattgcaaaatgacgaaggcatcaacaacgacagattcacagttaaaacataagtacatgtcacagcgttaacataggttgaaatggagctgtaacaagctgattagacccattaggtttgcgttattatgcagcatcaagttactttaggaactttgctataatttcgtaagaaatactaattccccctgttaaaaaaacatcttttttttactatgaatatggatgctttgggatgatactttgcttgcatgctgcagcattcaacgaaaagtctgaacatgcaggcagcaatgtttctacatgcctttctttctctgaaatattcggcaaagataatatatctgctaagaaatataaaagagtcacaatatttttaggccatgtttaagctactcctaaaatgtcctcactagctgaagacactcgtagggaaactcagctcgcaatgtaggatacccctagatgggctcctcaaaatctgaagtaacttaatagagacactccaacccataataggtattccaatacacaaagccccatatttatttttactaccctacccctaatctctctctctcccaccccctcttctctttttcttcgccaccatcctcgcctttccctctcgctgccgccgctcgcctctcccgtcgccggcggccgcgaggatgacgaggagggccgcctct

SEQ ID NO: 63602 - DNA, 4564 bp, Oryza sativa
aattttataccctgtcacatcgaacgtttgaacacctacatgaagtattaaatataggctaaaaaataactaattgcgcagattgcagctaatttgcgagacgaatcttttaagcctaattgcttcatgatttgacaatgtgatgctacagtaaatatttgctaatgatggattaattaggcttaataaatttgtctcgttatttactgacagattttgtaattagtttttttattagtgtccgaacacccccatgcgacatcatatataatacctgatgtgacacgacaaaactttacactccgtatctaaacacccccttattttatacgcaacatagattttgaaagcacgagagatgaatataaaaatcagtggccaaatgataggctgctagcgatatgcgtggcctatttctttttagaatcttcatagcttcccgagatatcagcacatgctcatgctcttagtcactctagagtctattactatacgctccctccatctctaaatataagtgattttggttggatgtgacacatatggagggagcagttactactaagttaaaaagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgctcggcttcctcgtcttccccttcatctgggccgtcccggagtcgctcgtcaccgccgagctcgccacggcgatgcccgggaacggcgggttcgtgctctgggcggaccgcgcgttcgggcccttcgccggttcgctcatgggcacgtggaagtacgtctccggcgcgatcaacggcgccgcgttcccggcgctgtgcgccgactacgtcgcgcgcgtcgccccggccgtgtcgggcggcggcgcccgcgtcgccgccatcgtcgccttcaacgtcgcgatctcggtgctcaactacacgggcctcagcatcgtcgggtggaccgccgtggcgctcggcgtcgcgtcgctgtccccgttcgcgctcatgttcggcgccgcgctccccaagatccggccgcgccggtggcgcgccacggcggcggacaaggactggaagctcttcttcaacacgctcttctggaacctcaactactgggacagcgcgagcaccatggccggcgaggtggagcggcccgggaggacgttcccgcgggcgctgctctccgccgtcgccatgaccacgctcggctacctgctgccgctcttggccgccacgggcgccatcgacgcggcgcccgaggactggggcaacggcttcttcgccgacgccgcaggtaaattcttccgatcaccaacaacgccatcgaatcgaatccagtaatcagatcacgttcttgcataatcacaaacacctagcacgcgcgccacgccgagattcttgattgattgatttatttattactttttgctcttttccattgacattggtacacgattccatcgaacgtgtggaccatggaaaacaaaaaagatttttttttctttttgcggggaaatcaatcttttttagtgttgttgtgattgtcatgagccatggcaagttaacaacgtgggaaagaggagaccaagcaattaggcagaaaggaacaattagatgatgatattattgtcgtcgaagaaaatctctataaagtcaattccccttagaacaatatggcaatatctttacagtactgtcagtacagctacctctccaagaacagtacaaaagattatgtgtcagtgtcaatgacatatactcctgtttagagctagtcaaatcctataaattaattcatatatcttactgtattatcttaatttggtgttccatttggacaatgataatgatgcccaacatttctaccattcttcagctgcacagatgaaattaattacgcgctgcatgttccataaaaagaatacaacaaagaatacaacataaatagtagattgtaacgacgcataattaccttatacctctctctttctcagaatttaaggcctgatcaaacttgacaatagtctccaaaactaatatttttttcgcatgtactacctctatttcaaaatatctgttgttttagattatttagtaaagattaatgcttaaaaggaaatgaccatagcgccccctattaaatgatgtatgatggggagtgtgtcggtagtttagagtaggatagagaaaattttcaattagaggtaactaatgtaacaaaaggtacttttaagtgacaaagctttttgacaaaatttaaatcctaaagcgtcaatattttggtacggaggaattactacactgtctataggaacagagtcatagctataagaaagtatattcaaatgtcaatcccgaatccaataataccgttgtcaacaagtaaaatttaatttacatcaaactaattgtcagtaaaatattatattgtgatgaggaggagtgagtattttccaagcttcacacaacaatcgatttacgcggcgcattaatttaacgatctctgcatctgcattgcactactgtggatggttgatcattttgattgatcactttctctgcaaacgcatgaacacgtacgcaggcatgatcgccgggggttggctcaagtactggatcgaggtgggcgccgtgctctccaccatcggcctctactcggcgacgctgagcagcgccgcgttccagctcctcggcatggcggacctgggcctcctcccgcgcgccttcgcgctccgggcgccggtgttcgacacgccctgggtcggcatcctcgccaccgccgccatcaccctcgccatgtcgttcaccagcttcgacaccatcgtcgcctccgccaacttcctctacagcctcggcatgctgctcgagttcgccgccttcgtccgcctccgcgccaggctccccgccatgcccaggccctacgccgtgccgctccggggcctgcccgccgccgccgccctctgcgccgtcccctcggcgttcctcgtcttcgtcatggccatcgccgggtggaaggtgtacgccatcagcgccgtcttcaccgccgccggcgtcgcggtgtactacctcatggacctctgcaaggccagagggtggctcacgttcagcgccgctgccgcagaccgcgcaggca

SEQ ID NO: 63603 - DNA, 611 bp, Oryza sativa
tttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagttctatggcccggaaattggattatcaccctgagacaacatattctatgcgtttaagggtcacatatgatcacaaaaaaggcggggggcacgtgtttacacccaaattttgcaactatggacgaaataagggaaaaatggt

SEQ ID NO: 63604 - DNA, 539 bp, Oryza sativa
tcggcgctggaggccgccggctgggtgttcgtggcggccgacgccgtctacctcgtcggctgggtcgccatcgagggcggcgccgtcgccgtgctggcgtacagcctcgtcgccggcctcgtcttcctcagcgtcttcggcaaggtctacagattcttggcatggttggagacgagacaatctcaatggaaatcaagcctctgccatagcgctgtatgatactactactcgtcagaaaaaaaaaatctgtaaaaagaaaaaggaaaccatttcttagctcaccttttgttcatttgtacaatgattcacacaatgagaaaaccacagttgtaatttttttttcatgcttatatataagttctctgaaacaaatttgttcaattcttggacaagttttctgaagccattctgaactttttctgatgaatcttcagagtttcttttccatttttcgatagggtgtttgagagcagcttcctgattatagcacacattagatattcagcttcgaattaggcacgtgtactacacttttgggg

SEQ ID NO: 63605 - DNA, 606 bp, Oryza sativa
gtggcccttttgtatttcgactcggtacccctaacgacgtcaggatgcatagttaagagggtttgagggagttctgtgctttgagattgtgacgggacacgtgttgcacaagggattaagtcttttgcaggagcgtaagacttcagtcttaccaaattttcttcccagtctgtgacacacaaaagctttccaacgccaagcttgccaaggcacttgcattttgtttgttctatgtgtagatcctgaggaggctgacttgctcggacctggccgagggagcacattgggaggtggtgctcatggcgctctccgcggcagcaacggcactgctcgtgctcgcagctgcagcagcgatcgatgaccactactcagcgaggcacctcacgtcgtcgtccaattcaaacaaatcagaggctgacttcgactagatttacgccaaaaaggaaaccgcgagttgttctccgaattgatagggatcgggcatgacctccacggaccgattgagaaatccaagaatcaatcgcgaaggttgagcggagtggagaggagccacagaccaggtgaccacggaagaggaaagcatgatcggcggccgaacgtcgacat

SEQ ID NO: 63606 - DNA, 2362 bp, Oryza sativa
  unsure (1)..(2362): unsure at all n locations
cgcgaacttgannccctttgatatcgaccctgatatggcgaattcgagctcggtaccccttctctctcatccccatttgatgcaaataatcattttttattcaggcttacccctattaaatgttcatgacacaccagtgaaacccccattgtgactggccttaggctgagtttttcgcacgcaccttaaggtgaggttgttattgcaactcgttaaaggtgtatgatattattggttacgacagctgatctgatacagataagttttttacattattgatcattcatgaatgactagacccttcactatcacaaatgacggtttaagtacgacatagatgacatgttccgcaccagcatgatattgaattagcatgttataatatttcaaaaattcaaaaacatggattttatcatcgtttccttagtaggaatattccaaatatatatttttctgttttttctgacttttctatatatgacaaatatgaagcatttggaatcctctcactggccccatctacaatactccctccgtttcgaaatgtttgatactgttgactttttagcacatgtttgaccgttcgtcttattcaaaaacttttgtaaaatatgtaaaattatatgcctacataaaaatatatttaacaatgaatcaaatgataggaaaagaattaataattacttaaattttttgaataagacgaacggttaaacatatactaaaaagtcaatggcgtcaaacattttgaaacggatggagtattttactaaattcgcattttacttcttatcaagatctccctgccatcgatgggaatcatactacagcaggcgcttgacctcactatgaccaccaagacaatagttcggtcgtttactccaatggtaataaaaacacatcaaaataagttaatgtgttaactttatttttcgaaattcgatgcagcaatctgataaaaaaattgttaccattaatattaatgcagctaattaattactttttaattaaattgaagtattttccatgataccaggcccatgataccacattgctgatcacagagctagtagctgtggcaagagaagagcatgctctgttgcaagagtgtctcgagttgctgggccgagtgtctgcattgcaggtagctttgagtcaatatgttccatgaaagaaaacagcatatattcttttcccttatttttatttaacgcgatgcttatgctaatcttcattgatcgtgcaaatccgcaggttgaagaagagagcttgcgttgccatatgcttcagtcatagttactgaatcttatgtccgttgatacagtatgatgacagtagctaaatgttggcttgttcgctctgttatcatttttaaccttaccaaactaaaataggttgaataacagcagtaaattaatatttttaagctgattgcatcaatcagctgtagacatcacatttttgtcagtatacgtaggggctacctaatgcaatacaggaaaaaaaattgaaaatatactgtttattttttctaaaaaatactataagcaaactttattatatgaatagaccatcgtcgcgcttgaaataaacgaacttgttaacgatatcatcgtgtcctatcgccgcggncacttccgcctagccctnnccgccgcaccagacctaacctaccgcggtcgtcgctgacatgtgagatgtgagagagaagaggaggggatagagagagaagagagatgggagagctgacatataggtccaagggtatttttgacattccacatgatttctctctcctattcaaccgaaaattattatttaaattggtgcagtgtccaccagcaaatatccaacttttgggagtattttccccaaagtcatttcgtgtcatgtcctacagttaaaaccgcaaactcacgatgtcatgtagcaaaatttgcctaataaaaaacaaacagtggatccgctgcatcgcgctcccgacaagcgaacttacacgattaataattagtatcattagtaattgattaatgaactattatttttctaataattgttgtcgtgacccaaggtcacggacaaatagggggatagacgggagctaatccctttactcattttggcatttgagtcgtgccttttcgttttttgtgccccctcatctgcgagtgctccctccacctcgcgcctatataaaacattgttggtcactatcagagagcctcacgtgctccagttttatctcgttctttgaccactttctctttctactcgaactttctatagttttcgagtttaaccatgggtaaaactgtcaagaaaatcgccacaagcctaagttcaaacagtcttcttcaagctt

SEQ ID NO: 63607 - DNA, 5574 bp, Oryza sativa
tagtatcttaaaatcctgactactatctccatcccaaaatataaaggattttagctggatatgacacattctaatacaataaatctggataggtagtctgtctagattcattgtacttggatatatcacattcacccaaaatcatttatattttaagacggatagaatattataatccgagttgcacaaaatcatagtgattttagcacgtggcaagtaaaacggataatagggtagttttgtaaaattttagaaccataatattcggttacgtgacttgataaaatcactgtggttttgtacaatttggatcaataaaaaacttaataaactaggatgaaattttaaaatcaactttaaaattatattttaaaattcaaattgtagtcttataacccgaaaggcaaacggtggacgactaaaaaattgaaggcagcatatgtcacgagattagcctgtgatctcttcctccctttcgaaacgaaactgtgcattcgtacagcgggtggaatgtgctacgtacaggttcggttaagcagaaacagagagggggcagtagtagtatcatggagcggcgtgcgcgttaacaaggtacagcagcgtgtgggtgcatcacgagctgtaccccccgctacgtgttttttctttctttcacggcgagacgtgacactgctgctcgttttcccactggcgcgacgcaagcaaaagtttcccaaagccggcggccggaggcgcaggggaccagggacatccagccccgtgcccgcgcccgcgcgccacgcacgaaatcagcgtgtaccccccggtcccgtgacgttactggactagcagcagcggcaaggagtaaatctgttgcgatgccggtacacgaacacgaacgtactggtggtacggagtctacggactgcgtggtggtacacgggacgagtaatattctcatgcatgctgctgctggtggtggcgcgcgatggatcaatcacgttgcacgcgcctcgacgcgacgccagcggatacgtacgtctttccggtggcgcggcaggggcagcggcagcagcaacaatccggtgccgcgagcgcctcgtgatccgcgaggcaatacaagtattccttccctatactcgctcatcacaagtggaggaggggaggcggggcaatagctgctgctgatatcggagactgttccgcgggtcacatgccgcggcttttgaccggacgcgtcgtcgtcgtcgtcgtcgttgtcgatggtgtggtgtgttgttgatgggtgatgggtttgcgccgctgcatgccagtgcgaggcagagcggcagcgagcctgcgacgctgcggctagttccccctgcgacgctggatctccggtcatgttagcatgacgtagaaggcgcggaacagtcactagtcgggggtcgtcattgccatatatgacgcgcctgctcgctcgattcgacgcctgttccaaggaaggaccccggtcaccaacccactcggggccggggcatcttcctcatccccttgcctgcatccattcgtcatttgattcgcttctctgagggcacccacgatagttatctataggctctttataagagatatatatcagcatatttttctacttggaagagattaaatgaaaagagagagcaaagctagctactaatctgtagatagtttatagagaaaaacgagacaatagattagagagctatagatacccatatagatatactattaaggtggtttactattaatattgtctattaccgacatgtacatgttttatagagagcaccttattttaccattacgggtgctctgagtatctactactcatacaaaaaaatatatgaatatctactattttcatctcataaaaaaaataacctactagtgaatgtgaaacattttattaatataaaaacatatccaggtttatatagtattagaatatatcatatttgatactaagttgatttttatacaacagaggaagtacatatgtccaggacttaccaaatcgtttgggatagggttaccgtcacaccacggtttgaccgttaccgcgagttataccctggtttcaaaaattaaaaaaggttattgcacatcataaccatgatatatcagcacggttttgtaaatcctctctctatctctatggaatactactcttccaatttttccattacatcaaaactttcctatacatataaattttcaacttttccatcacatcgttccaatttcaaccaaacttttaattttggcgtgaactaaatgcaccctcaatctactatgggtcaagtagagacatgccctataaatatcaacatatttagaaatacgataattaccatattataagaaactgtaattttcacaagaatacggtaaatacggaaacgaacggtaaaacagtaaaactatttccgtttttattttcatatatttttttatcgattatcattttcatatagctcgactgatagaaagtcaaaaacggaccctccctacttgtactccgtacgttgtagtacgagtacactcctacgtctctctctttctccgtgtcttcgggcgtggatggtgtgcgctagctatagtagagctccgggataagtgcggcgtcgcagatggcagagacggggtgatatcgcagcggtctgcctcgaccagtcagtccatctagtcgagcctcagcctgaacctgccgccctgtcacacacagcgcttcgcaccagccgctcactcattggctactcgctgtactccacccctttgcatgccttcgcatctgttctcgtgcacacacgccctttccacccctatattcgttccatcatcatagcctagcttaaccagcatctcgttgcaatctcaggaggtgttttgattcaggagcttgaaattttaacgtgttacagtgcattggatatcggatattatgttcagatactaataaaaaattaattacagaattgattaataaaccacgaaacaaatttattaagtctaattaatctgttactcataaattattaaatcatggagtaattaggattaaaaattttgtctcgtaaatttagtcgttatatgtgtaatagatgtttttagcctatatttaatactttatatatgtgtttaaacgtttgatatgatagggtgaaaaattacgggcgggatcgcctcagattatctcagccatatcctatataacctatgctagctgctcttctagtccaactggtagagtgttgtgaatagccagttcagttcatcagttgataggagccatgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatgggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaaggttcgtcgccggcgacgctcgctctcgccgtcgctgttctctatctctgcagttcacttcgcggtttcgccgacgtacgtcgtgtcgctgacattgccgccgtcgtacgtttctctgcagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactagctataggcgattaactagtgtagcattagcgttggggagaagggaagctgcaccgtttttttggggaacattttgtacggtcgcacgctcccggattgatcgaactgtatgcatctgctgtgctgtgttgcacgctagctagctagatgactctgatcttgaaacgaaccgtgatcatttcattcatttggaatgaacatgtagctgtgcaaggtcatcttgctcggaaaattcataatcttccaatctcttgtgctgctactactgctgcatctcaattctgacgcgccaataagcaagtgaagagaaaaggaaaatgttttaaaccttttttggctactatacttggttttcaaggctaaatagattaggagaaaatggcccaattgggccggaaactccatcgagcccaatggttatgtgggctgcacagaatgggctgtcccagtagatcggaagtacggaacggctgaaatcttgtaaaccgaaggggttcgaagattaaaactcggaccctcctagccttgattttctttcgcggattgacacgccgagtgattagaattcaggattagcgagttggaggctgagtacaaaccctttttgcctcttggacagcgctaggaattttcagcatcgtgcaccgactattctaccctgaacttctgaagagcgacgagagcctgaacttcgaagcggtgttattttaaacccttttttttccttaagaccttcgaatttaagaccttattttttccttcacattttaaatttaagagtcttaagaccttcgaacttgcaaccagtagagaggaaaatcaaatgcacataatcagaactaacaaccctcagctatatatttgctcaaaattcatcatacggcatgacatattggcatcttcattgttccatccatccacatggcgtgcgtgacaacttgcaatggtccattatattgtctcttgctactgctccattctatatttctattgcacatacatgaacacatgatacaaaattacaaatgcaaccaatacacgcttgccttagatacacatgaactcaagaattcaaatcttgatgcctaatccgatagctcacggagccaaatctgttgccgactgacgtgcaccaggctgatcgccagacaacgttggcctgagcttcaccggaaagaaaatgcaatttcctcaagtgttcttcctttagtctccggcacccacaggcatacgaaaacgagggtcccggcacacacagcagcatagatagcaaatgttcctgaaaaaaaaaaaagagcatacatagtgacatgagcctggaaggaa

SEQ ID NO: 63608 - DNA, 1463 bp, Oryza sativa
cagcccgagattacaaccgacgacacggacgagacaacaccaacaacggtagcagcagcggaaacaacggactaacatctaacaccacaggcgacggctgggaactaggacgaaaccctaatctttgcttcaacttcatattcagagctagcagaactatatttatatagagagcaagggtgagtacttacgtattcagcaagccaggggaacttaggtggttaatgcaagcttcaagggtaggctgttatttttcaatcagttttatttgcaagttttcaacaatctaagtgtgtgctttccacaaccagagcgagacaggtctcagctcggtcgggggtgggaagtgaacaatattatttatcaagattgcacaactcccaaagttggcctcaaagctagtttcccaaaccaaaccaattttccaaactttcagagttttggttgtctccaaacaaccagtcacttttagggactccctgtcccgctgtctccctgatagccacttgcctttccaaacatcaggtttcccaaaccacatcactttttcataaaacagggggaaaataaaaactacgctaaggaatcacctcacatccgcccatgaccgtgggcacggccgttcgaacagtttgttaacctctgcagagggggtacactttacccacacgacattactaacccggatcacccagcctgtggggatcagccacgtcgggagacttccaagctttcatgacaaggcatttctaaagccgacacaggtttaccatatgccgacgagagggatcccagaccaacaacaggttaggtcccagaccatattgtgccaggaagcccaggggtcctccccgacaccaccccggcgaatccacttgtctctcggcatcaaggctcccctgattagctaattactcagccaggggtgtcccattccacccatgtggttgcactatcatatgctcggatgtaattccgaaggaatcggtccttaaaagcgaccgcacaagcatcccgcccaggaatggccttgtgtcgcaagttttatttttaaagctcattttctttcacaaggcaccgacccaggcgtcgggttttccaatcgttttgtaaaccaagttttacccaagatgtctaccatattttaagtttgaaggcgaccgtcgatactcacacagagtgcatgaataccgaggcgtgaccaggtggttacaaggaaacatgatataacaatttaacaatggaaggattaaatgcaacaagttaggtatgcccaccgatctgcctcgcagacggggcaaacatattatgtgcaatcctatcaatgcataatattttgcaagcaatataattaagttcaaatataggctcaagatgttcaaaggtggcttgccttgctcagagtcttcacggagcttcccgaatcttcgagatatccacgatcgaccgaaaatccgcaaccg

SEQ ID NO: 63609 - DNA, 1892 bp, Oryza sativa
cgcccggcgtcccgctcgcgcgccttcctgcttcacaaattcgccgccgacgcaggagacctccagtctagatggctctcgcctactccttcttccgccaggaggtgagatgattcgatactttgctagttcctcctgcaatttgcgcgtctaatgaggattccgtgatgtagtaatttatgtgaggttattagctcgctttcattgggctggggagggattgtccttgaagccctattttagtattcatccacagtagaaatctctgaattttttgttccagtagggtttccccccggatttgggacatttttcccctagttgttggttaagcaaccaattccccattctttacccagtttatccagcacaattttacaatttttagttttaccagcgactttttagcatactgtgtatggacatgtgattgtgtttaactgaatgaatttctctatcatctctggaggatatacagtgtgcagggccaacagtgtttatttggtgctaatgcattcctttgaggttgtaacaacacgtgcccttttggcagtccaactaaaaaacttggaagttggagagtgtattataaacattttgattttcttcaacttttctaaacatgatgtcttatgcaattcaccttaccctccaatgccctgatccatgttacacttatgtatctgccaatcatttacattctggagcaaaaatagttttactgatccagtaagaattttcatttcacgtctttattcttgctataagaatcaagcatctgttttactgttctttatcttcttgagaaaagacagtggttttaattccatgaaacgaaggtccatgtgtagtccttttttactttctctttgaaaaaaatatggaattaatatctgttcatatagcttcttgttgagttttattatgtcttttgttcacttgcatcaaccaagcatgattggagcatcattgtaggttgaaaacatgcaagtttctcagttttgtttgaatttgtgtcctaaaacctcatggtttgattgaatttgacccgagtatgtgtattggtgctctattacatatatcatctttccatcgtttataccacgttaaatttcttgtacacagaaataaatggtttaaacctatttatttccttctgttcagattacagaggaaactatttctttttgttagctgaaaaatttgctcttgcagatgtatgaagaagcagtcacactttatgctgaacttgcagaggctgcgcttacaagctctttgatctcgaaggagcctccagtgattgaaccagtcaggttacacagtgggaccgaagaaaacaaggaagccttgaggaagtctcgaggcgaggatgatgaagattttcaaatcacagagtaccaggcacaacgaggcaatactgttgcaatgcacaaattagggcttctgtattactatggcctacgaggagttagacgtgattatgggaaagcatatcattggttttcaaaggctgtggagaaaggcgatacacgggcaatggagcttctcggagagatctatgctagaggtgctggagttgaaaggaactacactgaagcatacaagtggttgacacttgcagcaaagcagcaacaatactcagctacaatggactgggttatctctatgtcaaaggttatggggttgagaagaaaaacttgacaaaagtaagtatcatgtattagagttttgaaatttagttgcatgtttgtattgggcttacagcctagaaaatagaatcttgaattgcattccattgttagacgatagaatcttgaattgcatttcattgttacaactcactatatccactgctatcgttgtttctagtcagggaaatctgtaggccacta

SEQ ID NO: 63610 - DNA, 2412 bp, Oryza sativa
ttctcaacaatttttgcagtgttccaactagtagtagatgatgctgtgatagaattgtgagtgagaatcattaattgtgctccagttgataacttgatatactagtacgtaccatctatctccagatgaagcaaatcacaaagacacaacctgatcaagcataattgagatggaaaccaaacaaggtagcgcctatagaaactttcgctggttttttggtggaaacactttcaaatgaaatagcaacatttgctgaatcacagctgatcacatccatcaagactgtaaacttcactgaagaaaaccatataaacagcaacaaattcttgatctcgggttgcttcaccaccacatcacagctttggcttttcttgggagggagggaaaaaaaattattttcttgaatgggtcaagtaaccatttccaactttccttggactctagcctacttcagtaaccttttcaacttttggggatatattcccgttgtggttggttccccgggccttccggtccacttctattcgccatttcggtggtacaacccttccaccatattatctgtggccttgtgattggatccaggtggcggggttcgccttttccgcccctataaaacgctcctcgcgttccccctgtctccccacagcgatctcttcgaacgaacacacagggtagcgctcgcgtagtcgcgtactccccggcatgctcctcacacagacgcgatggcccagggaagaggcagtgcagcgcaggggctcgccctcggcttgctcctcgtgtgcctcctcgtcggctcagacgtcgccgccgccgccacctacaacgtcgactggtcgttcggcgcggacagctggtccaagggcaagaacttccgcgccggtgacgtccttggtgagtgatcgatcaaaaaaaccgtttcgttacttgattctactactatggcgcgcggcggcgtgctgcatgctgctgcttgggctaacttgtgtactgtgccgcgcagtgttcagctacgacccgtccgtgcacaacgtggtggcggtggacgccggcggctacagcggctgccgggagtccggcaccaagtacagctccgggaacgaccgcatcacgctcggccgcggcacgagctacttcatctgcagcttctccggccactgtggcgcagggatgaagatggccgtcaccgccagctgaagaggaagccaacgcagcacaaaagcagggccaggctgctgccgctctagcctgtagctatacatatttacatgtgtcgcccgaacagcaataataagaggcagcagccagcaccgcgtcatcgtgcaggttttgttgtcatagtgcgtcgcaaacaatatatacagccatatatgtgtgttatgtagggagagtggtaggtgaggcatgagtgatgtgtgcttgtatgtattatcagaagtcaggagttgattactagtaaagcacatcagcttgtttgtttgctctctacagcgcaagcagaatctgttgtctttgtcttttagttttgcctgattgatgatggttttcttcctctgggttttttatggcgtggcagaaatagttctacacatacactcccatttcctggtttctcatacgttccttttgtccgagttcattttctcctcgtcgcccaaccaaacattcctgataataattaagctgaaaaatatcataatacttgttaggaccagggatgaaaccggtcggaaactttcacataaatctgataatgtaatgcaattcgtaaagaaattctacacaccaccatatcttattttagaggaaaaatgatggttcaagtagttcattcaactagtgatgataaacgataatcaacctgaaaaaatgagtcagcccaaatcgagcaaaattaatggcccaagtgccaaaggccgtctctatggcccatatcaagtgctaaaggcccaaagcacatactgtcccaccaaccggcccattagaagcccaagatccccagccaatcaggtttcaggagacacgtcctaaaccgtgggacccacatacacgtcatgccaatgccactctcgacgagaaaattgcatatctaccattgcataagattggcttcgcagaaataccatcacttaaatcggcttcgctagaataccactcctaactagaacggcttcgccaaaatgccattttggacaaaaatgaccctggttcttctcccttcctccaatgccggaggagctcatcggcagccaccggtgccaccttgccggcgacgatgggggcgctgccatcctcgtcgtccccaccttttcatcctgcccgccgcgctaggaggaggccgtagccgacgccatcaacgttgatggggccgaactcatcggcgacgaaagcggagcggatgaactcaccggc

SEQ ID NO: 63611 - DNA, 66771 bp, Oryza sativa
  unsure (1)..(66771): unsure at all n locations
gggggttgggggtggcttttcgttatgtttgttagctcactagccgtgtgattggatcattggaaatctgtaatagcagtgtggttagcatatattttctgggggattttgtgccggagtccgccattcggctgttggttgcgcgtcaatggggaaatcagtacattggctagtactccggaaaatttggcattgaagagagttttgcgaattggttctggacttcccacgggaactacaagtgatttcatcatgatatagagtagtaccaggatggccggatgggatggttaactctaccatgaagttgccaactgctagtaaatttaggtggtgttttcagacagtgaggagttgggggggattcggagatccactaactcataaaaaaactcgaccggcgggggaatgaccgtccccgtggcttttcattaataagaacaggcctcaaccaaactggatgagaaaaggcatgaaccctgcaccccccccctccccccaacaccccacacgcggactcgccccctatggattggtccttaacctgtactttgaggctcctttcttgtacacaaggcccgctctccataggtcgattcataacatgtgtttttacgagaggccagcgagtaacattttttttaagtaggcctaaaattcgctctcgaggaaagtcgaacccaggatctagaggtgctacttgagcattgtgaccgctagactacatgccctttcacaggcccacttgctcatgctagaagagtcgttgaacgccttcctccttggtttgtgtcttggttctactgtcttgctaaaatcccagtgatttcactgcttcaatgaactattaaaggaaaattagaagttcgaataacagaatggtgaattggtttaaatcaaggtttgagatttcggatttgtgagtgggtcccagcagaaaatgtctctggccaaaaattccaagtttgtatttatttagcgaaaagttgttcaatttgaaaaaaaaaatctgaaaatttcgtttaacagttgcttgcattccatttaatttttcattgttatgtgattttgcaacatccatacaagagtacttagactcaacaccttacagaacggctcacttcaccagtaacttaggctcacaaccatgcacccacagcattaaggatacttgcaacaaaagctcataaaagagacacaaagcattaaaagttcgagtaacagaatggtcaattggtttgcctcaatttttgaaatttcggatttaccagttggtcccagcagaaaatgtctctggcccaaaattgcaagtctatttatttagcgaaaagttgttcagtttgaaaaaaaaaatctgaaaatttgtttttgcggttgcttgcattccgtttatttttttcgttctgaaatgtaaaaaccctggtttactagacatagatgaacgtgatagttactaaccattactccagtatacagtcactaaattattcagataacactattaccatgcattatactagacattctatgagtagctggcaggatcatattcttccacaaggttttgtagaaatgccggtattgggggcaacacgacatctcgagtgccctgcaagatatgaactatctgctgcattgttggtctatgagcctcgttgtcctgaatgcaccaacatgcaaccttgcatgctctctccagctcttgaacattcgtgtcatgcattctatgatcaaatacttcagaaatgtcaccattgcttatcctgactgcagcccagacaggaaagtactttatagttttactctccatcaattctgtgttccttttgcctgaaattatctcaaacaacatcattccatagctgtagacatctgcttttgacgtgatgggaagacctgcgatccattccggtgcaagatatcctattgttcctctcatagttgttagtgcccgactaaaattccgatccataagcttagcaagaccgaaatctgccacttttgggctgaagtccgcatcaacaagtacattttctggttttatatcacaatgtatgatgcattcatggcattcctcatggagataatgtaatccttttgcaacacctagaataacttggaatcttgtgtaccagtccaacaccttcacattattaaaaaggtgacaatctagagaaccatttgttggcaacttttttgacaagtcgacgagcacgatcgcaacacctaaacgccttgcggtgatatggagtcgccaaccacctcgatctagccaaagggccaaattaagatgggtttcggagaaaaacaactaaggccctctttgtttaggcttataagccaacttataagtcgaaaagtctaagccaaaacaaacaagcagctttttcatttggcttttttaagccataagccactctaacactattaagccaaaagctaggttggagaagctttttttggcttatatgagatagatgtatgactctaccattaaacttaggacattaaatccactggcttataaatcatataagccaataagctgacttaaaagtctaggccaataagcctaagcctaaacaaagagggcctaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaaattgtattcgggggttttacaatgaaccggcggccttgtcccttaaatagggggttggtcttgccctctacaggcccttctccacgtccaactcgggatagaaactaaaggaaacacgaaacatgccttcccgagcaaggaaacctgagacccgacgaaaacagactcggactcggaccctgccggtctgaccgcctacatacctgcggtcagaccggccctactagccggtcagaccgcccacacacctgtagtctgaccgccctgtgaaggaaacctgtcactttccaaactttggcaatcttcccctatttcgtccataggtgccaaatttgggtgtaaacacatgcccccctgcctttttggtgaacatacgtgaacctaaaagcatagaacatgttatctcagggcgataatccaattactggccataggacttcctaagcatcttgccaaatgctcgggaagcatttcttcaagtatttcccattaattgatatctgaaaacaccatcttgaagtgtcttcatctccttcaaagtcttcaaacgctcgtcgatgacatcttcaaaaattgcttcccatcaaggtcttataatcttcaaccgacaagtcgtcttgcttgaaataccgaagagagccaagatttacctcaactggcaaaacggcaatttcaacaatgttttattactcgactcggcttatccattaacctgagtgtaagaactcaacaacttaatatcataagattcggcaatacttctcacttccttggacataaaagaagctcctttaacgtttgaggaataccgaatctatgaacaatatgcttcaaaatagagtcaattacctccgtacaagtaatattctcgagcggcacggcttcggcccacttagtaagtaatccattgcaactagcacgaaccaatgctcttttgatgacgaagaataaatttgaccaatgaaatccaaagcccaacctcggaacggccatagtttaatgataggattcaacacaacggtaggcgctagttgaacattgccaatccgttaacaagcttcactccctctatagcatttgaaacaatcatcaattattttcggccaatgaaaccccactctcctaagcaaccaatttatcttacgggccgattgatgaatttcacaaatcccttcatgtactactctcctagcaacttcagattgatcattatctaagtaatactccatctatttttcggtgatataatatttgaacgcttgccgccgaatcttccgatcaaccttaagtgtaggatctttcaaatatctaatcaaaggaattctccaagctatttctaactcatgggcacaaatgttcgaattcacaattaatttggccttttaatcaattgtaacgtgccccccagcctcctgtctgggatcggtcagaccggccacgcaatgccggtcagaccaccctgtctgcccggtcagaccggctatgcagagccggtcagaccgccggtaccaccggtcagaccggccgtgcaatgccggtcagaccgcccttggtctatgactttgccaatttcgtccaaacttttaaaatcaagcatcggcctttagtatataatttttcttcacataatagccagatgcttggtgtatcaaattattggaccaaaattcctcctctctagacatatgaaaaactataacatccaactaacatgtctagatgaatactaattcaaatggcttttgaaacaataatcatcatggcatcaaaacacttagccaattgaataatgaatcaccaaagtcatatgcctcacacacatgaattccaataaactacaaatgtaagtaatcggcttgagcatgtatgcaaaatattaataatgccaatgtttctaaagaaaacaactctagaataaatcatcacattgaccattgacattagccgaattactaataagcaaaactttcatggtgcaataattataaaatctatatcttatatggtgatccataaaaacacatacaatttggctttaaataaatatcaaagactcgtgaaccaaatcatacttaaaacaaattatatgccaacctaccaattccactacttagaactggcatttgcaacatgtatgtataatatcaatttgataagcaaacaacacacatgtgctagatagtaagcaatgttctaacatggcataggcatataatataatgttaaacacaaaaaaacccataccttgccttagcatccgacaaacggcggctcaaagatgtgatgttgtatccatcgccgttcatctctcttgatttcttcataagcatattaatgtcttgccccccgagcaaaatcggctttcttgattgcacgatttcaaaggcaagacgaacaccgcaccaacatccatagcatcatgtgaaggagacttatctctaatgaccgatgattcttctctcatcatattggatttatcactactttgggaaatcaccgatctcttaccttttacttctttaggtctccacactcgcttaggtgtcgttcgaggctctaaattattacatgttttgttctccacatcttcggcctccttttctttttgacctatggcccgaagacgctgaagcctcctcttttgagagcgagataagccggaaggtatccacttcagctgtggttgttttccaggagccaaatgatgattcttcatatttttggtcgaagtggaagctcctgtgttgctctcaattttctcactcttctctaatgccccccggtcagaccggcctctaggcccggtcagaccggctacaaaccgtcgatcagaccggccaggaaggtcggtcagaccggccgttgtctggcggttagaccggctagctgttttggtcaagccgccgatgttgacagtaacggcgtcggcttcagtcttctccgcttgtatagttttcggcgcatctccagtaggtacatgaacatcttaagattcctcattgatagcaacgacctccggagctttggcttctttcctcacccacaccttcacctttttcacctttgatccaccggaccgattcttttgtgggaaacggtcttgtcttgagttagatgaatgacttgatgttgacctaggtgattccttccactcttggtaatacggcataggtggttgatgcatccaaggcatgtaatacataaaaggataaccatatagtgacattggatatggataccatggcatcacaaccggaggtttgtatggagttggtatagttgatggctccgattgctttggtatttgaccaaatctcttcctacaagatgatcttggtctttttgaatcactagtttgattatcaagtcgttgaccggctaatcctttattgtacttagccataagcatctcaaaagtgagcttcggctttttggtcctttggaaactagatgactcatcctttgcatctttatgatcttcggccttcgcatttttgatcctattcttgggccgaggatccccaataataacacgtctccctttctttttgtcaacatcaataggactaacagagagaggatcactaacaactccggtcttaggcatagatgtaaccgaaataatttcacaagtgaccgatgaatcatcaaccggtcttttctccatcaagtttgcatctttaaaataatcatgaaactcatgcttcatttgtgaccatgtagaaattgaactaggagcaagcaaactataccatgtagatgcaaagtttgacaaagaaagagaaaacaactttaacttacgcaaatcatcgctaccggccttaccgcattgatcaataaagcggtcgatatgctccattgtagtcatagcattctcacctgtgaatttcgtgaagttgggcacctcaaatccttgcgggtatggaactgaatctacatgttcaggatacggcctttgatatatatgcatggctactttggattctatttcactactatcccgcaagacattgtcatcatcttttccaacatctacatgaccgatttgtgactcggtcttaggtgacaatgctatttcactttcgcttgtaatacaatccgaaccgtcatttagttcggctatatcttcaatgatgctattctctaagctagcaatacaatccgaaccaccacttggttcggctattccatcgttgtctaaactagtaacacaatccgaaccaacacttggttcagctataatggttgttgcattattttccaagctagcaagacaatctgaaccaacatttggttcggctataatcgttatggcatcattgcacaaatcattaacacaatccgaaccatcgcttggttcggctatacatgatattgcattatcatctaaactagcatttaagctattgtcatccactcggctttcctgagccggagcttcatgcaacacatgatcaacatcaagaaatatctggccattcaacctctctttaatagaatcaagcaatccatcatatgcaatgtcggccaaatctttgtcagttattttcaagctataacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaaaaaatagaatttaccggtaaagaagtaaaccatgtaaaagcagtaccggacaaagataaagaaaacaagcgcaatttaaaagtatcactattagcctctccacattgcgctaaaaattgacctacatgctcccatgtggtcctactatcctcaccactaaatttggtaaatttgggaactctataaccacgaggatatggcacattatcataataattaggatacggcttttggtaaaccttagcacgattcctagtttcaatcccaaatttatccctaataatctcactaattatctcctccatattatcaggcctatgttgaattggtggtggatttggtggcctaataggttgtgtttgtggcgcaatatgattatattggccttgcctagtatcgtgagaatatcctctagcaacatcattataagtattaggaacatgcgggggaacttggggattagttgtagcagtagatacaggaggatcaaatgttctaagatgatacaaataactagcattagtcattggatctatcccctgaatcggtatgattgtgccggtctgaccggtccagggctcggtttgaccgacatccagaggcgcggtcagaccggcctgagtcccggtctgactgccggggtaatatccagtcggaccggccgtttggccggtcggaccgacggtgaaatcgcggtctgaccggccatcaggttcggtcggaccggctatatgcgctgctccatcggttccactacttgtttgatctataggagcttgactagcagtggtagaggctttatttttaaacatgtaatcggccataagagggccgaatttaaatcttaaaaactcatcaaatttaccctcaaaagttgcatctaacttatctttaaaaacagtcatggatgaatctattgtagatgctacttcttgttggatagattgtgttaccttcggtgaaactgcaacttgaggtagcggcacgtttcctttcatgacgtcttgatcggtcttgatgtattgtgtagcaatattgttgaaccgttcccgctcgtcatagttaatgaagaaattccttgattaaatccggccatatagctcatagccgaaatatttgaccgaataaattaatacacggtcttggaattttttctctcgcgatgagcaatgtgtgcactaattaattccaccaaaatcaacagataaactttgctttgtctctctgtagatcggctctggtatagcctgatctttttgatctatgcacgtatacagtaataaaaggaaacaatgctcctgctgcttgtctctcggcagatcggctctagtagcctgatcttttcctctgttgccatgtgaaacaaaaggaaaggaggttgccgagtcagctactgctccctgatgatgatcttcagtacacacggcaagtgttcagatggattcggtgacgaccaaataacctcgccgccgattagattaatccggcgatactagattaatttcggccgtttagccgaaacttggatttgacgaaacggtagctactagattaaacgaaattcggccgtgatatggccgattagatcgttccccagtggagtcgccaaaaatcgtgttggcaacttttttgacaagtcgacaagcacgatcgcaacacctaaacgccttgcggtgatatggagtcgccaaccacctcgatctagccaaaggccaaattaagatgggtttcggagaaaaacaactaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacagcgcaaaccgacaaagatggactaaactagggtaaaatagaaaacatagtaaaagaacgattcaagtaagttgtattcgggggttttacaatgaaccggcggccttgtcccttaaatagggggttggtcttgccctctacaggcccttctccacgtccaactcaggatagaaactaaaggaaacatgaaacatgccttcccgagcaaggaaacccgagacccgacgaaaacagacttggactcggaccctgcctgtcagaccgcccatatacctgcggtcagaccggtcctactagctggtcagaccgcccacacacctgtggtctgaccggccctgtgaaggaaatctgtcactttccaaactttggcaatcttcccctatttcgtccataggtgctaaatttgggtgtaaacaccatttaccataaatttatataccagaagcctttcagctcctcaagcaaaacccctcgaggcaaaccagatttgtgtggtgaattcgtcctaaggccctcacctcagtttgaaattgcttctcgcgttgcctcattccttgaagcttctttacagctatcatttgagagtttgggagtgatcctttgtacactgaaccaaaactaccttgccccaacttatctgagaaattctttgtgcagtgctgtaaaaaagagtaactgtataggatgagagaatcatcattggagaaagccttttgagttgcattcctttttcgaaacgtccaaattattgcaccaaaagcacatagtgcaacaaaggtacttcccagcactgcaattagcctcatatgatgtgtcttatgttcattgtattgaacttgaagatcagatgctgcaagacgtacataaatatcaatagcatcaacattaccagcagacaattgtttaagatcccggagctcactattccaaacaatgcattcatgttgatgtgcatatgcagtacaaatgcagttgttcaggcatatggatctgcactcctcctcgctttgaacattcaattgcattggattgcctggaactttgatgttggcaatcttgagaaatgcatgcttctcttgttggccattatgtttattagagtcaacacaagagatatctgttttcctaacacaaccttgattccatgctccaagatcccagctcctcgaggaaactggcctgaaacctggcaggcaatagcatttctcatcaaaacctgttttgcagactccaaaaggcccacagactgaataaacagcacacagagctgcaggtagagaccattgtactatccattcctctgatttgttggaccatgtatggcattggagttgaccgttaacggtaagaactattcttgtgattatggatacatcctttgtggtgtatataaacttgagctggtgactattattaatgaaaacataattgtattcagtatttagtggcattccagggatcgatgtgaatgcttgtcctgtccagttcccagactgccaataaactttagattgattccagagagagacatattggttcaatctaattagatctacatggttggagaaaggacctggtgcaggatcttctggatctttccaagaaacacgatcctggtattcaccggtgatcttattgatcccaaatctctgcccactcagtattgtgtctgttgggtgatcaaagctttgccagattacatcagaagagttaccttgatccctcagaataaggtttccattgtcaagaagaactgcaactattgactttcttggtttattccaagtaccatttgatgaccattttggttctccaaacttgttaaggaggactaaatttccatcctctgatatcttgagctctggagatgtagcacttgtgacaggattgtctcggttggccacccagataacagccttctttgatgtggttctgaaccatataccaacataaaggtttccagtattacctggagagaagaatcccagctcaaaatttccttcttttgagacaacagttgtactaccagaaagagattggactcttgagattgtatcagtcaaagcagaagtacttgtgtaaagatggaagattgataatatgagaaaagaaaaggaagaacatatcttccacttgctgggaggggccatcctttttgcatggaaatttggatgtgtggtattcttctagttaatgcaaatgccacaaggtagagagttatttcttccctctattgtcatccttctcatttgacttgtcttccaaaataatattctttttatgttgttagtctagtttcctgtgaattgacggatgctattgtgccatctggaacaagcacaaccatgtgtgagcacttgataagagttagacacgacttgttcacaaataagtccagacacagaatgtgaaacggacatcctcttttttttgactaaagaacggacaccctctttcaaactctgaattcttctcctagttgcttctgttttactgctgttctggtgattcaaaccaaataatgtcttcttttaagcatcatatatagcgatataactcacctttagtaagttatatatcatatttgtcctagtagtaatatgttcttcaattgcaacgctgttttggccattgaagcatcagatgtttttggtggttcatcttgttattcaagtgtaaaaggcagaagcatgataaagctgtgcatccccaggagcatagatggtttatttggcaatcactttttttttcttttcatgtaattgcataaaatctgctgtgcatcatgctgtagtttcgatttcagttttacatctttcttaatattgtttttcatgtgattatgcatctgtagtcatcagtcagtacaccggcacaggctagtatttttattgtgattttggaacatcattatttatatttatgaatattttaatttgatatattgagaaaactctatctaaacaacaagaaaattccttgccagcacttttttaaatcttctgagaatacagtacacttatatttttcctctttgccaacgaagttattactttgggtgtggatacttttgtaatttgttgcagcatgatgcttatatttagtatggaagtttagtttttaaactctggaaattaaaacctaataaatcttttttttcatggttacttacagcctaagaacatttttaagacaagattagtatgtaagctagctacatattcctctaggtatgctttagttgtatgccttaattcatactgattgggcagatagtgtaaatcaacttgattagaacatgggaatcgaaaataaatctaattattctgtgtatatttatatgttcagaccttgtatacatagagttactatgaactgaactttgatttgtttttccaggccatgtgcgcccaggaaacagattcatggatgccttctggttcttatcttcatattgtgtgcaatgcatggaacgcatgcttctgagttttgactattactttaaaaactactactactctgatacttattatctattgcatgtagggtgtagatgaaaacattaaatcaaatttgacggtcatggtttccttttttaaagattaatgtgctcatgtttagccatttttttattattgtgtgaatttatttattttagaatttttaagattaatgtgagggcttcttattagtataaacaaagcttcagccgggattcttctactggcctgccaaaaaactattttgtaaatttacaggataacaatggtgtaattactcagatgatggcatttggcccttaagaatttgaaaaatatttaaccagtgcagatgttaaagaaaatatagctactccctccgtcctaaaatataagcattttttgaaccttgacatggtctccgagatactactttgaccaacaatatctataaaaataagatgttttaaataaaaagagttgcatattatgattgtttgtttaataataaatctagtaacatcaattttatatgattgctcttttttaattttttttttgctattagtggtcaaagttaaaaatgtttgacttgtcactgtgctaaaaatgcttatattttgggacggagggagtatttattctcaagtagctcaagattaccaaatttaatctattcagattgttatgtgcaagcagatcataacacctgaattgaagcacatgttgggactctatcaaatgttaacatgtgcagtcaggcctcctcataggttaaacataaaaattctaatacatggtggatggctcaatgtgttagttcgtgatagctcaattatgtgctattaatatacagaaggcatggaactacagaactacagaaaagcatagcatatgtacaacatgagtcactcatattactctcaaatacgtaaatgtctttccctaatcaaattcaggattttctgatttatgtgctctgaaattgtgaaccacctgaagtagaactctttgtctgcgaagaagctgtgctattatgcatctgcgaagtttgacttgatgaaacatctgagaaaaaatttatgacatcagggctttcatcaagaaccttcagtgaccttggaacaggaggcatgttgacatcaaggaatccctctaaaatttggacgacctgacccattgtaggtctgccattttcatcatcttggatacaccagcaggcaaccttgcaagcttttgtgagctcatcagcactggcatctccattcaacctggggtctaacaaggtctgcacatcaccttcctggagtttgtttacagccaaagttgggaagaaagaggactttccctcctcccctagatcagcattccttctgcctgatatgagttcgaagagcatcatgccatagctgaagacatctgccttaggagtaatcggcacaccactgatccactcaggcgcaaggtaaccccttgtccctctcattgttgtcaaaacacggctgaaatcccgccctaagagctttgctagaccaaagtcagacactttgggtacaaatgactcatccaaaagtatgttatctggcttaacatcacagtgtattatgcaatccctacatttttcatgcaggtaatttaggccccttgctgttccaagtgcaatttgataccttatggcccagttcagtgccgttgtctcaccatggaacagctgcaattccagggagccctttggcatgtactcatagacaagcagtcttcttgatccttcagagcagaaaccaagtaggcgaaccagattgacatgttggatggtcccgatggtgcttacctcagcacggaattgcttctccccctggctcagtccatcaagcctcttcactgcaatggctgttgaatctgggagcttccctttaaatactgtgccaaaggcacctccacccagcttctctgagaagttgctggtgacatgctgcagatcactgtaccggaaggcaatcagtgcgccccctgtagtcttggatatgcgaagagtcctgtctcggcggcatttctggaatacgatgaacaacacaattgcaaggattatcaaagctgcagcaactccacctacaactgcaccaatgatcattttcttgctctttttagagtctggaagttcagacgctgcaagcctgaggaagagtgtgcctcctccattcccattgtattggtcttggaggttaatcaagtccccatgccaaacaaagcagccactactattgtaagtgtaagcattacaggagcaattattcaggcaagcaacctgacaggcctgagaactagcggccactgcactctgagcattatcaggtagcctcacactaaccatggaatagaacttatcaggctgagtctgtgcagagcttgagttggtctggcactgcacccgtacgtttctcttgcacccaccagtaaaatcctggaggtcccaatcactctgaaacttctggctgaaccccttgatgcagttgcagaacggcaggacattgaggttgcaacttccatatgcgccgcagagcccgtacacctcacactgcgtccgtggctgggaccagaacaagatccaattctccgaggctggtacccatgtccactgcttgatctgcccattcacatcaatggtgaaccgcgagatgatcgagtcatccttcatggagtatatgaagtagctctccgagacattgttaatgaaccggaagttgtagttgtagccggccgtcatctcgggcacaagactgaagatattaccgttccaagggccgctggtccagtaagtgatggagtcgttccactggatgaagtactgcgttgtgccgttgggatccagctcaagggagaacagcccaggggacgggtttgcattgttcctccatggcacaagccgctggctcacaccagtggtcttgttcagccccagcttgccgcccggaagccaggtgtttgtcggatgatctatgctcctccagtagactatggatgaattggtggcatccatgaggtcgaggctaccgccgtcctggatgacggcaacggtggagttggaggccacacttacgttggtcgaccacagctgcctgttcttggattgatcaaggaggacaagattgccatcgctgccgatggacaaggatgcggtggtcgggtcagacaccggcacgtcgctgttggccgtccacaccgtcgtctgcaacggtatgttgttgtaccatatagctatgtagtagttgccggtgccggaggcggtgttgttaccttgtggcggggtgtagaatccaagggcgaacctgccgcccttggagacgatcttctgcgtcccggacagcggcgtggtggagttgatggtgtccactgcggtgcagagaaagatttggctgaagaggaggaggaagaagacaggagccatggatggatcttggcagagcagccagggctgagaacctgggacgaatggaagctgagcttggcctttggagtaatttgattatggtggttggaacctgagaggaaggtaagcttggtcttataactcatatggacagcaaggctccacttcacgagatattgcagaatgaacgctctttgacctggcacagtagagggttctgtggaaaaggtacatacccgaagacctggtgtttgtttatagaagaataatcaatatgaaatgtaatattctgtttaaagttgtggtgaattattaaatggtgggttttattttgtttttttgcaggaggggtgcagaaaattggttctacagttttgcttgcgaaatagtactgttcctagtattaattaattttgctgcctgttcaactaatcaacttgtgttctaggattgaagatattcgtgtcccctcttagtaatttattagtattcacatttgtgaacagagacgccaacatctgctatgatgctatcctcttagtaatttattctgttgcgaaataaatttaaaaactaagaatagtgtgaagtcaaagaaaggtgttttggacttgtggcttgctggtggcagcaaaagctccgggggctctgcgttgacttggccttagtttaacgtggccggtcgttcagagaaactcttttaagacttgctagtattatattttgctgaggtttcaaaattctctgtgctaataatttcaaactttgatcaggaccagaccatctccctttgaagatgaccaaaatcttgaagttggctgccctgttttctctcatgtgggtttctagagaccgggtaagaaatgttgctgcaagaaaattagctggtcatgttgatcggcgaatagcactgtcagtgttagaattgcctgctgatctgttgaaatgttgagtgttaccaagactaacagtatttataattttggttcatggatatctgttctttccgtaaataactttcgtgtttctcattgcgatcaatatagaaaaagcttctgctgaacagctggtgtgaacgttgtcttcctacacgtctgtctgctgttttttcttcccgtcagatttttgttctgctttgtttttgtcatattctagtttttgtacacatctattccttcctgattgcaaatttatcaaattagttggtcagtccacattttgaagggctaatctggtatgatataaatcctatgtttcagaaaattgggtgatataaatcccaaatctgggttaaacactcgttgccatgtttttttataatactgttgttgccatgtttgagaacaggatttgttgtcgaacttagtggcccaagcttgacgatgacttgaccaatgaccagtttccttccttagttcctgtgtcgaagcatgtctcagcatgttaaatgctcactcattcatttatgaccagttctctgatatgatgctgatatggaccgagagcattgaagtggcattgatggagagcagatggatgaacactgatcaccatagtgtggaggggagagggccacagacgcaacaaggagatacaatcatacagataatggtgattgaatctcatgaagacgaagacaaagacgaagataaagattaagtgtttcacgcaaaataaggtggtaataacgtgtgattaattaagtttgaattattacaaacttgaaaaatagattaatcttatattttaaaacaacttttatataaaaagttttcacacgaaacacaccgtttagcagtttaaaaaacatgtcatttttatccaaaagtttatccaatatttgttggagaaaagaacatggcaatattaatcttataatactagtagttggatttttcatcaacacgcgaaaaagggagtacatgagaggtggtgcggtgccttgccagttgccatgccactggcaaattgcaaattgtaaggacgcattcatgtgtgtcactgccggtgtccatgtgcatcgcacaaggagagtggcctgaagaatttcttgttgattgttgaacatgttgatctgtcctgcagtaaaaaagatggtccaggtctgagttaggacgagtttgctcaaaactcgcaccatattgaccgttggcttttttaagaaacggcattgatatctgatctgtatgaacaaatagcaagacttgcatggccataacccatccaacatgatagatttgaaaaatacaatgtttttttttcattcttaaattgccccggcaaaaatgccaaaatggtaaaaaaaatcatattgtaatgttttttttgcatctctagagtagacagatagagaggaccagataaggtaggagactacatgtagtatacatagtgttgatcaacgacctgcatttagttcttccataatatagtcataaggttttcgggtacatgggccaagggccaaggaacgtggtatgcttcttacgagagatttttataaggttgggataaaaatatccccatattcctgtgattggaatgatttcttcaatcgaggaatactaccttcgactatttcttgatatgctcacctttcttcttaaattattgacactaaactccttagattttctttgaaccaacctgtttacttctatttttattttaccctccatcgagcacaactcttcatctttcctagtcccgtctcaccacaacccaaatcctagtgccttcctctagtcccccttcctcttcctcaccagcaagctattggtaaagaggggaaagagacccacccatccagtagatctagttgcttaggttttcagccaaataaagttaccatctttccttgccgtcgtcgtcaacaacggtagccatctacctccgtggtttcttccatgagggtatgattggctataaatttcatgttcatgatgacattctttagaatcgaatcctccggctctctttgtttcaccggtggtccatttgccactggtgaggagcttgtgagggttgtggttatattgatggatggtggcctgagagcatatttggttcaagctcggggcaaggccttgccgttgtttatttagcagttctatagatccgttgttcgagatgaaaaattatttaaaagccaatgtgtaattcgtattcatccaaatttctcttggttctctgtgtattctctcttccaatgatatctctgagagtccataaatatatttttccaaggccattattgcgcccatggcgacgacgggtgcaagttagtactgagtaccttaccaggtattggatgaaatgctatactcgcaattatctaagaaagaagactcagaaataatcatattatggttttgttagttatgcttcagcaacgcttcttaagtaaactggttgtctatgaggtaaacatattatattatattctctctgtcccataatataagacgcggtcaaaattgacacggtctccaaagctaatctttaacttatattttctcatatacaataagaagatttgtagcaacaaaattataaccatatgaaagtaaatttaaatttcaatataataatataatttttaacaaataaaatttattccatattataagtgttggttaaatgttttaaagtttaaatcttgaaatacgcgcgccttatattatggtatggagggagtaggaaatattccccgattgctcagcaggcttgttgacaggtacgagacacacctcttctcaaactcgttaactggttttatactcaaatcaattaacagtgacatgaacagcacaaaaatctcaagtcttgtcctgtgttgcaccatggcagatcattatgtctacttgattgataaattggtcgatattgcactctgccgaggagttgaggatctggatctgacaacaaaactagaccaaatatatcaaagatctgacatagcttggtacaaatttcctttatccttgttcaccaatggcaagggattatctctgttgaaactcaaacttggccaatgcacccttagtattcccactggttttgatggattcaaatgcacatttctgatgacatgattcagacacttcttgaaaattgcccaaaattgaagagctttcacctgaaccatttttggggtatttggagctcagggacatgatgatatgtcattgctttcatatcaaatgtatcgagcttgttgctcccaagttgcagaagtccagatatgcagggcgatgcataacaatggtgtttgcctcaatcccgtccattgagcatgcctggctggattttcatgatcacgagtatgctggctcttttgagtacttcatccgtcctaaaatataataatctagaaccggataagatattttctaacactatgaatttagacattttctgctgtgttattagctcaatgaaactttgtttgagggttttggtgtaactattggctttctgttatggaaatgctatcacgtcagaattagggaaaacggcactccgtttcgtactatttttctgtttttgagaaacaatgtttaccctctagttgtaacttggatgattgcatctcgagtggacctaggggtgaaagcagtacataaatttacgagatttccggttgactttttcagtttgcaccgaccgtttcagtctgtatcggtaactaacggtggtggaaatgaaaacggtaatatcttccgaaaatggtagcggaaatgggatggaggtttttccaaccgttttgtcggtaaccatatttgtacgataatttccgtcaaaatttcgaaagtttcctaggagctcagctagcctaacccatcagaagcccatgaaagaagaaagcctggtaggcttgcagcccataaaaaaagagaagtgactaggtaaaatggtattaaccctatgatgtggcatgtggattttgctgaactttggtctccttaacttatcgatgttgaagtattgttgaactttgtttatattggtcatcaaacttattatcataccattaatcatcatgtaacagtgttatgtggagtgtgatgatgtaagaataaagttaaaaagtcatcttcgtgcatagttaaatgtgtgctatgccatactctgctgattctgttgacttccgaccaatatcggtatattctgttccgacggtcccgttttcaatataccgatatcattacagttttcgggtctaccgtgccgattccgttttctataaaaaaaaatgaaaatgaaaatggtataggttttcctgaccgttttcatccctaagtggacctatccttttgtcaattatttttttcctgtggtgttttttttcctgggtacacttttttcttgtcgtttttaattttcgacttccaagttctaaccctgtactgttaggtttgcttgtaactttcgtatttacgcgtttaactatagtgttttatttccatagattttgtttcatttaaggccccattttaattaagatgtaaatttttactcggttttcgttagtacaatttttaaactactaaccgatgtatttcgcgtgaaaactttttatatagaaattacttttaaaaatcaaatatttttttaatatgtaataattaaaactcaattaaccacgtactcatagctttatttcgttttacatgttctaactttaccgacatcttatattaattagaaacaaacaccaccttatttcagtgacatggttggtggttaccagagtccagactccagaatggatggcgaagtgataggaagctcggacaaagtcatgagaactgacaattaatttaccgttaaaaaaaaatgtcgtcagcttattcagctcgcgggtcaaccgtgccatatctgcaccaatccaagaacaagaagacgcctcaaacattggagctataaaaaaaaatgctaacctcgcgtcacaacttgtgggggtgggttagtacgacgttgtcgtcatctattatctactccggcttagccgccgcgagtcacctcgccaacactgcatccatgcacctgaacctcatcgccaccgtccatgtctccaccaacggccgccgatcttcgccggtctccatgcgccagcgcccctccggtccatgtgcttttcgtcacacgcgacgcctaaaaagaaaatgttatctccgtttttaagagaagaaacatgttttatcattcgtttttatttaaatttttttctacataattattatttataaacatttaaagatggttttatatcttacgtattggtttaaatgttttaaataagacgtataattaaacgtgtgtaaagccagcaacatcatgtattatatgtaaaatggaagagtataaacggagtcgcaactcgcaaggccggcaaggcaagcaaaagctgctgacacagcactcctatctgctcaaccacttgcttggcttcctctgctccggcgaccgggcggccggccggccggcggcgagaggtagcgccaggtgatccatccatccatccatccatctcctccccccttcttgtgatcaaccgttaatcagccgccatggcccatgggtttgagttgatgatcgatggagctagcttcccagattcttgcagacttttgtgttctcgcctctgcctccttaacatagatgatggctgggcagtggtatcaagtagctcaagtttgtgatgaattctgtgtgagatgctgaaatgattatagcaagttctagctatgcagaaattgtattgactctccatatttatgggaaattttttgctgtggcatgcacgttgactttttcgtcatgtactgtactgcatgaacttgatgtccttgcacaaagaaaacgcctctttgaaatatgctagctgggttatgttgattttgttttttaaaaaaattatgcctagttgaattgggatcttgagagatgtattcaccttctgctttcaggggcacagggctgcaattggaacctgaacttgaaagcaagttgtgcaagaggacagaaaagaatcagtctgaatatggctgcctcaaagcttcaggccttttggaaccatcctgctggccccaaaacaagtcagtggcaaccctgtttgccttaattttagtgtaaaatggcaattgatattcccatagacatgattagggaacagaagctagcttacacatgtcattacacagtgagaactacttcccagcttgtcaattattaacagatgacatgattagggaacaggctgatgctgatggttccagcttacagttcagaatagtatgtgaaatcagacagcctggtttgatcacaagccagtttacaaaatactaaattactgaaaccgtcagaacataaaaacaacagtgtttaagactccctccttcagatagctgatgtgcttcattcttcaattgtctgatgatccatttggtttctaatttctagtagtagccaagttccatcttctcctcttcttctgatctgatggatgtctattggatgaaacatttaacatattcaatcactgtcatctgaactgttgaggcttccatctgatctttgttgcagttcatttctgggccccaacattcaaatggggtatcagtattgccaatgttgctgactttgccaaacctcctgaaatgatatcctaccctcagcaagttggtaggtttagttgtcagttaatcttattcctgacatcagtttatcatcaattcatgtataatgttgttgtgcttactctgatgtatgatgtatgatgtatgatgtgcagttgtggcttgcagtggagtaatttgggcacggtggggcatggtcatcacacctgtaagcccctgatatttagccatacatacaatcgtttctcgttattatggaaaaatatttggaattttggattgtatatctcatttgaatgcagtctaaacagcaacttttttgcgcaatgtctagtacgattctctagtgtaggttagtgcggtgtactgtaaaggagtaactgttttgaaactgaatcaagccaaagacctgttttatgactgttgtacttggatagactgattcagatatctgttttatgactgttgtattgttgcagataaactggaacctctccagcgtgaatgctgcaatggccgtgacaggcgtgtgccagctttcccgtaagataaggtctgttactgcaaaaccaatcctcagcttgctgatttataattccagatgtgatttctgataaattagcaactttcgtgttgatctcttacgattcgatatgtgatttctgacaagttaacaactttcgtgttgatctcttcttttacaggcacgattacttctctgatgagaagagtgctactgcgtcgctggaaggatgataggaagaagaagaaattgttgtcatggaatggaacactaatttcattatcagtcgaccagcacagtgttcactgtgaatgtgtccgcttccatgataacaaattaacaatcccatgtgtgtgtatgatcattatgaattgggctatgggtatgaaatgtttttataccctttggtatacagatagtaagcgagtctgaacttaactgaaacggacttggtttgagttcagctcgaagtacactcgaattaaacttaactcgaacggccttaactgaaacgagagagctcccttcctctgtgccatacaatatgtttgcaatttcggtttgaaattcccgaaatttcatttcggacttccggcacgaaactatttcgcctgaaattatattttctttctgaatttggtcaaattttattcaagttcggctaaaatttcttcaaatttcaaaaaaaaaaaactattcaaccgagaaaaaaagctcctggaagaaggaccaacagggagaggcacaaaagcggtgaaccagagcacgtaacttactccacaaatacctaaccaatgttccattcttcctctcatcttgattttataacttttagacctaacaaacattattcattaaccaacgctgcgtgttgctttgccctctgaaactactggaacggcaaatagcagcaattgcctccttcttcttcttttttttccccctcctaacaacacggggaaaatgcaaacgctttgcccggaaaactcatcataactgatagcggagagctgcgaatatatgccatcgcgttagctttttccaccggagttgtttttttctgactcctctcgcggcgaaagacgatgccatctgatttcagtcgctgcaggccttcctgccaagtagtagcttttgttgcgtttttcctatcaaacggcagtaaattaagtaaaaggctggtaattattaattaacgtgaggcggcaagactttgttgtgcaaaagcaaagcggcagaatgttaactttgggtaagtttcgaagtaaaatcgtgggggcatcgatctacagggagctggaataaaagaccatggaaatgatggaaaagttggaaggcagcagcacatgatcagatgatctgtttgaaattgagaagcaggtgttccccgatttccacccatgatctgtgtacagtacgtatgcgcaagttccgttaatttctcacgcatcagttacagcctcatcttttcgcttatacttatatacttatcaaccaaaagttaaattttcaatcttaaatttagacttgattttgagattttttttcatcgaagtttatttttcagcttttacttttatatcgctaagaacacgtatataaaagctttattcataaattatttttcgtttgcatatatgtcgtttggcttattccatcgataagccaaatgatggatgaggctcaaaatgatccacttagatggatgagactcctctcacataaagttagagggacatggctactgacatatgggcccatgaaggtgggccccatatgtcagggactcatgtccctctgactttatgttagaggagcttgctcccacttagatagctagtttggtaaataggaaaacatgcaatccatgaaatacagatagatactccctttagactccagtcataaatattttaacgtttaaaataagatttgatatatgaaactttaatagtcaatagtttctcaagtgctgagcaaaatggtatatgcaagggcggatctaggaaaaattaatagaagaggccgaataaaccatacaaagttatagccccatcttctaataaatgtatgacataaaattttagtgggggcttcataggggctcttatggttgtaacatcggtagtgaggcttgagaccccaaagccctcatggtagatccgcccttgggtatatgtagatttgccttcgaaaatactattataatattattataaacatattaaattttatgaacttgttctaatataaaattagtagttagaattttaaaagagattgtctaattctcagttgcatgaaaataaaaattaatccaattttggactgctcatattgtagcgagatttgtgcatgaacagtaaaaattatctctttcaccccgcttcattcttctattgtaacacacaatctcctctcgttctctccgtatcacaagcaccaagccaccgccgctccaatccctagcgcgttgcttcaaccacctatccacttcggatctaacgcccccactgctaaaaccttgcgtagcacaagcaccaagccaccgccactctaatccctagcgtgttgcttcaaccacctatccactttggatataacgcccccactgctaaaaccttgcctgccgctcccctccaaccccactactccggtggagggtccaccacctcgtcacatgactatgtccgccactggtcttactaacaccctgcaactatccctctaagtttgagaaaaccctcttcttcccctccctcaaggctccctcctacatcaaccacaaccctaaactttaattcatatatctttcacccgagttggagtgtcgctagcaccgcagaagacagacatcgtcaccattgtcgttaagttacctctccttgtccctcctccctaccgtaaagaagattgttaggttgaagatgactgaaatccctagcaattttcagtgacatgagatatatcaatccccttacaaattttcctcaacgttactacatatttatgacgggattcctgcgattcatggcactgtgaatctgtgatggcaacgctgttccaagacatgaaactcgcgtgccaaatactgagcataataattaaagctagagcgtctgtcaatcgggtctgaccggcgcctctttattatattattccattattgttaacctccaaaagccgcggaatcgatcatgttttgcaattttgcaaaccgagtaaggccacgtacgcgttccggtctacttaaccagatcccgccaagtcaaccaaaccacaagtactacgtccccaccacaccacgtacgtacgcgacagcgcgcgaaacagcatccgtccgtctcgcggtcgcgccgtttcgcctgtcctgtggctcgctcgcggcctcactcccaatctccgactcgattcccactcccactcgcgacgtatataaattcccccacgcgcccgcgctctccgacccatacaccgccacacgccgcgccatctcttcgaaccaacgcgacacgacgcgacaccggcagcagctagccgcggtgatcgctacgacgatgaggttcgcgtgcttcagcgccgcggccgtggccgacgaggcggaggccggggctcgccaccaccaccaccggagcggcggcggtggcggccggcggcatcgggggacgtcgtcgtcgctgcggagcaagttgtttggcggtaggacgacgaaggcgggcagcaagaagtactcttcggcggcggcgctggacgatgtctacgacgcggcggagtggtcgtcgtcgtcggtgccgtggtcctcgacgtcggcgctgtcgctggactcggcgcgctcgtcgtcgtcgtcgtcgtcgacgacgacgacggcgccttgctcccgctcccgctccttgtcgtcgctgtcggacgcgctgtctccgcctgctgcgaggcgcgcgccggagaggagggggaggacgccgcggccggcggcgggcgtggccgcggtgatcgtgtgcctcgtgatggtgatgctctgcggcagggtcggagccacggcgctcgtctcggcggcgttctaccttttcccgcggcggtggcggccggtgggtgccatcgaggcggcggagagcgcggcggcgtcaccggagcatgactggccgtcgtcggcgacggatcaggagacgacgacgaagaggaaggtggttaaggaggggttcttggcgcggaactgcaagaagtgatccatcctttttttttcctctcctttttttttgaagagaaagaacactaatttccttcaaattttttacctcgagagttgttgtaattatagaattccagacacaaatcaaataatcaatcatcaaagtatcaaactgatcaaacataattgccttgtagtgcgatgtatttttgcccaagggaaagatttggagatataataatatcttagcttgtctcagtgacgcaaagtttccttcttgagtttaccacagtgagagatagagaggtcaagaaagcaactgatggtcttctcgatttttttattttttttaaaaaaaaagaggaacaaagaaaaaaagcaacgcatgcatcgtgcatgcacatttccattgcgggcgccaacaaattccttcatgcgtacgtgctgtatccatggttagctaattaagctagtggatcgagatggaactttatccaactttgcaataatgcaagaacctaaatagtctatattactcctatatgtaagagtaactttggggcagcttacaaatgattggcactttaaatcattattgtattcatcttgtatgttatatagtctgtatgtcgacagaggtcacagttgtaaaccattttcattattaaaaagagtccaaatcacccctttgaactattgagtgagtacaaattaccctcatggacccgaaaactagatatctttaaccctcgactattaataccggacaaagaaccccctacccccaagcattgttctgaagcggttttgacctgagattgcacacatggcgtcagcgtggcaatccaatcagctaaaaaatagaaaggaaatccatggacgcacttgtcatctctctccctctatatatcccctcccctgccttctctcccctggtctctctctctctctctctctctctctctctctctctctctctctctcggggaggcatacccggaggtgggggagccgggaggcattcgcggcagccggggagctgggaggcatccgctagcttgagctcctccgcctctgccgctcgagttacgccccgccctgtcgttgtgcaaaggcgcgtgcgtccgatgctcgcctctgccatcgagatcctatcctccccgctactagagctttgccgcccccaaccgcctccgccatcaagatcttcctccctcccactcgagcttcatcgccctatcgctgtgccccatcaagatcctctggtggtcgccgcccacaaccgtctttgccatcgagctcgtccaccccgcctctcgacgctccgacgctctgctgctgtcgttgcctccgcccccaccctcgcccgccgcctactcggctcgccctcctccgccgcctctctgttgatagagagagatggaggtgaggggatggagaagagagaggaagtgatgagagggagaagagaggatgagagactgacaggtcgagcccaccaatttaaaagaaattgtagaccagattactatgtacgatcaaaactattatggatcgagtcagtgggataattcatctggttttaatagttaggggtgaaagatatctggtttttggtatgaatggggtaattcgtactcactcaatagttcaggagggtaattcagacttttccctaaaaaatatagttcgtgtttgccttgtgatatctttttttttttgcaaagatatatataatggattattcgaaatgataggtagtccctaatcatggtaaaatcatgttgaaagaaaaaagaaaggcaacttatttttgtgtgtgtgtgtggaaaaagaaaagggcatatgttctcccctttgttcatttgtccagacaatattgaacgggaggctttttattataaatataaataaacagacccctttaaatcttgctacctttttctagaggaaaataataaatcttgctattttcacaagttggtttgttaatttaatcatgtacttatgttattgtggcgcgcaccgaatgatgtgatgttgattgtatgctctatgattttggaacatgttgtatttcggctaccagcctagtggtaggagtatcaatatattcttgaaagtaaattgttgagttaaatcgttagcttgttgatttaacagctaccgccaaaatttcaattttaaaagttagattttgagttttattcatcgtagtttattttctagcattagtttttaaatcgctagaaaaatatcgatgtaaaatttttatccaaatattattttgttgcttcgttcatttttttcacaagccgaggagagaacgatgagaggttcgtttgctgataatacataactccgatagtccgatctatacattttcttgttatatctgaataagatgggactacacacctcttataaaaataaacgtgaaatttgcctcgctgtaacggtacaagactagatttggcacaggtgtttcatatttatggctaattactttttcagcagtaaatgatgtattcgtcgacggcgagacgtatgtggtgattttgttaacctcaaaatttaccgatccagttttcgaagatattgtgtgcatgtatatgtttattggggtgagtgtacatgcacgcgcttatatgagctttcatgtttgtactatatatgtttaaaaaacaaggcaattaaacaatatatatatatatatatatatatatatatgtatttatgtctaatttggatttaaattggcaccggcagacgccagtccaaagcagggttagatgtgggttctcatgaacctagtacgtacgtagcttcatgccttcatacacaaagaaaataatagtatacacactgagtccttgttgatagctatgaggttttggaaagtggccatctccattttcatagctgaaaagctgctttattgcttgggcaatgataccaggaggcagcattatagctgttataaccgtagcttcgttactaagaaatggagcagaggttggattgcattgttaaaccctaaaagccatggccctcgaagtattaaactaaagccgttgttttctgagcttcagcatccatccatccatgtgattatttatagattgccaaagttagaatatacctgatgagcatgatcaaccgtaaagatggatcagcctcgtggaatgcatgccgtacagctaactagcatgatcgtttacttatgggttgagatgttccaaacatgcatgattctcacgtgatcaatagtcacaaatatacctaagcatcttgcaggtttgtcaagcatgtcctatctcaaaaatgaaaggtagtcaactaattcagcttggttggatctacagctgtattcagatgcaatatatacctggactaattagactcaagtcgtggttttgcccatgatgcggaacaagcaacattaatttcttcatctgaatcgcatctcttcatgaattgtagagaattctagcggaattggtggcatgcatgttttgtgtaacatttgttctaaaacttagggcatctttttaacgcaggaattttacgaaatttacacatgagtgattcaaattcctataaaattccacaggtcttaacaattttttgaatttactgctatgaaagaaagcaaaagtgagactaattaacattaggctgatcatgagaaagtgctactagttaataggatgattgataattcacatcaggaagcaaaggtgactttagaaccaaaggtacaatcaagccgtggacacacgacaagcacacacatatgcagccgttcgagtgcgagcacaagacaagcacatcccacgcatgattgattgtttggtaaagggtgaaaccctagtgcaaaggcctagagtgaggtgtcctccaatccttatcccagacagagaattatagtaactcaaaagctcatcccacatggaggagaaaggcaaaaaaaaaataaaataaaaagatcttgcattggcttaggagccttaggaggcagcagggccctgcattattgcagctttgttttgcaacctttatttagtagccttaataatccttttgctggttgtactaatagtctagtgcatctgctagtcttattgagtcttgagtgatgacaaagtccaggacatgctgggaactccagcaggtgtactgtggatggaaatcataagtcagattagttatagtgcaattgtacttgtttctgacagccgaatgcagaagtttgaatcccctcagaaattttcggcatttaaatgtttgctttttcccccccttttgtttatgtattttatgttagaaaactaattataacttgaagaaaataagagtaacaatatgtttaaccaagaggttaattagcaattttttagctgaaacatcactcaagacagtaaaaccaacatcaattgaggattgagcacgttctgtttccattcatgagaaggacctaacaacagttgatgacatttcatttgattcatgtcaatttgtccctgaaagttggaagttgaaacactatgtaacagccagaaaaatttacacttggattcatcataagccttgagcatcatgatataatatagataccgacttgagactaaataaaaccaaatacacgatgagaactatcacctaagtttacaacaacccagttgcacttgcacctatcacccacatatggttgctgccagcgccaatacaaattttcaggcttgatacaacaaacaggcctgtaattgcagtacagattattttcttgccggacagtccaccaattctcttgagaattttcaccatttcaattcgaatttgtgcaaaagggtatatgcaatacaactgccaactgctattatcctactgctctggtagatctgatgggacgagtggttcatgctcattagcaccatttgatgttctgtccatgccacacacctcaggagattttataggcacaaaagaggacttgtgtagagcagcaaaagccttatttccttcaccgttgcttcctaaacaaatggtatcaccccgcccatgccagacaccgcactggacattatttatctccaacgtccgagcctcctgttcattcaatgctagaaactgttagatcaataggtcaaaaaaacaagtaacgcatgttgaactgggacttcagaggggtttcaagatatataacctggcatagcgtacagcaaggacaaatgagatggagaacacagtcatctagactgctatcagtgccctgtatcaggaaaaaaaaagtcaaggaaaagaaacgaaggtgcacaatcagcttaatcacaaaaaaagacagtcaatgagatggctggattttctccaaactttgtgcttggcaattcctaaattgaagtgctcatatttatatctacccgtatgttgacaacataactatggcaggtattccaaagtccaaactatcaagaccagcaggatttagttttcatttgtttgagttaagcattcatagccatactgtgtgatgcaaatgaaaagaagagacaaccaactgcattaagcagttaagcactaatactaggctgcacaataacaacctgtttcaatgctttaaatgaaaaatggtaatgccaagaaatacgtaccctgatattgaactgcttcctgattcttcttcggaagtaaccagtatagattgctatcaagagaacagagctaagtcccatatacaaatatatattatgccttgtgacagaaaaggcgattaggctaaccagaatagccactaaagaaattaagtaaaccatggcctgaaacaattttaatcttctgtcagatttatgaacaaaggataatttcaagaaaattgatgcacatatgtaatatagagtgatgcaataaattccaataacattttttacataagaactgagatagcaatttatatttagtatttcaagactgaaatggctattaaatgagtaaaatattggcaagtccaacgtgcagtctgattcacagtaccatataatataagtaaagaacatctcactagaacttatcctatacagaatgaatcacaatttgaaataaaaaaagcatgatgcttatcaggctgactaggtttaagacatgccacagacatacataattgtgtaagcaaatgtagcacacattgacaagtcaaacatgtcctgcattaacaactcaaggataggactatggaaaggacgactttgctgataagggcccgcatttcaagaaactgtcagtggtataacaagagaaattacaacataaacctatggcttgtagattacatgtaaactaaagaaagaagcaagaaggtaaaaatacagaaatgcacagttcaaaatacacaagtacacaacaaacatttttttctcagccctaataggcaatacatcagtgatgaaaaaatctattcggtgtaataatattcaccagtggtaatggtacattctaaaattgactcaaagcatgttccaaataggaggttttcctagttcctatcaatagcaatagcaagtaacctcaggtggttttacatgtttacctcgagagcagtttttgaccagaatcttttcaaagaaaaagtacaggtagaaatggacgaatatggacatatgatggtgagagtgttatccttacctgaaggaagcaagatccaagattggctctccgcatgttcttgccgaacctgtagcatgggcagctgcagatggtcgcaagcaaacgacttcaaaaacatcgctcacgcaaagtttaatggtaaatatttaaatgtacagcataaaagaaaaaatgaaatattttgcagaaattagatcagaaccacagaataggcaggatgcctcatttttggggaatgttccctgacaatttatcatcccaaatatgcctgattccgagtttccaactacagatgtgcctaagattttttttttcaacagagttaaaattcaccaaactgtgacgctggtttctaattcaaattaatcgaaactgaaactagagagaaaaagtaagacttcaagcaaaaaatttcctccttcatctccatgaaccttacaactccaacgggaaaagcccaccaaattagagacaaggaatcggatttgaagctctgtcaaatttgaatagtgcgatttccagcaccgggctccccttccttcttttttttttatgcattccgaacaaaggcagcgacctttctttcccaaatccgcacaaaaatcagtcaatcgacatgaaaaattcccgctaaaacactaaatcccaagcttccccgtcgcgcccagcaaaaaccagattccaatcaaacaacagattcacgaaaacgaggaggaaaatagtcacagctccacctaccacgcggcctcgagcgcgattcgcctgtcctccaagcaatccagcaccacgtccccttcccacatcctctgcacccctcctcctcctcctccgcctcctccaccaccggcctccaccgtggccgccgccgccgcggccgaatccttcctcctctccgccgccagcgccaccgaggcgcacagcatgtcgaagtccagcaccgccatcacctcctcctcctccccctcgctctcctgccggctcctcgccgccgtcgacgcctcctcctcctcccgcgccgccgcggccattctctctccctctctctctctctctctctcctttctctctctaaagccgcttccgtttcgtatttgcctcgggtttttaacggcctaagcgcctccgattaggaggagaagcgaagggagggaagggaagagatataacacaattcgattaattaattaattgattgattaataattaatcacgggtgcgcgttagaattttttaactaactgattacatgacaggtgggccataggaaagcgtggttcgcgcgaggctgccactgcggggcccacgagacagtgagataaggtggggaatacgtgggtacgcgtaggtcgggctgccttagcaatcggtggttaaaccgggtaattagtactagtagtaattatgaataattaacacgagggggatcgctaataataatggcgcgtgattgggtggtttattagtggttggatcgggcggccaagcccacccgccagggccagactggtggtgggccatgtgggcccacgtggcagtgggagtaggtggcggcgttcctatccatcggctcgccggcgctccggggcaccaaacgtgtacctgagaatttgcgtcatgaaaggcacgtttgttttttttaagttcagccgacatgttttgcttgcgtatcctgaacaagaagttagttcttctgccaaatcaaccggaaatgaatgttcttctatcttggaggtatctttgtttcgtggttttttgcatgttcatgtgattaatagtatgcgtattagatttttcaccgaaaaagctgttttggtctgtagattactaaaactacaagggctgtgtttagttactttctaactttcaaaatttcttcacatcaaatatttgaacacatgcataaagcattaaatgtggacgaaaaaaccaattacatagtttgcatgtaaattgcgagaagaatcttttgagcctaattacgtcatgatttaacaatgtggtgctacagtaaatatttactaatgacagattaatttggtttaaaaaattcgtctcgcagtttacaggcggaatctgtaattttttttgttattagtatatgtttaatactttaaatgtgtgtccgtatacgtcaaaaaaaatttggaggaggaactaaacacggccaaaggatgttgcttttgcagcttgccttgttaattattagttttattgttagaaggtccattctgccaatcatatcttgacactgaattattggttcaaccccccctccccccccccccaaccccgaaaagaaaaaaaaagatgactttaatttgatactgcatcattgaagtctaatgtatggttcagagcgatacaagttcctgtctgtatgatcgacccgtaaaaagtgagatatgatttgccacgatctttaaaattttttagggttatgctttcaaagttgaaattcggccattaataactcatagtgcaatatattactataattaaaaccatgattatttgaaaatttcacccaaaaaaaatcttcctatatgttgcctaccaagctattgatacaaaacatagaggtgtgttgcatgctggaagacacttggggcttatatattcagacagggcatattacgtaccgtgattagaggaagtacaataacagattataaaagtaagctataaacacatattgagaagataacagatttgtagcgaactacagtacagactctaaaacacaatgtgtgtatgataggtggaacaatatattaataatgtaatatatgtttataggaaactattgtataaattgactattaaattaactttagatgatttaaagctaatagttagctatactattaaaattgctcttactccaattttattatggaagtaatgactcaagcataagggcagtcacaaccctccacctaggatggtgtctatagcattaactatattgccatataggacttttagcttatgtggtactatattaattaagagagagagagtgaatagaggaagaaactggggccctgtttggaagattagcccagggctaattttaagagctaatgtttagtcatgaattggtaggctaaacattagtctagggtggtatgtttggatccatgggctaattcaaggctaaaaggtggagagagagaggagagagaaggagagaaagagctgctttttgatggtccccgcacaaaattagccccattagcaccccttggaggggctaatgttttgaggggggctaattcacattagcttaaaattagcccacctgtttggattcttgagagctaatttgaggctaaaaggtgagggctaaacattagcccatgaaatcaaacagggcctgggtctcatgcaagacacaacttcaacacgagaacctatgcactgaacactatcaagttttgtattgggagataatagtgtcttcataatagatgaagaataaatatgattggtagagaagagaaatgatgtatttattaatggcccactttaagaaaccataagttgtaaagtgtagtttctattatgatgtcttattgacatgacaccatagacactttttatggatactatggattgtgactgctctgagcctcttggctcttgcacaccgcaaaacgcgcaacgagaggtgcacgtaattaatcaatcagctttaaaaccaagagaaagtagcacacccaacgcaacgcttctcccatttattttattttttcactccatggtgttgcttgctttcgcacggtatataatggtcggcaagcgagagcacgagtgggcgagcgcgatgcgatacgggtgaagcaaagcaaaggaaagcaaagggatgtcgtgcgcgtgccgcacgccacgaacggaaaattatgggggcggaaagcgacgccatccggtggatcctagccgtgagcgcgaagtgcctcgcttcgctgtgggcctgtggcctgtgcgcaccatccgtagtgcagcggcaagtgggcctcgcgcactttgggttgcggcttccgctttgagccttacacgtgcacggatacgcatcacgcgagcgagctggcgcaaagccgagagccgatcgatcggttgcaaacaggttgggaaaccacctcggccggggttaccatgtcccggtaatataagtaaatttaccacgtggtaactgtggcaaaccatttaccgtacaaagcgtaataacacgcagttactagcggtttaggaaactctacacttgcaacagccaaaagagttgcaacttgcaacctgacagcttgtattttgctggtactttcgttgtacgtagcaggcttcaccattccgataaaaaccggttgaatttcgcggaaaaccgatgtttcgatatggctcaaaagtagaagccatatgaaatttcgacatggcttgaaacttgaaagtagaagccgtcttaaatttgttcgaaaaatactggctttccactggatttcgtgaaaatcatcataccgtcagagcctggaacggaaagttatctcggaatcgcaaaccctggtgtgtagtataggtgagaaatgctcggtcccaagttaagggtaatactccctttttctcgttataagtcattttttactattttactagttaaacattttaagtttataaagaaatgcagtgacattttcaataaaaataaatatatttaacgtcatgtttaatgaaactaatttgattacctatgttgttaaatatttttaaaaaactgattaaatcttaaaaagtttgactatgaaaaaaacagaacgacttatgatacagaattgagggagtatatgataagcctacgtctcataataaaccaacttagaatatgaagatgaaggaagcagtttggaacacactatttcaataatatttttagggattttaaggattaaataattttatatataaaccggaaaaaccgggtgtttcgacttccaagcacttgttttgagtgatagatgtgaaattaaacgtgtgccaaaggatgtaggagtaggtgtgtatttgtagttgtctaaagagaaaaatggagagcgttattgggccgagttaactgtaaagcccgatgttccttaaagggctggcccaggtgggcgaaattaacaaaaatccatatctggtggcgagcgtccgcgcgctcgcgcgcacggcggggatccagtcagccgatggtttccgccgcggcgtgcgtggtgctgttttcgcatggggctcgaaaatgctagttcgcgggcgctcgcgtgtccgcaagtgggcactcgcatgcgcgactgttggtgcacgcattgctccgccttctgctcaacccgactagatacaaggagaagaagaagcggggaaatagaagggaggaagaacaaggagaagtggagttgataagtgggctccaccatattttcatttttactgctgtcccttacatgtgggacccacttctatttttaatttctttgatgactaggctgacagcacttttggaccaagacaattacaacattagcaaaaacgcttctcaaaccgctaaaagagttaatttgcaccggtctttaaagttacgagaggcattatactcgattttgcggttgagacaagcaattcaaactagggacggcaatgggtcaggtcgggcacgagtagagcaaaatcatgcccgactcggcacccgaccttgcccgcccgaaccctgcccaacaggattaatgggcaaaactccgtgcccatacccatgcccgacaggcacgggtatgcccggtggatatccattgggtatgccttccgccttccgcctcccgtcgccggttcgccgccctcgatcgtcgtcattgtcgcctgctgccgccggctcgtcgccctcggtcgctgtcaccggctcgtcattgtcgccctgagccgccgtcgccggctcaccgccctcgtcatcgaggccctaagctgtcaccgccgccatcgtggccctgaggagccgccgccgccgtcgccctgcgaggttacgacgccatctcgcgccgccgctccctgccgtcgcctgcccgcgccgccactgcgctgtctcttgcttgggtcgccgctgtcgttgctaatccgtgccgtcatcgctagcctgcgccgccgccgccgccatagggattagaataggagaggggagtggggaataccggaataggagaggggattggaataggttagggtttctattagttgagtatatatatgtccatagttagtgggccaaatgggccaaataaatggatataaggaataagagataggccaaaattaggtcatatatatgtatgagtcgggtatggactatccgcggacaaaaaacaatacccaattattgcccacgatgttctcgggtttcggacgggcgtgcccaccgacaaaatattacacccatgtccataccaatcgggctgggtatccgtggatatctggactcgcgggcaaaattgccatctctaattcaaacaagggcaagatatgtgtgaaccaaatagactttttttttacttggtcagtgactcagtcccatggagcaaaggttagctttgagtcaagagtgtgttcggatgccccttttctcaacccctctgcctcgttttctgcgcgtacatttttcaaaccgctaaacaatgcgtttttggtttttttgcgaaaaaattctatacgaaagttgtttaaaaaaatcaaattaattctttttttaaaaaaattagctaatacttaattaatcacgcgctaataaacctctctatttttcgtgcgttactgttccggttgggatatgagatagcgaacacaaagcctttttactccacaaaccaaaccaaccaccctccctgggactgggatccataagtcctaaaccgaatttcctattgcgcgcgtctgcgccagcgaacgaagtcgcgcgcggttccggcccagcccactacacgattgcgcagtgtcgcagtgcaggaaggtcagtaggtggggacacgcacacgttcacatgcgcagataagattggattagcgtaatcaggttttgactaatcacgatctgaattatggtgaccattctttttttcttttcgcataaaggttgttttctttttattactacaaatttcaaaaacttatacataatatttaaattttcaaataaaatttaaaaccttctaaaaaaagtcatatccaaaatttaaaacttttaacttgaaagttgaaaattttcaacttaaaatttaaatgctttcttctcaaaatttgaaactctccactcaaaattggaaaacttccaacataaaattcaaaattttcatctcaaaatcaaaaactttcatattgaaattcaaaactttcaactcaaattttaaaaacttttaactcaaaattcaaagttttcatctcaaaatttaaatactttcaacttaaatttgaaaactttcaagtcaatatttaaaaaattttaaattagattttgaaaactttcaaatcaattttgaaaactttcaaattagattttgaaaactttcgactcgaatttttattgttgtattgtgaaattactgtagcgtgtgattaaatctaattaccgtgattaacgctaatctccgtgattaacgatgggatcgcgacagggttcgttctgcagctgaacacgtggaagtgcgcgcgagtaactgaaccggcgcgtacgcgcgaattagtaatccccgtcctaaacctccttcccccggctggcggctgcaccgatggccggcgacgaaatggcctcgccgtcgccgccggtggcggcgctcaccaacgacctcatcgcggagatcttcctccgcctacccaccccggaggacctcgtccgcgcctccgcggcatgcgtctccttccgccgtctcgtcaccaccgaccgctccttcctccgccgtttccgctccctccacgccccgcccttcgtcggcttcctcgaccacaggggcttccacccggcgctccctccccacccctccgctcccgtcgccagggcggtggccgacgccgcggacttcgccctctccttcctcccctccccagccggcagctggatggtccgcgacgtccgcggcggccgcgtcctcgtcgaccgagataccaaggccgagaccggaggcagcgagaagccgttggtcttcacggagatcgccgtgtgcgaccccctgcgccggcgattcctcctccttcccccgatccccgacgacctcgccgcttcggtggaccgccctgtccgcgtccacctggaccgctggtgcgagcccttcctcgctccccacatcgaagaggaggaggacgatacctcattcaaggtgatctggatggcgcagtgcaaggccaagattatcgccttcgtcttcaattcgagcaccggtcaatggctagccggtgcctccccgagcaccaccgatctgttcaatggcgccggtctgtcgccgccgccgtcgtcgtcgtcaccgagcctagtgttttcgtcaccgggtcgagtgttctccagccgccgatacgcgtgcggctgcttctgctgggggattttgaggaccatgttgctggtgctcgacacacgactgatgaaattctccattgctgaacccccaccagtctgccttgggggaccgaccgccattgttgaggcaggggaaggcatgactgggatctttgctctccgggggagcgttggtggcacgtttgatctccactacagcatttggggaaaagaaggggcgactcgtcgcgagcagatggagaagataatcccactggatcatggctaccggtattacattagaggtgcgatggagaagcacttgctgttagccaggtcgcgaggggaaggcgaagaagatacaccagaggagccagatttggaatgcttttcactggatgtcaagaccttgcagcttgagccggtgtgtgttctgaagtactacagtttacgtactgacatatataccaacttcccgccttcgttgtcgccagaaataatatgagatggtaaatttcctgttgtatcctgattatgtctttatttttcggcatagttatctcgtggcttatgatatatatctgcgtggatgatgcttgatttattattgcaatatctgctccttgtttaaacagttatcatagcgattatagtatgaaacatttgtgtggtatggggaaaatatataaaggaaaggacattagagagatttgcttgtttgttgcgcaattatattgtacaagaccgattaagataatggggcaaatgaaggagatgatcctgctacgaactgcttagtgcttatcgtggaattcaagtagccctaagttatcatttctcttccttttagttgctttgattaggagttcgatatacttatggctgatttattttgcccttcaacatgaagctactaattttgtatgacctgtgtttggtggttatttaataattataatattcagcttttttgtctagtactctagctaggtgttccaacttatatattgcaaaccacaatgacaaacacatagctaggtgttccaacttctatatattgcaaaccacaataatgaacacgtagtggtgagtgtttgtcgtgacatgtttcaattaagttgagaatgtgagatttgatataatcaattggtaagggctaaaatgagttctgaaggtgggtttttcattcattttatagatttattttgaattactaataactatctcagctatctaacataacatgttttttcctcccctgatcaatttatgaagtgttacatgtagcctattaatagtagtttgttcctttctggttcataagtcttgaatatgtgcaatctggtctgaaaggtcttattcaatatctaatttcttgggttatttgtgtcagattcagtgttcacggtgaaagaaacactagtggagaaaccatctttgcccggtcgaccaaaaaccacaatagtctcggatgcactaaaaaccaatactaaagatggtttttagtcccggtttataagtagaacgggaactacgtgatctttagtcccggttggtaacaccaaccgggactaaagatgatctttaatcccggttcacatgctgtcaggtgttgtcaggcccctccaggatctttagtcccggttggtgttacgaaccgggattaaagatcaaaacgcactatataatccctgttacttatcctcttttctcgtccactcttttctcatccacacccactcctctctccctccatctctaatcttatctcttcccttcctccttatctcttttccttcttatcccttcccaactccccttcccaactcgatccagtgtgcgcagcaggagggggtgggcggcccggccagcggagggcagcgcggcggcgcggcacggagggccgcggggcggcggcggccggggaggccgcagccggctcagccggccggcggctttgcttagtttttttttctttttttttcaaagaatttgtgatccatgtgtagattgagatgaagaatctgtggttcattgtatggattgagatgtataatttttttttgaatctcatggtatggatctaagatgtacatgatttgtgtatgatttgtatatttgggacgtttctttgatttgggatgtataatctgtagtgtatatgattgatttgtgtatttgggatggtacgcatcccacctaatacccgggactaaagatgggagtgggcaatagtttttttttatttacttactatttaatctctaatttagtcccacaccaactgggactaaagatcgatctttagtctcgggtatttgaaccgggactaaagatagggatctttagtcccggattcatagtcccggtataaaaaccgggactataggagggttacgaaccgggactaaaaacaatttctccactagtgaaacattgcagttcttcgagctatagtgcttagcgtgagccgtgagattggtgaatgaattgagatggtatgccagattttcatattctcattgttatattgaactgcaaagcaatatcgtattcttttggtagaatgatagctgctgtggagtttccagttttagggcccctttgaatcacagggttaaaaaaatggaggaataggaaaaacacaggattctgataggaattgaagtgtaaaacagaggattgcaaaacacaggaatggtcgtttgattggagcgcaggaaaaacacaggaatcggatgagagatagactcaaaggaaatttttcaagaggttggagctcttgctatatttcctccaaaatccacatgcaatgtgccattccataggaatttcatgggatttggaaagcttcaatcctttgaatcaaatggacaaatagaaaaattttctataggatttgaatcatatgaaaatcctacataaatcctttgattcaaaggggcccttattgcatatctgctatggttattgaaactttgtatagctttgatatttatgtgtacaagatatttaagctaataattgcatactcccttcgttccaaaataactcaacctataattggatgataggatttgacctatcctggaacaacaattctggacaagcccttccgagctaggttatatcctactctaggtgtgtgttatggttctaagttactccattttggaacagatggagtatctgttatggttattgttatggttattgaaactttgtatgacttggatatttatgtgcacaagatattaagcaaacaattgtgcaaggtctgtactgtttcagcagtttgaaattactcggctgtatgcaccgatgacgctagtcatcttcgacattcacatatcgcctctaccattttttttaagtattctgatgtttgtctacttacttggcttgaatcgggatgagttcttaagtattctgatgtttgtctacttggcttgaatcgggatgagttcttaaaatctactctctccgttccataaaagaactaacttctaactactccatcctttcaatattactagaaaaatgtccgtgcattgcaacgggtgaatgctattttaattttattattgttatacggtttagttatgttaaaattcactataagaatttgcttagattttttttaaaaatacatgaattgtaattcggagtccgactttcatcttaagttagcatgtggagttttttaaaagagattttcttatacgacttcttttgtagttccaaaagcaaacgagcttaaaatccaactcaaacacagatatgtatttccaaaagcgaacaatcttaaaaacgtgggcttcggagcggtggggagctggcttcggagcggtggggaagtcggcagcggcggcgagagcgcgagcgatgggagcggaggggtgcggcggctgggcgggctcgaagccgccgaggtggacgaacccgaggaggagaggcgggtggtagacggagcggtagcagcggaggaagtggcggccggcgatgagtcggcggaaggagacgtaggcggaggaggcgcgggcgaggtccgcgggagagccgatacagaagaagatctcctccaagagctcgtcagtgagggcgggaagctgacgcggccatgaaattaataggatgccacgtcctcatcctagatggaacaatcacatcatctcacgggtgaatccattcatcgatagtatggttttgtgaaactaaactaacaaaatatatgtacttaagtgccaagtgtcaaaatatgtgtggttttctgcatcttaaaccatagaacatgtagttttgtgaaatttactcttttaaatatgtagttctatgataactttaatattaaatctatagttttataatacataatattaaatatgtatttttaataatgttttgtgttatgatatattcgagtaggcaaaatctaattcgcgcgcgctctctgttttgccttatcgcgcgacacgctcatcagccgtctgatcccacaagcactggtgcgtccatacatggcctggtgattcatggacgtggcatcatcccgaggagtccaaattggaagcccatacgatgctctacgctacgcaggcttcaaaaataattttctcttaaactaatcacccgatctacgattcgattataccgttgtgttcgtaagaattgaatctttataacaagatcttacatgattatattttaatgaaaaattaaaaattacttttataatatatctaaattacttttagatttcactaaattacttcttagacccataaaagtaaattcaataaagcttaaaagtaatttacatatattataggagtaacttagaaaaaaaagaaagcaactttatcacgacaaagcaactttctaatttcagaaaagggctcatcattacttaaactgtcgttctcttttctcaacagaatagcgaaaaactggcagtgtgtactacaacagggtgtgtttgggaggatctccggcacgtaaaacaaagcatacattagtacattattaaattactccctccgtttttcaatagatgacgccgttgactttttctcacatgtttgaccattcgtcttattcaaaaattttatgcaaatgtataagatataaatcacacttaaagtactatgagtgataaaacaactcataacaaataaattataattacgtaaattttttgaatgagacgaatggccaaacatgtgagaaaaagtcaacagcgttatctattaaaaaacggaggtagtattagcttaaaaaactttaaaaatgaactaatatgtttttaaaataactttcttatagattttttttaacaaagtgcattgtttagttgtttaaaaagtgtgcagtgaaaaaagaaggatgtgaagttcgtaaagtagacttaggtggtatttggatccagggacttaactttaatctatgtatttagacactaatttagagtattaaatatagactacttacaaaactaattacataaacgaaagctaatttatgagacaaattttttaagcctaattaatccataattagagaatgtttactgtagcatcacataggctaatcatggattaattagacttaatagattcgtcttgcgaattagtctaagattatggatgggttttattaatagtttacgtttaatatttataattagtgtccaaacatccgatgtgatagggacttaaaagttttagtcccatctaaacagggtcttaagaacacaaccctgatctgctactagtacacagcaagagggttatccatataaaaaaaatatcagcacactagcttatgtggtcatatgaaaagggaacaaactaccacaaatatgaacatttaaccaggaaatggaagtaaatatgcttattggatgacccttatcgtgtttaatcaaatttgtattagttttttttttgcggggaaatttgtattagttggctgttggatgggaagaatagatgatttgctcaatgccaatgagataattgatggatcatttgtgattgggtgatgcacaaaataagttagcagggataccgtgctaattaaggcatgtatatagcttaacaacatcacaggctacaattcggtgtggcaaagtcagtatagaaacagaatggcagcattccaacattaagagatactaacacaaataatgaaataagggctcgatagtgtgatgttgattgatgggcatgatggccgattttaactatcgctggaagaaaccctcgcgcgcgcgttcaaaccccttaaacggctgaaaccaaattaaaccgtctaaaccgggggtatccctgggtttgatcggtttgctgcgggaacccggcccaaactgcgtatgaataggctgaataaaaagggctaaacatagactatattaaagagggattgttgatgcagttgcagtagtacgttccttagaatgaaaggtcaaaaaagacattgtaaacctctagtaatcccctcataacacaaattaattttcatagttcttgcaaaaagatatggccaggaaaagagcaagcttaccgcttcatatgcttggtgatgatagagatggcgggtagccaacatacaggaatgacagcgaaggtggaacaccactgatcaccctacggacagactcaagatacttgcaacttgggtttgtgctgaactccagcgaatagcacccgcgcgcgaaactcggaggaactttcaagaacaactccctgctggtcgcacccaggatgccgaattcgtcgaaaggcacgaccatggcagtctcaaaactccatttgccggcagcagctttcccttcattttgcatctttgcagaatagatctggagtgcatagcctgcgatgtaattacggaaagcgaacatcccaatcttgccttctccttcctctacgatggcgcattccacaatgtcatggccaggcgcgctcgatgggagctcgagaactgagaaatccatcctacgcatgtcgagcacaagcagattcttcactgagtcacccatcatccagtagaagcagccgtatgcgtagctgcgccgcgacatggagcggcaagcggggcgcgagaatgcagggctcagatctccccagcagacagatgcagtggctcgccattgcccggtgactgaagagaagacgaaggcgacgagtttatctgcgcactccgcaatccagatcaccttgaatgacgtctcagccaccgccgccacgcactcttcttcaccgatcggagcgaagaaggtatcgccgcggcgcgattgacggagggcggaggcggcggctaggtcttgaggaatctgggggagaagcaagtgccgccggaacaaggggtcgcacacggcgaggatcctcgaggcggcggcggcgccttcttccacgacgtcgcggtcgagcaggaagcggccgccgaggacgtcacggacgacccagccgaggggatcaggggaagggaggaacgagaagccgaagtcggcggcgcggagcacgccgcgggccgcgggggcggacgggtggggcggctcggcggggtggaagtggaacccgccggcgccgggtgaggcgccgcagaacccgaggagcgacggcggatggagcgcgcgcgcgcggcggaggaaggcccggtcggtgacgacgcggcggaaggaggcgcaggacgcgcaggcgcggccgaggtcggcgagggacgggaggcggatcaggacctccgccaggaggtcgtcggggagggcgtcgagctgacggtgcgccggcggcgaggccatcgcgacgctaaggctagctagtagctacccaccggcggccgggttaattaggtttccgaggaacggcggggattgtggtgtggacgtttgggtccttcactccttccttccgctttattatccccacgaggccacgttctccacgaaaatagtcgaaacgttgcgttgcgttgcgttgcgccttgcgcggcggaggacacgagcgatctccacgaaaatagtcgacgaaacgtttgtgttgctcggtggcggcggcggcggcagcgcacgttcttaagagcgagtataacagtaggctataaatcggctaaatgatgacgtggagaagagaagagaggagagagaggggaagcgggttgtaaacttacagccagcttggatactagaactaagaaactctgtgagagagacaagtggaacatgtattaattgtaaagagctaagagtatcaccaacagtcctcctataatctccccccaaaaatttgtttttaggtttcctaaactgaaaataggaagtaaaaaaactcctccctccaacagatagcctaaatttaatccccgaaaactaaaagtgggtccttctgttgaactaccaacagaaattttcgtttttcccctcccacgcgcgcacagaaagagatcactatctcagtatctcccacacgcaatagccggccgattctccactgcgcgctccctgccgctacgccgccggccgatctctccacgcgcgccgtgctcatcgccgatccctacaccatccctgccatctccccctcctctatatcccccactggtgctgcccatctctcccttgatctactcgcttggccgcctctccctacacaccctcgtcgtgttaaagaaagagatgagtcctccaggcagtctcgttaagatgctattggatgatgagtcttcgtcggatgacgacgatgaatttatttttgaggcggtcgaaacaattttcgatgataacaatgaagaaccaaagcgaggagggtctgtctttggacatgcagtgattaatcgggagagattggctggtcattggagactatacaatgactatttctcagaagagcctacataccttcatgttcaatttagacgcaggtgggtaatagtgaattgtatttttttttaatcttgatttgaattagtgatgcatgtattaattttaattgctaattatttttcaggtttagaatgaaaaggacgctctttttacgcataatgaatgctgttgaagcgcatgatgattattttgttcagaagagaaatgcggctggtatcattgggctatcatgtttgcaaaaggtaacagcagtgtcacgtatgttgtgttatggaatagctgcagatgcagttgatgaatatgttcgtattggaggtagtaccgttattgagagttttagaaggtttatcgtagctgtacttgatgaagtttttggggaggagtacatgaggacaccaaatgagaacgatatagctaggttacttgcagttggagaacgtagaggatttccaggtatgctgggttctttagattgtatgcactgggagtggaagaactgcccgactgcctggcatggtcaatataaagggaaagagggagttcctacctcagttttagaagctgttgcctcgcatgatcgatggatttggcatgcgttctttgggttacctggaactcataatgatattaatgtgctccaacgatctccattgttgctcctaaagttaattacaccattaacggacacaactacactatggggtattatcttgtagatgctatttatccttcatgagcaacactggtgaagagcatccagatgccacaaggaaataagagaaaatattttcaaaagcacaagaatccgttaggaaggacgttgaacaggcatttggggtgttgcaagctcgctttgctattgtccgtgggccagttcgtttttgggatccgttgactatacgtcaaattatgagatgttgtgtaatcttaaataacatgattgttgaggatgagcgtgatgacgaggaagatttacattatgatgagatgggacaacaggcggatggttcccatgaacgtacggctgaatttaacgagttcctcgcaaattacgaaaaaattaaagacaaggcagttcacaatcagctacaagaggacctcatcgaacatttaattgctaattgatggaatttaagctaaatttatgttgaagccgaacgacgacttaaaatactagtcttgacacttttatagtactcttgctcctcgattgacatcgcacttgtatctagcctcagaagtctatcttcttctatcatcctcttaaaatccaacttttctttctccaaattaatccgttgttgttcaagtgcaagtgcagctctgtacctctcctctctttggcgctccttctcagcatcggcctctttcttcttagcccataaatgatccaaagcatcaattttggattgatctgagcgttgacgctgtttttctctctttcttcctccctgcaggtcttcccgaaggctgcacagcatcaactgcaatagggtcctctttctcttgagggacacagttctgaggacctgaaggtgcagacgtagcaggtgtagactgcacattggtcttctgcttcttatttgcattattttgacctgccttgtgaattcaccaatcaatccactttggctgatccttcaaatatttgtagcaatgcatgaactgaaaagtcctgtttttttcgtcttccttcgtatacaacagcccagcctgcaaaagctgaaaaaagaattgcaaaacaaagttaggctaaaaagttaacaaataaatgattactaacaataacatataaaatagattaattttcaccttgtcctcagcattggcaccactttgaggtctattctcgatacgacttacacaaccagcaaacgtattgagacactcttgtatagtggaccaacgatgcatgagcgaattttgggagcgatctgaactaaagtatttgtttgcatgaaaaaaatcacaaatacggttccagtacgcactccgagattgatcggcaccttgaatagcatccatactaacattgacccatgctgacaccaacaagacatcctcctgcatactaaaattcttggaccttttttggttaggtctcgcagatgcttccccttccccaccttgatgcactggatcttcgggtaatcgggttggctaccttcagcactccaattgaaagtattgccaccctcattcatcaagtttgtaaaatacccatcctccatgcttcctgttcatggcaattaattcatcacattactcaatatgtacttcgattagaaatatacaatagaatttcatgaacaataggcaccatgtaattgcattgccaaacatatgcagatgcatgtgtggtaaacgatgacacactgaaattttcattttctgagagcatgaagttatattagccacaatgacagtatgaaattattttagccacagtgatagctgcaaccaaactgctggagaactaaagaaattttgtgagagtatgaatattagtttgacagacacaaagtgaaggtcatttggcagattgctacattttcatcaatcagcattcttggcaaattaactcccaaaaatgtcatagcaaaatgatttgtatttgtagttctgatcaaacatttaaaaaaattgcattaatttttctatacagcatgtacattccaagaaatttgcactagtttgtcatcaccaatcattctaatataatacatggatgccacactttgtaatactaaacaataccagtgattacttgcaacaagaactcaggcgatagagcatttcaatgtaattcacacaaggacaatttcatgaacaagcatacggtattagctatcaattaccttgagcactgacaaaattagtcacgggcacaccaaagtagcttccacggttgaactcctcttcactagcagataatccgtggcccaaatcaacactggccgagtcgacctcgacaggatccgtcccatcggcgtctgggatggtcacctcctgcacttcttcgtcgatctgctcactgggttgacgaggcggatgggtaggacttggaggcgcaaaccctacaatggagggagccatcaccggggggcacagaggagaggccggccagttcatcccgtacggcggcagataaaaacgtggtggcggcggaatcagggaagaggaggaaacagctgccgccggacgagccgccggcgggcgcgacgccgccggccgtgacgtcgccggccgcgacgccgccgatcgtgatgccgccgcgaggggctgcaggtacaggcgccggcgggcgaggcgccgctgccgggagaggcgctgacgggcgacgcgacgccgccgggagaggcgcaggcgggcgcgggcgcggagaatcgccaggcgggagcatttcgccttcgcgcgggaacgagaggagagaggcgggagtgcgagattgggagcgatattcgcgagaaaactctcccctacataagccgagcgaggaatcgggagaagggagttccaaaactttggcaggagagtaagggatctgttggagctgttttttagactaaaatatctcaaaattagttttgggaatcagataggtggactattggtgatgctctaactattactcccttcatttcaaaatatttgacaccgttgactttttagtacgtgtttgaccattcgtcttattcaaaaaatttaagtaattatttattcttttcatatcatttgattcattgttaaatatactttcatgtacacatatagttttatatatttcataaaaaattttaaataagacgaacggtcaaacatgtaagtcaacggtgtcaaacattttgaaactgagagagtatatgaatagactaaaagaaggctaacaatagccaataggtcagctgtactgttacccttactctaactgtgggatgtgggctgccgatggtcgtgctctcaaaaggcccaactctttccggaatggctgggttttgggttggaggacgcgcgcgcacgaatgaaatggtccggtggctccgcagtccacacgagtacacgacacgaatagacaaactcaccatacatcaaccgtgtggtgcttgcctctgctgctgctccttccgtaaaaaacacaaaataacggaatgtgacccccttacaatgaatgtaatccagattatttcatagcttgattttcttttagaatgaaggaagtacaatgtaacaactgatggaccaaacctaggcggtggtcattgagcagggtagcttaccttgatctactttaaactgacatctaagagcaagtttaatagtatagccaactactgacttcaaatcatctatagctaatctaatactccatccgtttctaaatatttgacgccgttgacttttttaaacatgttcgaccattcgtcttattaaaaaaattaagtaattattttttttctatcatttgatttattgttaaatatactttcatgtatacatatagttttatatatttcgtaaatttttgaataaaacgaatggtcaaacatgggctaaaaagttaacggtgtcaaacatttagaaacggagggagtagctcattcatacaatagttaactataaaaatatactacaccattaatactcagtcctacctctcatacgcacataacgttttggagtccgtgctgcagctggctataaatctgtagcccgctttcttctctctcttctcttttcttctcgatatgtggttatagctagcttatagcctgctattgtacctactctaatggaagtactctctccttgctcgtaaagaaaatcattttggaaagcgacacggtctccaaaacataactttgacttattgtttctataaaaatatttattcaaaagtgatatatgtataattttatgaaagtatttttcaagacaaatatattcatataatttttgtattttcaaacttaacaacttgagagttattcataatttatattcctaaggtttgacttaaacattgttctaaacgacttcctttacgagtatgggagagtacaaaactagttgcaatgatggttggtttctagccatactttatcaccacttgtcaacaataattatgtcagtttaaagtagaccgagctaagctgccctgcttaatgatctcctaggtttgggtcataaggctcaagaactgatatttatattatgtcattctttatactttggtatctaagtttaaaaaacacgtgcgttatatattttaaattgtatgatttgtattattatcatgttattgccgtagcattagcataggcgtattactagttgcaatgtagtagcagaggcaagcatctcattgttgatgcacgcgagtttgtctatttagtcgtgtggagccaccggctgtcgcgcgtgcatgtgcatcaagtaaaccgcatctgccgggtaaaactggcggcgacctatgcggcccacacgcccatttaattcgcatgcgggggtgtcctccagccgccaaacctcggggatttcggcagacgatctccttgtgatggcatctgccttctcccactcaataacacaactgttactgtatcgcaagcagcaagcgctaaaagagaaacaagcggagcggtggcgggacctcgggggcactggcggatggtgtcctcgtggcggtgctgctccttccttcgccatggcccgtgtgcgactaaggccgccgatagcacgtcacgttggagggagatgaagagaggggagagactgacaagtgggtcccacatcatattttacccagatcgttacacattggcatgttacatgggcaaaagtggtaagtagttaagaaagtatatctttagagtggtaaaagaaaatattaagagtaaattaaaaaaagcatttagataattggccatgccaaatagttaaatttccccacgtatagttgtcacgggctctcggtgcacggcgccaccactgcctcctcataactagagatggcaacgggtgcatatccatcagtttctcttgccccacccacacccacgatggctaaatattctcactgaaatacgcacacgcacacctgttgcgggtaaaaaatcgtcaccatacccacacccgtgcgagtatcgggtacccatacccatataattgacctgtagcatttatagttttgtattgtaatcaaccatattagaagtataaaccgtcgatattttcttttgtaacaatgttattaacattagcgttcaaatacgagtaagaaaaaattatacaaccacattacataatcaagaaatcaaataataatttcagcttaagatctaaaagaagttttatgttatgataagagttagaatatgagcagcagtaaaaacctatcgggtgttgaatacttgaatatcgggtcccattaccatctctactcgcaacgcaaagtttcgactattttcgtggagatcgtgtggcctcgtggggagtactggagtggaagaacccaaacggccacaagaaaccgaaaccggcggtgggcagcgtcgcgatggcctcgccggcgcggcggtccgggcaccgtcggctcgacgacacccaggagttggccctccccgacgacctcctcgcggaggtcctgatccgcctcccgtccctcgccgacctcggccgcgcctccgccgcctgcgcctccttccgccgcgtcgccaccgacccggccttcctccgccgcgcgcgcgcgctccacccgccgtcgctcctcgggttctgcgcctcgcccggcggcttccaccccgccgagccgccccacccgtccgcgcccgccgcccgagccgtgctccgcgccgccgacttcggcttctcgttcctcccgtccccgctcagctgggtcgtccgtgacgtcctcgacggccgcttcctgctcgaccgcgacggcggggaaggcggcgccgccctgaggatcctcgccgtgtgcgaccccctgttccggcggtactcgctgctcccccagattcctgaagacctagccgcctccgtccgccggcgaccgcgccgcggcgtggctcccaacggcagattcgataccttcttcgctccgatcggcgaagaggagcgcgccgcggcggcggtggctgagacgtcattcaaggtgatctggattgcgcagtgcccagataagcttgtggcctttgtcttctcttcagtcactggacagtggcgagccactgcatctccctgctggggcgatctgagccctgccttctcgcgccccgcttgccgctccctgttgcgccgcagctacgcatacggctgcttctactggatgatgggtgactcagggaatctgcttgtgctcgacatgtgtaagatgaatttctccattgtcaagctcccatcgagcccgcctggtcgtgacattgtggaatgcgccatcgtagaggcaggagaaggcaagattgggatgtttgctttctgtaattgcatcgacatttatgcactcgagctctattctacaaccatgcaaaatgaaggaagagttgccagcaagtggagttttgagagtgcaattttaatgccttctcgggatggatttcgcgtgctaggtgtgactggcaaggaattgtgcttacaagtttctcctatttgtgtgagcggatgttatttgctggagttcagtacaaatccaagttgcaagaaacttgagtttgtccggagggtgatcaggggtgttcgaacttctctgccattcctgtatgtcggctacccaccatctctatcatcaccaagcatatgaagcggtaagcttgctcttttcctgctcagctttttgcaagaactgtgaaaatttgtgttatgatggtaatactagaggtttacaatgtctttatagatcttctgttctaggaaacgacttaatgcaactgcatcaacaatccctctttaatatagtcaaatatttagccttttttttcctttcctggcttgacagttaatactaagtaattagtgctatatgtaactcttctccagaatagatttttggtagtgttaaaaagctacatcctttctttctgtgttaactgttaagtactgaacaacgtgaccatactttctacatactttctacattgtaagcttttgtgtcctggtcaaagagtgttctgaggctgttcaccagggagggggaactaggactctaatctctagaggggatgtcaccttattcacatatatattccttagatgtaatgtactccctccgtttcatattataagattttctagcattgcccacattcatgtctagattcattaacatctatatgaatgtgggcaatgctagaaagtcttataatatgaaacggaggaagtatatagttatgaaaggaaaattttgatatatgccactccaaaacttgcaatcttttcaaaattctgaaaatgatgtaggagtaactacataaattattgtgttatatagcactgtacacaaaaaagaatcatgccaaacttctatatatcagtgaaaaacgaaaaaaaaagataaattttgctgcgaattgtgcaggacaatgcagatcttttgttttttctcaaacactgtgggatggtttgtatctattgtgtaacgttgtctaatttttccataacttttcataactatttacattactttttcgcaatgagggaacatccccttaggggtttgaaacattttccccagggaggggttacattcacatgcaaaattgatttcaactactagtttactagctacgaaatacttccaggtctggttattcgagtatctgggagttatgtgattattcatttttgtagttaagcttctgtggttattgaacttccgttcattgttgttgtgggcttatggtattcaacttctgttcattttttgctgtgggcttatagctattgtcctggttgttgcttgcaaatagcatcatggccataagtcatgtatcttgcagagtactgaggggatcactatgcccagcactcaacatcacacagcttgacaatgtcgcaggctacaatttgttttggggcaaagtcatcanaaacaaagcggcagcattcctgagtagcagcattcttgtttctgctgactttgccacacatggaattgtagcctgtgacaatgttaagatattacatgccttagcacagtatccctgctaactcattttgtgcatcacccaatcacaaacaatttagcaataatccctcattgacattgaatcaatcatccgttcttcccatccaacaggcaactaatacaattttgattaaatccttcaaacgataagggtcactcaataagcatcttttacttccatttcctagttaaatgttcatatttttggtaggttcattcccttttcatatggccacataaggcagtgtgctgatatttttatagaagactagtagtaaacactgcctgtttttcactgttctgtttagaaatgagaatgacggtttaagtaatgatgagcccttttttaaataagaaagttgcttatcatgagccctgacttcaactatcatgttgcttaagtgaagtgtaaagatggggttctatccaaaccaaaaacaactcgttactacagatgactacagaatacacgtcagcaattgccacagcaacttgtttgctatctatagtatcaactctgttgctgcttggatggaaaacgattaattccttccatcatgtgtagctatcatttttatgattgcatagtaggttcaactaactggaactgcaaatttgggcacaatcagatattcaaagatagcattgaattaggtgttatatgacattaatattttttttgcaacgtataacactgcatcatgcttaattatttgatctatgagaaaagatatttgaaaatcaaaattaagataccacagtcacaagaatctatcagacaagaaacgtaagataatattgtagaaagtccgagtactcttacattacatgcaatttatataggtgaatagttgtgatgacttgaatattcatgtttgtagtactttgttgacatggttatgcagtaatgcttgttccaacatgtttgccacacctttgaactgaagtgtatgctcaacttccagcataatgattttccagatagtctgaaagtgaacgtttatattgcaggcaacagcagtacgtcttcgtttcagtggttagtcgactatgagcctctcttttgtgccatgcagctggtgcaaggtagtactctctagtgttagggtagctatctgtttcgtcggcatttttttgatgatatgcatatcatgatatcgaacaccgattggccttcctgttttgttgaacgccgcaagtactatgtattcaaggatctttgttaccaagcttttgcccttggaaatgcgctggtgcttcgttggtttttcactgtggctgcactggagcaagtgttcggacgagctggtaacctattgctccaggtgcacagtgcgctacttaagtagcggcagagtataaaatcatactcctacagtttgaagtagaccaagctgcccatatttagtccagtgcgttgcagtttacggcttcatattgtcgcttatgcttatacttatcagctaaaattttaattttcaacattaaatttaaagctaattatagggttttttcattgaagcctattttttagcctttgcttttagattattaagaatacgtatataaaagttttattacaaattacttttcgtttacaaatatgctgtctagcttgttccttgaataagcgaaacaatggagccgttacttgtagtagcgtagtagcagccatacaggagtccaagttcgcccgcgaaccgcggggcagcgggcgaagcggaggcctctggctcccgccgtggcggcgtcccaatgtcccacccacgtagccgtgcatgtggatgactcgtgttgcgccttgtgtggtcacacggttgcaagagtctacattttaacatgttttttttaaaagaattgctgcagtttgaatttgtgaagacatctcataagagcaaggataattggcagagttcttatcctagtttttccaactcacttatctcgttttccgcgcacacgttttttattccgctgtggcggcgtcccaatgtcccacccacgtagccatgcatgtggatgactcgtgttgcgccttgtgcggtcacccggttgcgagagtctacacttgtaacatgtttttttttaaagaattgctgcagtttgtatttgtgaggacatctcataagagcaatgacaattggttgagttcttatcctaggggtgtttagatggggctaaaactttttagcccatgtcacatcggatgtttggatgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtcttgtgaattagtccaatgaattagtccaaggatatggaatgtgttttgtaattagtgtatgtttaatactccaaattagtatccaaacatccgatgtgacatggacttggaataagtccctggaaaccaaacaggcccctagtttttccaattcacgtctctcgtttttcgcgcgcacgcttttcaaactgctaaacaattaatatttttgtaaaaatactatatgaaagttgttttaaaaaaatgtattaatctattttaaaaaaataattaatacttaattaattatgcaataataactgtttcgttttgcggccggctcctctcgttccagggatgcatgatcatttgattcgtttgccaatgacacgcgggcccttgagcgctaggatatttaataaaaaataagtacaaaacccaccgccatggcgtcgccggcgtggcagccgccgcaccgcctccaacctcccccgccggcgcagctggacctcaccgacgagctcctcgaggaggtcttcgtccgcctccccaccgccgcggacctcgctcgcgcatccacggccttcgcctccttccgccgcctcatcaccggccacgccttcctccgccgcttccgccgcctccacccgcctcccgtcctcggcatcctcgccgcgggattcctcgcggcgcagccgccccatccgtcggccgccgcggcccgcgccctcgccgaccccgacgcggccgacttctcttgctccttcctcccctcccgcgaccgctggtgtctccgccacttctccgacggcaggtacctcctctccgccatcccggaacgcagcgacccggctcccgaccaccgcgccttggtcagggaattcgctgtctgcgaccccttgtaccggcgctacctgctgctcccacccatccccgatgacctagcctcagtagtaaatcaatcagagattgtgaatttcgagcccttcctttgtcctgctactgaagatgaagaggacacaatgttcagggtgatctgcttggctcagtgcgaggccaaactggtcgccttcacctactctaggtgttctgggcaatggcatgctgtggagttcgatggctggagagatttgaccagggggactagcaatccgtttccatccggtgagcctagttgtccggacggtactacgcgcacggatgcttctgctgggtgatgcattgggtgaacaagttgcttgtgctcgatgcccgcagcttcgagttcagctctatcgacctcccacctgggccctcatcacgtcggatggtcattgtggaggctctggaagggaagctggggctctttactctctgcaatgacaatgccttatactatttcctatggtatgacatcttggaaaatgatgatgagggcgcgcttcagtggtgcatgaaggagattataccactacatgaaaattttaactataacatcttgggtgttgctgggggatacttactcctacaagggtttcctcatgactttaggccaaagaaactctgttttcactgaatctcaggacattcaagcttgagtggttttgtgggactacatatgccatcatatctccggacatgtacgctggttttccaccaaccttgtcaccaccagctatttgaagtgggtatggttgctttccatctttgtttatttgtggaagaattgcatctattccaccatatcatattttgcacacaataggacactgatatgatgcagataggacactaattgaacttcattttgtttttggtaagtatgtttatgttctttctagttgatcacaccattgcagtagtcagtaactcagtacctttgtaaattttcattgccatgtccatataaactcctttattgagaaacgcctagggatcttccggttagctccacaaggtggtggactggtgggctagacgacctgggttcgaagcctcactccttctaattatttgatattaggtccttccgtaatattcgtgcttttttttatataaactcctttcttgaggtagaaaatgcaagatgcatgtctttttcccccttctgaacagttgtttgagtaatgatgggcattactatggatacaacctaattatcttcttccagcagtcacaccttatcgggtgtctgtgcctggataattgatttgtgttgcacattgctctagcttaggtgattttcagtttttaatttttccatgctatttagaagcttgtcaaactcgagaaatgaacaatgatgtgctcttgtctgcatctttttgtgtgtttacttgtttcggttttgtggcaattctgttcatggtagaacgcatcattttcatctccaagtaccaacataacacttccagtgaatctgagtaaatgttgatgaactactgtaccatatngtaggcgaaannccaaggccctg

SEQ ID NO: 63612 - DNA, 37080 bp, Oryza sativa
  unsure (1)..(37080): unsure at all n locations
ttgtcaaaaacattatgaattctttgaagaatcttggattctagagatagttgcattcacacatttcttgctattgatgggcttgttgagtaccatttgtactcatcccctatgttaattccttgtatatagatgttgaatcattagaatctgttgaacaagaatatatggctggaagtgaaggaactcacgttatggatgacaaccgggaaggactctacgatgatgctgagattgactatgataattagtgtataatatgcatggttcatatagttgatgtagtggtgatggtagtagcagtggcagcggtagtatttgtagtagtagcaataacgttaatatgagtagtagtaataactgtagcagcacttgtgaattttctagtgtgctgtatatttgctgagcttttggggtttgtatattattttgttgttatcgctcgaggcttgtcttgagctgtatctattgtactgtaataaccggaaccaatgcgatgtttctgctatgctactctgatgtgcatatctctgagtaaacgatgtctatgaagatatatgctatagacttatattctactcttgttgtggaatatgtgggtcgtttcaggtggtatcagagcattgttcgaccttaggccgtaagttagttggagacttgagaactctaggattggttgagattgccttgtaaaaaaacatagattactaaaattatgttgcaaaattttcttattctcttatccttacttgtgtactgtttttttaaaaaaatatagattcccttgattaactataagtgctaactagtttgttggactgggaaatggaggttcaggatattgaattgccaaggaccacactgactcaaactagacaggtcgacgactttcatagtacatgggttagataccttgcagaggttcaaaactccattggacaaactgagagaactcaattggagattcgcatgatttatgaggggcctggattgctgttttatgaagcacatctaactttagctcctatgcatggattttaactgcgtgagtttcatggttacaatagtgaggagagttctggaaatacttttgacaaggattattttccttccatgagagagcgacgtttgactgatactacagcaccagctcgtcgtagtgctcgactgcaagctagagagtctcagtaatgtggtagtgtaggaattagagggactgacttttgggaatggctggatattatagatggtttattaaagatttttccaagattgctagacctttaactcagttacttagaaaggatgttaaatttctatggacagaggactgtgaagagagtttccaagaacttaagaacttaagaggagactcacaaatgcaccaatgttgactttacctaggatgggtatgaatttcactgtgtactgtgatgcatctaaaacaggattaggttgtgtattgatgcaaaaccagaaagtaattgcttatgcttcaagacagcttcgacctcatgaagtgaattatcctactcatgatttggaattagtagctgtggtatttgctctcaagatatggcgacattatttatatggagcaaaatgtgaactgtacacagatcataaaagtttgaaatatatttttactcaaaaggatctgaatatgagacaacgacggtggttagaacttataaaggattatgatctagagattaattatcatcctgggaaagcaaatgttgtagctgatgctttaagtcgtaaagcacaagttacacagattgtaagagaggaaaacatgcctaaagaaaattttgctagtttaaaccggataaatgttgaggtaattcaaggtccagctacaacagtaataaacaatatgatactggaatgtgaattgagtagtcagattcaagataaacaacaagatgatgcatatattcgagaagaaattcaaagaattaaagctggaaaattttctgaattcaaacttgatgataaggaactgttatggtacaagggtagaatctgtgtgcctaatgttccaaagattaaggaattaattcttagagaagctcatcaaaccaatacactatgcatcctggaagtcctaagatgtatatggatttaaaggaaagattttggtggagaaatatgaagagagaaattgcaaaatttgtatctgaatgtgatgtgtgcaggagggttaaagcagagcatcaaaacccggcaggattattacaaccattacctattcctgagtggaagtgggaacaaattggtattgattttatcacgggtttaccgagaacaaagaagcataatgatgccatatgggtaattgctgatagacttaccaaatcagcacatttcataccaatacgacagaatatggatactgacaagttagcaaaactctacttagatcgaatagtaagccaacatggagttccaaaacgaatagtgtcatatagaggatatagaggatcagtgtttaccgcaacaacggcgaatcatcggatcccgcaacaacggcgatctacatcatctaatcggattccgcaacaacggcaaccctcatcactagcccacactcacaggattcgcggaagtccttaagcccgcaggataaagccattaagaaagaactactaaaccagcctgtcccattccaggtcatatggtcgacacgattgctacggcgcttgcataccttgcagtagttgttaattaaccttatgatgttaagcatatacagctgaaccacacaacaaccaagttcagactgccaattattaagatcaccaaagaactgatccacagatccacatattttaatttgaatttttgcaacaaatatttgtcaaaaacattatgaattctttgaagaatcttagattctagagatagttgcattcacacatttcttgctattgatgggcttgttgagtaccatttgtactcatcccctatgttaattccttgtatatagatgttgaatcattagaatctgttgaacaagaatatatggctggaagtgaaggaactcacgttatggatgacaaccaggaaggactctacgatgatgctgagattgactatgataattagtgtataatatgcatggttcatatagttgctgtagtggtgataatatttttaaaccaagactaatatattataaaatttatccaattatagatttaatgaaactatgctggtgttgtaaatattactatttttttctgtagagttagtcaaactcaaagtagtttgactttgaccaaagtcaaaacgtcttataaccttaaacggatggagtacgatacatatccatttcaacgatggattttaaaacctgaaagggcaccgttcaatacaaattaaaattaaagtacacacgtctacccgtcgtacacctggtttgcaatagcttcacggtaagccgacatagctgcctcgctgttgggtgagtcgtaccatgtgcgtaggggtggcgcctgtggcacatgggggtacccgttgtacaatgggtgatgtgtcataaagtggaggtcgttactatcaatcttaaagttgtgaagagcaaaagtagcaactataatctttgtctgagcatcagcctctccaaataaaggaattcccgtaagactctccactgactcttgatcatcccaaaaactctttcagttgtattacgcaagctgagtgcatgtagttaaaagtctcttcctttccaactgggggtggagctttgtcgttatcgaaatcatccaagtggtatagcacatgtggatacggcggtaggaaaccgtacctactgggataaccatagtcaacaagcagatattttcctggaaattgaagaaatacaagtgtacgcattgggcacaagtgcatatttgaacttaaattaaaatgcaaatgtcaaagtttgaaaagattactaacctcatgacaaccttggaaacgcgaagggataagatcgcacagcctctgatagcactctctagtcgtggactgaaccaggccatccagcacctacaaacgtaactcgttcatcccaaccaataacggtgagcacattccttgaagtctcgttgtgacggttcccgtgtacagttgaagttgaggaccgcacgagaagaggtatgtgcatctcatcaactgcaccaactgcatcacagaaaggaaggcaggcaggctcttgccctagacggtaatgttgagcgaagttgtttggatcaacacatttgatgatgtcggctgccattgcatgcacaacattcaataccttgtgaaaatatctatttaccgtggcattgcaacgaaccatcctattgttgatagccctcacgaaatagccacctgccatagagtacagaaacattccaattccttccatagggcatacctcataggtaccatgcagatggtacctgttggtgagtagattatagagagcatgaatctagtccactctcatgcgaaacatgttgtggcactgctatatatgggttgcccatctccacaatccattttgttccgtactactgagggacacgtcttggagctcttatatgcacattcctttgaaaagaagcagccaacaactcaataattgtttcatcctcttcaccagtgtatccatcttgagactctgaggtgttctttgaactgatactcatcctcctaattcatcaaataagcaaatagaggttgttatgcatgttatgatcagtgtcatataaaactagttcatttgctctaaaaaaagttaattagaaacacgtaaataattaaactgaagcaaacaataaatttaggttagaatagtaatgaagacaggaaatttggttagttcatgtctgcacaagttcagctcaaatgttaataaattacaaaatattaaatttatattaccataagcacaacaaataaattgtagcacaaatacagaactaaataaattattccattaaaccaagcaactcaaatatcaaatgcaatgtgtgccacattattcatacatacatacaaataaacatgcatacaacgtttatcacaagtgttgattttaaaatcgaacacattattcaactatcatcacgatggaataaaaaggttgcttgagcacacttgagctttagcctcctgcagcagcaaacatcagcttttgcacttaatagcagctagcactcaactgcaaactgcagctcacaacaacagcacacacctcacagcatcacacacagcacatagcagcacactcccatcagcttcggcatacaacacacagcacacaacgctcccagcagcagcaacactaccagctccatcccccatcagcacaatgttgcaccatcagctcccccagtgccatcatccccagggtcacccccatcgtccccatcaaaccctccaccaccaggtggaaaccaacctcctgagcatgatggtagagggaaaacctccaccattaggaaacttcatggcatagtggaagagaatgtaatactcacgcatctcctgagtaatggcatcaccaaggaataactcgtaaaagtaggggtcacacttgatcagcacaatgcaagccctagcactcctcacctcttactcccgctgcttttgtgctttgctctcactggacttaaccctaagatttgcgagcctctacaaagcctcacctgtggagtcactgtgggtctttttggaacccctagatccactactcggtgttgccacacttttgtccctacgcctgataagccttgatggtggctcagatgatggtggcgactccgacaagttgacaaggtgctaaacatcaatgacaccagggttggctggcagcagctgctattcaggttcagctacaggaacacttgaacggttgccgacaacagtcctccctctgaaaacagcatggtgttcataaatgaatctgacatgaccacgcataaatgatcttgcccctctcctcatctgcatgtgagaaaaagagatatataagaggttgaatatgaagcacaattgcaaatgtattgcataaatgactgccgccgacatttgcatatccaatagcataatggagcaaaattgtgttgcagcaagcaaggacaaagtagacataccaaagttgaaaaaaacatcaactacacagcagttgtgcatgtttcttttgcataaccagaacaaaactgaaggcacaaacatgaatcacccaacagcagcaagcaaatatgtgtaaataaaccatagaatccatattgttgaagcaacaagctcacagtagcagcatgtgcagtccatacacatatgcagtgtgcagaccatacacatatctctactacttaaaaaattcgtagtggtggtcttgattcctgacatagcagacgcatctgacagacacacgtaatctcaaccatccgattgccatatccaacggcgtcaatcttctccccatcacgcgctcgctcctctcttgaatcgatctcctccccacgcccactcctcctcctcccacgccgcgtccttcgccctcctccctgggcgacgctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcctcaccttcacacctcgccaccgcatcgcctcctcagcagccccgtgccccgcgccccgcgtcccgcgccgccctcgaccgccgacgctgcgacccgcgccgtctcctcgctgccgtcgccgcgccccgagtcccgcgtcccgcgctgccctctaccgccgatgcgggagcaggaggtcacgccgcgtcaacaccgccgaggagccgcttcctcgccgccgtcgcgacgacccgcgccgccctcgactgccgccacctccgcagatcgccatcgcacgcctccgcctctcaaggtcacacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtccttgcccagatcaatgccgccgccgatccctcactcgcccctcgcccaagtcggcgccaagggcggggttcgccaatctgcttcccagccgcctcgcccgctccatgggagaggtgacacctgtgcccgcctccagcgctccatgcccccggataccatccgagcacgatccctccttagcttctgccggagaagggacgcatgcgccgaccttcagcactctacgcgccctgtggataattggttcgttctctttacgttgcaatccattcatttgtcaagaatcatcattgtgagtgccgagggttattacagattgcaggatcactaatgctcttttttgcccataaggtgttcaacgaaatgctgcttagccaatgtattaccagaaattgatttctctgtaagtgagaatgtcatattgtcatgtcccctatgttgttatttatactaatgattgcaggattctctctgttgttatttatgctatgaagtgctgggaagttgagagtgttgctaccaagcaaaaagattcaattgatctgttggagcaaactaatttggatctcgcagtctcaaaactaatctggttcttgattgtttcagagtggatgaaaataaaaaatggaatgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagctgtgatagatctgatacctgcttaaaaatttgagctgagttttcatacctagcagtaggactaacattttatgttgtattgttcagctcaagatgaacaaccacaccaaccccaagatcaccaactaagcctatcctgcttcatgattgttgctgcaaactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattatgatttcccatgtgctcggctattggtgttcttgtttttatctgttttgtttcagggtgtcattactatggagtagatcatttttttcttattttttttaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatatgatcatgtcccattattttggcacttgctgccttgattctgttgcctgtcccagcccttcagctagctctctatcacacatgaatgcgtgacccttgatggttgtatgcagttgggatattttggtgagttcatcccccttccccaccccacctctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttttgtaatttgatcgtagcatagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatcttttcacttaatataatttgaaattgatatatagcatttcccgttgcaacgcacgggcaccttactagtgtcacaagaatgtacatatgccacaaagtcctaaagtgtaattaaatagggaggttatccattgacctatgttgcatttgcaaaaccaccccataatgaggagtgaaacaagatctaaacattgtgaaaagcattcaataatgcatagcatacagctagttacagcagcagctaacttaagaataaagtttgcaaagataaaatgcaagcagcagcaaacagcaagcaagcacacttcatggcatttctatatgacagtagaagaaaaacgaccaaaggcatgcaaaaattctttaggtgtactatgcataacaacaacagcagacaacaaatattgttcagtggtaatgcatttcaatattttaaagtgcatgtaccttgcatcagtaatatgtaatatggtttgtttgtattaaaaacatcacaagatggagatgtaaactaaagatatgaggttttttagccaatcacaaaatgctctaatagtcaatgacaataaaatataactatagctaaatatgggagcaaccactattgtaggcaaagaaggtgatagttaaaatataccatgttgggagtagcaggtgttgtacatgtgttcatgaccttgtataaattaattgagctcttgcatgtactctattgcataataattaattgaaagtagtgctacgtattattcaaaagaaaatttggatttgctaagttatgaagaccaattgtactctagttggaagtactatatcatatttcattaaaaaaaatagcaaatttatcatctatgatggctttaggttttgaactcatataaatgttttagttttatgtccttgtagattctcaaataatgctactttcatttatcataagcatctacatttttgtatgagacaacataaggaaacctatgagatcataatgtactaaccttggaaacacaatgtgatgtttccatcaatataattaccatgatctacgatgactttattcattgaaaaatccatatgtacttcctccaatgaattctacatttctcgatcacacatacctaacttaaaatttgattacatctaattaaactatgtattctactctgccacagccaaaaattagttaacagctacatttaatcctaggttgagagatccaaatatgatggttttttctacccttatgtgaaaatgagttgtcattacagcaaaaaggagtactgtgaggacttaccccttccattgattcccaccactctgggctggcgccgatgctgccagtgtaggggttccttcctagcccagttgccatagattccagccatgtccatgtctagaatcggcggcggcaaccatcctagaaattcttcacctgctgcctgctgcctagtgacctgctttcctaccttggccagcatctaagcttgcgagttggcatacccctgagctttggggcaagacgatgtgatgttgcgagctgcaatttcctccatgtagctctctaggaacgcttgcagttcgtccttagtccagtgagtgtgccctccgccagccatctaaccacacaagttgagcaaacagaaacaaacctcagaaactcaaatctaggtagtagttacctttcttagtttgtcggatttgaggaggtcccaatccaacgagcgcacaaccttctccggcgtgaggcagcggatgaactaacagactgcttcagggttgttggcagctacggatgagagcgcacgagcgatgagctccacatcgtcttctgcagtggctccagacacaacgtcgaagatgtacaacttgctagaatcttggctcgattccaggtcagctgaaacctctcccaacttgccggcgtcaatgggcgacactaaagagggggaggtacagaggagaggttgaggggatggacattttctcttgattcctcttgctgccatgatcaactacgaggggtctaaaataggcgtcggcggctcttcaatggcgcacacaaatattgaagccgcgcgtcgacgattttacctaggcaaattttgctataagacactgccaatgtgtggttttagccctaggacactgccaatgtgtggttttagccctaggacactgcccaaacttacttttggaggaaaacacttcataaacgtggtaatttgccaatggacaccgcaccaaataaaataataatttctggttgaagaggagagagaaatcgcgtgaaatgtcaaaaatgcccttgggcccacatgtcagctatcttctctctctttctttttctttctcctatcccttcttcttcctaccgatcgggaggacggccgggtcgctgctgggcgcgatgctgatagtgctcttcgtccgccgacgaggttctatccaaagttccaaaccaaaccaaaccatttcccccttgtagattcaatccagttcttaaaaccattcaagcccattctaattccactgcaagccaagcgaagaggagtagttcatgttgaggcggaaagtggtgacgcccgcgccgaacaccccgtcgggccccgtggccgtgcggcactggaactgcatcatctcgttgccgtcggcgccgtaccgcgcggccaccctacacccacaccagccgtcaccgccgcagccatcggacttgccggcccgccgtggccgctccaccctcgcccttccaccgccgccgccgccgtcggacctcgcctgcccacctacgatgccgtgctaatgctgctcgtgcgcgtgtcaccagtgaccgccgcggtctatcgcagctgcagcgtctcggcgtcgggctggcgctctgtagacgctggaaaggggatagagagtggagataagagagctgacatgtgggtccaagggcatttttgtcatttcacgcgatttctctctcctcttcaaccggaaattaattattttaatcggcgcggtgtccactagcaaattaccacgtttatggagtgttttcccccaaaagtgagtttgggcagtgtcctagggctaaaactacacattagcagtgtcctgtagtaaaatttgccttctacctactgtactacacgagatcagtgcagagatcgatcaaatcagctcacaaggctgcaaaaatgcagcaggaatcgctgccaggctgcagcaatggatgttggaatcgctgccggcaactgcgcacaccacgcccctttccacaggatgcggtctccgaggggctgctcacgagtcattgatgtcacccgcgtcatcgcccggctgcacgccactgatgacaacgagcaacgaattcagctccgcacggcacgctgacgctctcctcctctgcctcgacaatcgccagtcggtagtatgcactcttacgcgacgtgtggaaaggggaaaaaccggtggacaatggggtgagctgctccttgcgatgggatcacgagagagcgctagaaggagaagatgacgcggtgacgaaggtctgacgtaaacgtcatgctcacaacggcgttataacccacgtggacttttatagtatactttaagcccaacacaaaattctgctacagtaacgactcccctagcccatgtcagcccatccaactcgccactttagagcgcacccaaaagctagattgctccctagctgggatgacagctgaaaactcctgaacgacaaacagctggtcaccaacaacgccaacaaaacatgaaacatatagcacgaccactacaacagtcccaaatcatcaggcagccttcccaccatacgaagttgcttggccttctgcatctatttgttatagagcaaattcaaatgaagattgtcttttcttctttgaaaaggattctccatctttgcatcagcgtgatcaacatgtaaaccaacctgcagaggaggataaatattagtgacaaagaaatgagggatgtcaagattactagttaggtgactatttagggataaaaacccatatccgctgtatcgatgcactgattgtacgtcttctgccaagcgatcgaaggcagactcaatacgcaccttctggaatctaacgatgacattgaaaaaggataattaattggccatgatttgctttaggattttaatttgcaagaatacttgttagctgtaaccaaaactattgagcaagaaacacatgcgagaacgaaattgcaaagtgagagagtacacagaggtttttggtgctgcgtataacttgcaccatatggccttacatctgtggacagcatcttgtagcgacgaatatgcatgccatcccaggcgttagagaatcatgcccgcgtgatgctcttcccgtgcgaatgaatcgtgcatgtagagcccaacggcacacaatcgattcattcatgcacatgacttgaacagaaaatatgcaaaaagaaaggagatggggagattccaaagtaacagaattaacaaaacaagcacccaattaacttcattcctaacaatactcattagacgttagcataacaatgttgttttatgcatcagcattggtacgtagcaagaacatccagatcaatcattcatgttctccatctggcactaaacactttacatctaatcagccctaggccatgtgtctgtagcatccaatgagaaaacatgtggttgaatagtataggaggagagtacactgcgtaacgtggatacgctgtattgagcctcaaggggctggtatatataggagtacatgggaaggagataaggaaggattacagatatgcaaggaatccacacaaatcaatcctgtcctaatatgactctaactaccatatactctaacatccccccgtagtccaagcgtgagcaatgcggacacttggactggagaagaaacctgcaagagtactcaatatggatgatatccctttgtgccatagtcgatgtagccaaagcgaagggtgcgaggaagctgtggtcgatgaatccgtgcgtagagtagccatggttgatgttgttgaaatcgggtgtgctgatgttgaggtagccgagccgcatcgcccgcaaggggtgctaaggagtagtcatagacgcacaggagggcgtcgtggaccaaggtgcacgagaacacgctggagacgaagacggtgacacaatcgcggcagtcgttggggaagatgacgccgaagagtcgatgtcgttgaaccgtgaaggacaagacattacgccgggtttgctagacctgaggacaactcgagttgaatgcgtgcaacggtgttgccaatatcgcgtgggagatggtaggagaccaccatcaatctatgacaatgtcagaggagactagcagagaaggcctccgagacggttgcgacacgagaatggtgtagagggagaattgccggagcaacatgcagttgttagagaagagtgaattgtagtcgaggaagatacggcaacgttggcaatgagatatgctagacgaagaagaaggtgaagtagcaggaccaacagtatggaatgacaacctcggtagccgaagtaggggcggctgaaccactggcctagagtggcaacggtagcagcctggagatgcggcggcgaggctcgaagtaaatgaagaagaccctgagcggctgatgatgaccagtgcggacaacgaggttgtcaatgcgcgaacggtgatgaatatgacaaaagcagcgaagctgtggtccaaagggacaacacagttgcagctcttatgtcgatgcagcagcatgaactccactggcggtgaggccatgctgaggagggcgcctctcagcattccaatagccaatggaggtggaccacgggcgatggcactgcagcctgagggggggatgcagcggcaacctgaagcttgatagcgtagatgcgtgcttgatgacaatcggttgcagaagtcattgtagccgagcacttgaataggtgatcaagccgaacatgcgcggggcaggacgacatagaggaagccagagccgatgccgatgtcggagacgcgtagatatcgacgaggcggtggacgacacaaacccggtctctgatcgggagaaaaaaaaggtatatgcaacagcagtaccacagcaatcaacacggtagcaacctcctcacaatctgcactatagcagcctccccacacagttgatccagccaaccattggttaaaatccccaacttgccaccccttctctctactcgtgccgactgttgaggggtcaaagagaaaagagagcagggaggtggcgtggaggagagcaaaggtgttaacacaaaaatttggtaagccccgaagtcatcatcggcctagagtcagtatcggtttcagagtcctggaatcagccaatgggcactatcagtcgccagtagtcggattcttgatgggttcagttaaggaaattaatcaattaagggaagtttatccagaagagaccgagttcaaggaggatgtggcttggaagtttatctattaattaggaagagtctgttagtttccttttatctttagaaaagtgtgtttagtgtttgataaggactttatgttttccttttaacattaggaaacaaattctcttgtccaataagaactagtatctacccatgtgtataaatatgtacacccggggtcattgtaatttatctctcgatcaataaaaatactcttggcgcatcgccaccctcttttccgaggtttttacttatcaccagcgaaacttggcacctgatgcggggttgcatcagctttcgatctccggtgaagaggtaagtcctacgttccaccggccttggcaattgtatccactacattggtgttgttcaaggctacatcgctttgacctcttggatcgctctggttcggttgatatatttgcctacctacctatcacatattttagttaatctagtttgacagctcaatttacttgtatcggctgggatctgctttagggtttttgccggtatcggctaaattgctttgccatattggattagctaaggtatccaccactattaaaaatcagtcaagggcttgattgtttagatattatgtttattttcatactttgcacaacatcagacctagtcgtgtttagaaccataatctctaccctgctttttgattgccaataagggtttcatcgtggtttcaactgatgagttatctggatgttgcatcgattcacaaggattacatacaagttggatttagcatgcaacaaaggtttcattgtttatctaatcatttggatttaataacatcggaccttcagctgatgtatgctttaaccatcatatcacttattctatcatattattattagtcgattggtttctactggattatattattgttatattacattattatcagccgattgtctttatatcattatctacattggacatatagctgattggttaaaaccatatagccgattgtctttatacattatctacattggacatatagctgataacttattagccgatcgactcttcggtgatcaacatatttatctatcttatcagttgcaagatcaaactggctggcacgcccgcatctcatcaagttttggacttgcactagagctaagcagatctccgaggctgttgtgttcgtcgacttagttcgcaccaacacagatctggcatcatcgaattagcatgcatcccgccacctaattagtgtgtaattagcacatgtcagttattattgtgtactagtaatatgcctgtacaaatgctacggggtggcgtttgataactcaaactggcacaatgacgtttgacattttaaaggcatttcatttccgcatagaatggatgctattaaggttcaagcaaaaagttacataaagagttatgccagtgacaatcacgcaataccgcacatgtttcttctggcgtgttgtacaaaatcaatcaaatggtagttgtcagcaggatttgaatttgtaatttgtacaactcgggcactaccataatgattcgggaaggattttgaaaaaaaaacaggggggggggggggggttcatgagttatttgaccattggttgcttagacaagttacctacaatgttattcttatcaagttattggaaccaagacacaattttattcaatagtcgctaccatttcacatatatacagtctaaatctatgaccttaagaaaataatattggccccgcatatataaatgcatgaataatccaaatatatctaccctgcaaattacatataacatggtccaatgacatcctaaatgcagcaactaaattcagtttggatgtttcatcattaactacacaacttgggcactaccatataataagacagtcatatttattcacaaagaaggattctgaaaaaaaaaaaggtggttcatgagttatttaaccattggctgagacaagttacctacaatgttattcttatccagttactagaaccaagacacatttttattcaatagttgctaccattttccatgactgatttttattcaatagtcactaccatttcacatgtatacagtctaaatgtatgaccttaagaaaataatattggccccaaatatataaatgcatgaattatccaaatacatatacatttcagtgttctaaacttcagaccacccaatgtttattaaaaacaactgtgccatttatctatttccatttcagcacagaaatataaaggcttccccccttcaatttgactatatagcaattttattgcacacattactatgtgatcttaaaaatgtaagcacatgtacttgtataggaatataaaggaattttgcttaggaataaatttagacatggttttatttttgacaaaatgttgtcatgtacaatgtacaggagatatgcatggtcatatgcatatcagtagtacctttctcccaaaattcaatgaagaaccagaattggacaacgataattaaaaaaaaaatatcaaaacagattttcagattatcaaaagagcggtaccaggaagttccacatgcaatctaatttcaaaatgactggaagaattcaagcatgaatattaataaatgtcaaaatttgatatgacgacatcaatgcatgtcactaaatttgatatgccggcagtgatttgatataagtctttccccttcaatttgactacacagcaaatctgctccacagaaattagaaatgtactactgatataagtctttccccttcaattttggtatccgaccaggcctcggtgctagctacagttgcagcccctttattttccttgacgtatatctgcaagccatcgaaatgagtcagctatttctagcattctttgtatccctcgggaatgctaaaaatagctgatttgtgtgcgaaatagctgactcaatgggctatttctagccggtgtgcatcagtttcagtttacagtgcaggggcttgcgtgagctcgaggacaatgcaacaggtacgactgcaggattattgtctgaaatccagattattgtctgaacatgggcttgaaatatatcaaaattcagtgtagaactaaatataaaaagtactaaattattttcttatagagataaacaagaagcttgaaaggcaaaacaagagtgaaactcattcttacaagggaaatttcaagagcttggtgctccttcctgcagaactctgaagcataggcctgcacaataatacatgatgctgaacatgagtataatgcaacaattcagtgtcatgttcttcacttcaactgtcgaaaccgtaaatttaccttgattgcatagggatgggcttaagaagaatgtacctttatttccctgaacacgtcctttgtagcatatgataaaactaatcagatgtctgaatgaaatgagaatgaatagcacatgcagcaactacgaacattttacttttacctgactgcttgcaagaaggccgtctggaagaaatgcatggagcttcctcaattggtccaccatcatggaaagcgctggactcaacaccagcgtctgtccacgcaaaatcattgcaagcacctgaacaatagcaccattaacttttcaacacaaaactatataacctcgaaatctcattttttgcagaacatatgatagtagaaatttgtgtttatatcaatataatgaaagatggccatgctttgttgttcaaagggcatacagtgaacatacaattaagttgctgataactgtagcagtgtgcagaaactgcgtggtggcaggggtcgattgcggactgccaccatggacgttggttgtgcgggtcgacgatgctctggcggcggagatcggcgcggtgtgcgagaggaaaggggattagggcgtgggggagagagttgtgggtgaggtgcggcggcgcaggaagtgatcggcggaggcggcagcgcagggagcgatcccgtcgatcaggaggtggcgcagggagcggttgccggtgccgccgtggatgtttgttgcgcaggtcgacgacgctctggcggcggagattggcgcggcgtgcaagagggaaggggattagggcgtaggggagagaggtgtggccgtgtgggtgaggtgtggcagcgcagggagcgatccggaggtggaggaaggaagggagacggatgtgatacgttggatgattttcatccgctggatttgatgaatgaagtacgaaggatgtaaacatcagttggtgaattataggatagatagaatagatagatatagcatctggcaacgcaataaatataggcgttatttttccacgtccttatttttttcagatttcttttattcattagtcctttttcattgtttcttttaacggaaacttttttatatgaattatttcctttatacatgtatagtttctatgtgtagattttatatatgtaaagattgtatatgtagattttatgtatataaactttctatgtgtagactttatttatataaactttatatatataactaatataaatattcgtatttttccggttgtcacatctaatttcgtcagagttttcatccatacacaatccgattaggttagcaatattgatgtaaaaaaattgcaaaaattgcaaaaaaaaaaaatcggcggccgccgacgccaccaccgcccgccgttcgggccgccacccttcctgccccgccgggccgcagccgcctccatgccaccggatatggaggaggcaaggcccggcccgccgcctccacgccgtccgggtcatcgcctccacgccgtccgacccgccgcctccatgtcgtccaccaccaccgccgccgcacctcccctccccccgatctcgcggaggggagggcgtcgccggccctcccgccaccgccgcacagagagcgcgggggagaagtggagagagtgaggtgcgagggagggcgtcatggtgaagaaggctgccgtcgccgccgctagcggtgggagagggcaccgccgcgccgctcacgatgggggagagcgtcgccgtcgccgccgctgctcgtgatgggggaggtagccgccgccccacgtcggtcgcgagatctccggctgccgctgaggaagatgggaatcgcggtagggaggtagtcgccgccatagccgttgcagctcgcggtagggcaagtagccgccgccctgcctccgctgtgagatcgccggtcgccgccgccaccgctcgcggtgggagagggaggagaatgagtttagggttagggtttcaacatggaatatatatatatatatatatatatatatatatatatatatatatatatattgaatctattctacacccttcccctagaataactattctacaccccctcctcccatgggtcaaacccacctccccaccctccctagggcccaaaacccccctcccacctcggtcaaagcgtcctcccgccggtcaaacctgcccaccactccctcccccgcccaccactttgctgctctcgtcttacaggaatcgtgcagtaacaggacggtcatcctgcagtaacaagacagcattatcgcagtaacaacgtcaaaaagtagtcatgatggatctagtttcgttaagcgtttttttatgaacttcatggtgcaaacggattggaaatacaagatatgatgtgagagatattgctctctaaagattgtgatttatctcttttttagttctcgtctcactggaacagcgtagtaacacgatggccaatatatagtaacacgtctacttttcgcagtaacaacattaaaaaatatttatgatggttctagtttcgttaagcactttttttttacaaacaccatgatgcaaatgggttagaaaaataagacatgacgtgtacgttagtactctctaaagattgagatttaaaatactctagatctaaaaaacattactactataaggccactgttactatgcatgttctctgttactgtaaatttcgttatattgttactgccaaaagtgcagtaacaaactataaagtttacagtaacaacctatacatttttgcagtaacatataatgttactatccttttgagataatgttattgccgaatcatagtaacaaggtatgattgttacatgtatataactgatttattcataaatcatcatatggtgatttggtaagaagtgctcgccatgaaccatgagatcatgggttcaagtcttgaagttgagattgggggaggatcaggaggagggaggagcgacgggagagagagggtatttttaatttttctaaaaaagagagaataaggagggagataaaaaaaagaagaaaagttgatattgggggaggatgagaaatcgggaggaagagagaagaagagggagagaaaaaaaaagagagaagaagagggagagaaaaaaaagaagaaaagttgagattggggggaggatgagaaatcgggaggagaagagagaaggaggagggagagaaaaaaaagaaaagttgagattgtgggggaggatgagaaatcgggagaagggagaatcggagggaggagcgacgggagagaggagcgacagggaggaagggaggtggggacggagggggcgcgagagggagaggggggcgcgggaggagcgacgggtagggagggaggtggggacggagggggcgcgagagggagaggggggcgtgggagggagagaggagcgatgggaggggaggagcgacgggagggagggaggtgggagggggtatagaatagttattctaggggaggggtgtataatagagcttttatatatatatatatatatatatatatatatatatatatatatatatatatatatatatatatatatatatatatctcaagcgatcctaacgttcgattgaatccgacgcctcttagcgcatctaagccgacttgggccacatgggccatgtgcacttaacaggccaagttgtggaagacattcggcccatccttatgggcctaattgagttttatctattgagttgatttaaactatttctcccttaagaaacttaatattttcctatgtttagtttttctttcttcatgttaaattatttatatctaaatggagtcaacaagaaatgtaattgtatatcaattaaaaataaataatagaatttaaatttggactaaaaataaataatattaattattttttatatggactatagcctctttcggagaatattactctcttccaatattatttattttataattcataatgtcttagtccaaaatacaaaatgaaaaccaaaatacacaaaaaaaaagtttgcagtacaggagttcaattagcttttctttcccttttcgtccaggagtgtgggtctgccccgcttttcttttcgctatttttagcgttcccactacatgattttaaagatttctatcgcacactatatttaacctaaaacaaaattcagctctcacaagtacaatgcatagaaaatcgagtatattctcacaattacattatatagattacaagaaaatataatttccgcatgacgtgtattcagacgtgtcctttgggcaattccattcatgtcctttggtcaattccattcatttttcattaggattttgtactttaaaaatatttgatttttctattcatcacttaaatttttcatcaatcactttctacgcaaaagcaatcacttttgttgttcatcatttgttcctctcttgctataatcattgggcccacgcgtcagaagtgtcatccacaacacgcaaatgtaaagtagattaattgtcaaaaacaaatatgatttgtttatcactctacatatagccgatgtttataatcatactatggtgttttggtaaatcattaatatcgaactccagtcaccccgccaattcccggtgcaacgcacgggcattttgctagtagaatttatatgtctgcaattataaagtttagtgtattaattttaatagaaatataaatgttgatcatcacaggatattttttaaaaaataaaatagctacattactccaatccaagcaaacctcgtaagtcgtgacaagaaaacataaagacttattttaaccgaagaaacaaactaccgggacattagccattaaacaaatcatgatttaaacacgtaattaggcatgtaattagctatgaggaataaaagatgaaacggtaatcgcaaaattcgcgagattcctagctcgtatactagacctaccaatccgttcgcgtctcccgcaagttcgcgcgatagacttcccctaaattttacataggcttgacctcgaagcggccaacgattggtaagttcctccgctgaaatgaatcagctctccacttttcaaccttctggtccaggaagaactgtgctgtgtcatcaacgtgcaactcctcgagaaccatggcgttctccaccaggaacttggtgagatggaccggaaaactgtccatctccttggccgtgaattccatggtcaccttcctgacggttttctccaaacattcgattgccggctcgcttacgcgctgacgcttaagctcaagatcaccttcgtccttggaagaagaacttgagcttgactcgatcctcctcccaatggagttcccggatatccttcggttgaagcgctgttcttcggacacggggtggctgtggctgtcatccttcgttgttagcctgagccggagttcagaaacagctgggcaggattggagcagcttcgccattgctgacaacgatatgggcgtctgatagcggctgtgcaggtactgtgcttccaggtggaggaacgcgaggttggggaagacggggagggcgccgccgccgccgtcgtcgagaatgtcgtcgacgcagtacacgcgcagcgtcatggccctcatcgtcgtggtgtcgccgccgccgaggctgcggaggacgcggcacaccggctcgtacttccaggtgaagaaggaaggtcggctgatgtccacgtcgacgagcgcgaggttcgccggcggtggtgccagcgagatcgccatcgggtgcccgccgtacgagaaggagaccaggctcggcgcgtcgagctggagtgcttcgatccttgacgtcacggcgacgagcacgagcgtcgtcaccgtcgggcagcggaggcggaggacggcggtctcctccttcgtcttcgccgccgagatcaggagatggacacggtccagtctgagcatggcgagcctcggcgcggcgtcgacgatggtctggaggaggtgaccacccttggacagcgacagcatgcatctggtcatcgctagatccgtcagggacgggaacgccgccacgacggacggcggcgacgagtagcagcagcagcacgcgaggtgcagcacccgcagcgtggcggcgcacggcagcgacgctagccgcagcttgtacatgccgatggtgtcgccggcgtcgccggcgccggcgaccggtagacaatcgacgcggaggtcctgcagcccggccgcggcgcggtgggagaggattgcgccgatcctgctgtcgaagttggagagaacagggcgtgccgcagccgagtccacggcgagcgagagcttcttgagggctgggtcgtcgccacggcggaggacggcggcgagggcgccgtcggcgaagcggaagaaggcattgtgtgtggggaggaagggttcggagtagaggttgaggacgcaggtccggcgccacaggggacgccacctgcgtgagaggacggtggtggcggcggcgtccttggtgtgcagggaggagaggatgtgcaggagtaggtcgtcggagagttcagagatgcgatccacggcggccatggatgatgttctcggctgggcaacagcgagaggctagatcgatccgttagggtttcttcgaggaaacgaggaggaatatcatatatatatatatatatatatatatatatatatatatatatatatatatatatatatatatatatatatatatatatatatagccacacacactagcaaaagtgcccgtgcgttgcaccgggaagcgcacagatcaaaaaaatatgcaattaattaaaatacaaattcactgaaatatttggtatttttaaataggtatgtgtataattaaatatatttacaagtaaagcaagtgtgagaaataaaatgacattgttaaatttaattttattaaattctccatgattagttacgctctttggaattttattggaattttcagaacttaattgctaattttaataatacaaacatcatttaataattatttaattggaaaaagaaagaaaatccttccggttaggtttgcttagaaataaacacattcaataaatataattgtaaatgcttatgaagaaatgaagcactaaaaatgaacttctctttttttttcggcccgagggacctaatatagacttatttccggcccgagggacctaaaatagacttatttccgttccttccgatcggcccacggccttatcaaaaccctaaccctaaccctaaccctaaccctccccacccgcccccccccccaaactcattctcctccctctcccaccgcgagtcggcgaatggcggcggcggcgaccggctatctcgcggccgaggcgaggcggcggcatacctgccctaccgcgggcagcgactggtggcgggggaggcaggcggctagggggagggggcggcgccgccggaggggagggggaaggaaagcggcgccgatggcgggggagacggccggctgggggtaggggggagaggcggnntcngagaaccgacggcggatctgccgcgggagggaggctagagggccgccgcttcccctccccctcccctctggcggcgccgccccctttccccctcctcccaaccggcggcttcccccgtcaccggcgccgcttcccttcccatctccctcctttctcgccggctcggtgcggcaacggcggggttcggcggagacggcgccgtcccaacggcggcgacgacggcgtccgcggcggcctcgctccctctccccctctccttcccgtctcgccgacttggcgcagcgacggcggggtgcggcggaaacggcagcgacgaccgtccctccccctctctctctccccccgtcggcctcgacggtgacggcgccctcccaacggccgcgatggcgtcggcttcatccgcgtgcggatccggcagcggcaatggcgaccgcgggcggatcaggcggcagcggctccctccggcagcggtggtggtatcggcggccgtcgattttttttttttttttttttttgcaattttttccatgactattgctaaccgaatcggattgtgcatggacaaaagatggacgaaaattagatgtgacgatcagcaaaatacgaatatttatattagttatagatatagatatatacgctcaaagaggattatacgtgaattacagttagattagatgagatggtaaaagataagggcccatattttcactttgggcccatcctggcccttcttgacccttcatttctcctacttgcggaataagttcactttgaatcccttaatcagtgactgaagttgatttgtatcccaggaccataataccggatatttcgacgccccccaactatcctaagtggttttggaggacgggttcgctgacgtggcgcctagtggcagtgttgactcgatcttcattccacatggagttgacgcagttttttaattctaatgcactaagcatcacgttgactccacatggaacgaagaccgagtcaacaccactaaatagacgccatatcagtgaaaccgacctccaaaaccatcgagggagtcaaattccaccggtttaatagtttggggggtgggtcgaaatatccggtatcatggttcagggatacgaatcagagagtcataatgaacttattcccctacttgcagttgacgaagtcaccacaggcgtctcgctgtcgagaggtacggcacctaccactgaaagcacaacgccattaaatcctagaaaattcgctcccatggggagttgaacccaggacctcaggtgctactgaggctcttgtaaccactaggctacaaggtttatcatatttgcacaagtaattccttttttttaacacgcaggagatctgcgtatcctttctttaataaggagaaagaaaggtactcgtgagaatgctagagtttaaaacccaatgcaccaccactaaggttttataactcataccaccatgaatttcagaggtacatttatctacaaaataaactaaaagtgttggtttctagggcactttaccgctgaatgatttcctctaataaaatggtatgggtatgtttcataacaatgacaatgaaattgtatttcataaatatctttaaaacaggatcaacaatccaaatatcgacacaatactgaaattcacccaacagatatattctcaactgtaccgaggatatagaacacctattagcaattcaaacttcaaaggataataaacaaacagtacaaacaaataaggagtataaatcaaggcacagaatgaatgtataattggtgagaaacgatagtataaagtgagcaattataacgacaatattttactcctaccattttataatttatacattaacgaataacgggagtgacaagttttggtaatcaacaatatcaaggtgttaaaatggcaagctttggtcatacttttgttggaagatggagaaagcaggtttgagtgtctacagtttttcaaatgtatttgccaaatcaggttatgcagaaactgtaagtttaagaataaaaaaattgaattgggacatgaacgtattagcatgttttttctcccgaagatagctcgtggtacagtcccttttaagaaaagactgattcaagaggataaatatcctgaccgtatgcctcagtggtgactactgttagtgatatgccctagaggcaatcatagagatgattgtatcacatactatgtttacatatttatccgatattgttccttgaaatagataactccttattggttaatgaatatataattttttcatgagactctttatgttgtttgttactatttctaaaggatccctgatcaaatatcatatgtgaaacaaatatgtttatatgatcagcacatgtattaattaatgatcatgtctcatggatcatggtatagagataccaaattaataatgtgtacacatgttagtgaacatgttgttggatagatccaacatgagacactgcaagagccatatgtgttgtgtcatcagtaatctcatttagtgttggtgttgaatccttagacctgagattatcatggttttcaatatatgtagcaacttacttagggactgctaaacgctactccgtaaatgggtagctataaaagtagtattcggatatgctatgaaacatgtagtgggatatgaataatcaagatgggatttgcccctcctatggagagatatctctgggtccctcgatgttgtagattatggaagtgtatggccatgccaaaagtgattgaggagtcaatcacaagatatataatctatcaacagattcgagtgaatgattgagttattagaggatggcacatatctagccttgagcttaatcgatatcgtgaggcaaaggggttcatacaagtatacactagaggttcagccgatatgatctttatgtatgcccggtgggtcaatacattctgctaggggccgctgttgacgcgtggaccgaaaaggagttttcgggttacagccgagtatatatgaacctacaaggtcgcacgcttaatgggccagaataaggggattggatagagatccaatatgagcttaattcggatagggatccgaataggagtcctacgggccttggaggcccgagtaatggattctatatattcgtgagaggcgtgactggcggaggcattgcatcacgtgagaaaccctagccgtcacttccgtcctcgagcaaaaccctagccgcacacgggtgctagcacatctgcgcgtggcgtttcgtccctgtacgtgtggataccggtagagacgccactggtttgcagtgctgatcggcgtgggagtacggcgaggagaacgcacgaggaggagaaggtcgagccggtgcgatcgactacttcctctacatcgatgcgcgctacttcgcgatagttccttcgacttctcagcgtcttcttccgctgtgcagcgcgtcgagtggtaacgatctatgatctaatgcttgcatggttcctggtttacgcgatagaaaattttaatttatgctatcgtagcccacgcgtatcccaacaactacatgggtcatcatgctctgttgctccttggagaaacaatcccagaacatttgctccattggacagtcgaccatgtacaaggttttcagcgagctaagctcctcagcctgctgcaattccgagcagtcctgcgcaagtaagagttgcaacttagaaagattggatatcctcctcaagcttttattgttcttgaccttgagccagacgattccgggatggtagacgatttcctgcaggctgtgcacaccttctataagaacccttcgtaggttaacaattctgtgcagatcttcggggagagctctcagttttgggcaatttatcagctgcaggtacctgatgcatggcataagaaagactgatcgtgagatggtttccgatgtgccatcagacaagctttctgtgctaaccgaccaactctgccagttgtacatgtcaacgatctcaagcagctcaagctttggaaatataatggtatgtgttggagacactacccctttaccaaagagttcatggccaatgctcacaactgcatcagcccctttgacatgaagaacctgcaacattggtagctggcctgcaggcggaagctctggacaagatattcagtggttgaagtgcaaatgagccaggttcggcagtgtgtcctgcggctctgaagataaccattttggaaacgcgtcaccagggaacccatctataaagatgtactgcaattttcgtgatggacagagcttgttgtagatctcctcgatgttcttcacttcactgtcctcgtagctggttcgacaatcagcttcttcacccattgtacaggtaaggccgagctctttgaggtgacgcttgttgcacaacacgggtgaagctggcggtgaggctttctccagcttgatcagcaagaggcgccgtatcttggagagactatctagttcatccaatcggaacccgccagtaccatcttggaaaactgatcgaagattatccatgcatcggaaattaccgatccctttgggaacttggggtcagtgctgtgccacctatattgaggaagcttatcgtggacagcgtcatcagactcgccggcagcgatgccaatttttcgcaaccagacactgagaggtgttcaaggcaggtaaggtttccgatggatcccggaagttgcttgatttcttcattacagctgacatccagcagcctcaacagcaccaggtgcccaactgactctggtatgctctggaggcctgctccaactagaattaagatgcgaagatgctccagcttcctgtaaatgtccctcttgactgatctgcatgcgtcgtggtgatacactaggaggcaccgtaggtttttctggtcttgtataccaggtatttcctcaacggcgttgccaaccgctaaacgccgaacatttggaggggtttcgtcctcatccatgaacacggctacgtctcttgtcaagtattggccaagcaaccttagtagatcatgcatggtagaaattcccttgtctatgtactctggtcttgcctgcagtagatttctcatgattagctcgtggtagtaatcttcagctacctcctgtatcggtctgctgccctctttcttcacaaagccttcagcaatccagaagtaagtgacatctcggtgaatatggaaattttgaggcatcaaggcacaccagaggaaacagctcttaagctgtggggataagtcattgtaacttaaatacaaggggccttgtatttcttctggaagtccttcataacaccatctgctctccaggactctagcccattcttccttcgttgccttcgaggacaggacacctgcaacggccttgatggcaagaggaagcccatcacatttcttgacaatctgtgatccaatatcaccgaatacatttatttcgtcttcggttcggaatgatctgaagaagttccaggccatcatgttccttcagcttgtgcacttcgtgaacatgtatcgcgttcatctgtgacaaaacatcacggctccttgtggtaacaagtacatgggcatccgcacatctctctattggggaccgaagaagatcaatccagatatgtgaacttgtcatattatccaacacaaggaagatactttgtccagtgatacaatttagtagagcttgtagaagttgatccttactcttgccctgataagactgtcctcctgccttttcaatggcctccttcagcaagtcagtctctgagatgctctcagaaattgacagccatataaggacatggtgaaacctctcccttatccttcgatcattgtatatcttctgagctaaagttgtcttgccaattcctcccatccctaggatcccgtaaactgatatggtgctctgatggccacatccaatgatcatttgaaccatatcatcagtagtttccttgatttctcttccgacaacatcaagttcatcaaccaaagcagccacatacctactaacaccgtttctttggagagtttgaggactcctcattgccagtggaacaaacatcttgctgttcattgtgatttgcacaagcctttcatttacatatttgattcttctggcaatcctgtaatcaagtggaagttgtgccagcctagagaacaggacacgatcacaacatcgctgcttgtacgagtgagctctcaaaaaatctacaatgtcgtcaacatcatacataacatccttcacatcactccaccatgttcctgtcactctattttccaaggccaaagcatcggcatcttcacgaacagaatcaaagtacttcagagattcacggagcctcctgatatctcttctcacaaataatgtcttcacaaattcctcccgcagtatcccaaccagcttttctaaacatttggatgacaaacacactaaaattgtccccatcgtctatgcttgtggcctgatctacagaacaaatttagaggtcttataaattgcagataccaatgcaagtcctggaaacacatttagatcgaacgccagtacctgaaaatggagatggctggaggtgttgaagcactttgagtgagcttgcgttgacctgcagcatagagtgttcaggcaggggaggtaaagcgaccctggattgctggaacaaggaaattgttgaggcacatgttgcaacactttctgtatgtctctgtgtgtgtgtgtgtggcaactatgattcctgataaggcctgagaaccctgacaacctggtttgtcacccccttgccaatattatattttgaaacaagacaggctgcagggcacaatgacttaagttcaccaaaacttgttaaagtaaatggagcaagaagcatattagcagagtatgtccacatgcaatgctatcaacaaaaataaataattgtgatatgtgttttaaaactaagtattttttttctatgtccacactaacctaacacgttacttattgcaattgattagttgtcaacaccagtagtaaataatatattcctagttaataaagaaaggctaggagctattgttgatttggacaagtcaccaacatgcagatcatttttctattgttgattattgctagcaacagtacatcattgactttctttgcagatcattttgactgttgcactgttgccgtctggttcctttctctccagaactttggtaattagtacacatggtttctaccactggcaacaaaccatgcaaaaccttatcaaaatgatgttgttactctcgaatatgaatcgttgtgtaatgaacatgtagttaaaatagcttgttaaagctagcaatccaagtatacataatttgttaaagcagcttgcttgcaaagatttattctagcgaaggcattcttaatgtggcagttaactaatctacatttgctatcattgttgtaggtatttgatgtggcatgcttgccgatgtgacagtggcctgatttttcaaatgaggtgcagccaaggctttggtaaagcacaaagtttgtgaggcagactaccaacagaacgatcggtgatgccagaacactcactacatcctgctcattgatgttatcaactgtaatgtgcagttgagcttaccatgagggcctgcaactgaagaaacaaataagaacggtaattgcaatttgaaatttcagatagagactgagcacaatgaaattgaacaagtagtaatagtcgttctatttgaatcaagcaaagcaatgagtagctatagggccttgaacaatgaagcaatcatttcacgatcgattaccttgaagaaacaatttgtcaacctgaaaataaaacctgatatgtacatgacacttaggatgaggttttgaggagaaaaggaatgccgggccctaaagactctacaggatacaaggcttatcagcctgagtgaaggtgatgcaacaccgttttcctaacatatgtggactacttcaacagttgaggttgactctgatggattttgaaatggcgtgcaaaatattagggcaacaccctgaatggttcagtctgaacctacccaagttgcaggactagcaacatctagtgaccgagattgaaaagaagagccaatatataatagcttgctgaagtactatatcatttatttgatcaagtaggcatgaacaattgaacacctcgaagagtgggactgagataaataatgttgcttcatgatcttgtgaagactttcacattatacacacagaccactgagaaatttcagcactacgatatggtaaataaaacagcgaccagacaccagagtatctgtagtgctgggtttagccaatgaacaggaaggtggtattgttgtcacaaatacattgtagtgaggcttacagaaaggtagactcaaactactggtctactgcagacaagaggagcattcacatttatctgtaaaacgttgttttcatgaaagggaagggtagtcattttttaagattctgataataaagcaatacctgcaaaagggtgctcgtattggccacagaaggatcataggcctgctagcttcattttgatggatctgggctaaaagaaatagtatcaacccattgatcaaatcaacacatggagttcagtagagattattctaaaatcaaatgtaaatggtataattgctatacctcaagaacaatccattgatctgttcatttcgaaagcagcaaaccaggaaacaaagagcagaagcagagcaaaagcaaaagaagaaagcatgagtacaagcaaaggaattacatatacaggcaccttatgataaaatcacaactggaagatttaaacagaaagagaaaaaacaatcggtcaaaaaaaatctgcaccagcatatacatccaattcaggtcgagatggcaaactgattaagcataacgcgtgaaacacatgtagcaaaagaaacataagtaatccctcaattcatgatcctcataaattagagctcaaaaataaaaaggcaaatatttcatcattggataattatgagaagaataaagagggaatagagtatggatccaaaacatgacaaaaaaatttgctcggtgaagttatttttatatctacaatgatcaggtacctgcctgttaaacaaagtttgcaagacagtcaatgtatcaaatacacataagaagcttggttaaaaacttctcagggttcctcctaactacagtaaattagcaacatgaattagaagagagcatcaacataatctactgcacaaaaaaaaattgctaatatccggaatttagtgaagatgagcatttaaattgtttccagtgcatagttaatgtaaacaagttaagagataaataacataaatgttctgctatgttttgaaagtaatcacattttacctactactgtaaagaagttgactgatttattacctgggattgctccttcctcttttgattgtagtcacatattctgaagaagtctcctcctggtcagagttcaaggaagcatgagcccctaaattaaacatcggcagcacttaaattttctttgaatttgccatgttatgtctgcaactacgggaaagcttttcacattcggctttgtatttgcaatcgaattacctcgaggcgaagtgcctggcactgggtaacggcggggtgagatcagcgctcaactcgagaggagcgagcagagaggcgcgcatcatccgcggcgaatcagcccttcccctacttgatggttgatgcgcggtgtgggcggcggcggcggcgcctacaacaacaatgccaattaagcttccgccgcgggtctcgcgctcccgaatcccgatccgattcattccccccatttgtttcccagaacgagttgttgaggcaaatgctcgtgatgatcgatcgatcgctcgctcctcgccatccacgatcaatctggcgtctcaatttggggaggggattgatggagctccgccgcgtccagacgcataggggcactcgatccagtgtagaggggatcgacgccgatgagcagcagcagtggcagtgcatggctctgacggggctgcagga

SEQ ID NO: 63613 - DNA, 2946 bp, Oryza sativa
  unsure (1)..(2946): unsure at all n locations
tgatcatcgttatcactggggggatactttgggatttattattcatacatcacatatactcattcaacttttanggataatatgttttatgaacactttcncntccncnccccnccnccggttttgattgcttgtacgctcggttcccacaaagatngaagngtccaacttcaggaaagcacaggtgaggatgctataacaacaatagagcatatcggccaatttattgaacaatgtggtaaggctggtagggatggggggctaaaaatgaaggggggggggctttccttgtcaaaatatgcatttaaatggatttgaacactggcttcttaattaatttgaacattagggcgtgacaaccaacaaaaccatgcacccacagcccaccatgtgatttattttaattgacccacaccgaagcggtggcattaatccaacattaccattagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgtaaaacaatgcagtatttgatggaaaacattagaacatttgcaatataggatcaacatgttcaagtgacaagcatgacttgccttgctctgctgctggaggaacctcggcgactatctcaaagtacaccggaaggtcaggagagccggaatctaagcgacatacaaggcaaacaatacaaacaggctataagactactgaaacaaagaacaaaaccatttttaatggattctacacatttttcttgatttactgagacttgaatggacttaaacggagctcggatgaattagttatgattttaagaagattctctgtgtttttactagaaaagaaaagtccttaatgaattattgcgcaataaagcatcccagggctgacgtcatcacgggaagcgggcggcgccgacatgcgggccccatgggtcagcggctcgggagagagaggaaggggcgccggcacgtgggccccactggcagagacacaaggcgggagggggtgcggctaacaagcaggccccacgggcgcggctccaagggggggcgagacgccggcctggcccggcatcaagccggccggcctgccatggcaagggcggcggcgcgcgcgtcgctggcgacggcaaccggcggcggaagacggcggcgcgaaggcggcggcgcatggcagaagcggcggctcgacccggctcggctaggagggagagggaggggaaaagaggaggagggatgcctcaccgtgagttggccggtgcggggaaggacgacggcgaacggcgatggcgactaccggggaacgacggtgaacggcgatgacctccgagacaccctaagagagggaaattgagagaggggagggagagagggagtccacggcgagcagcaaccgtggccgatggcggcggttatggagagactcactggcgcacgaccgaagcggccttcgatggcggaactcggcggaggaggggtggaccaggtggagctcggcctcgcgaacccgacggcggcgacggctcggtgcggtggctaccctaacggcggctagaggcggccggagcaacgaaaaaggcgacggcgggtgggagcgcggtgtgggagcgatggggagcacgggagaggccggtggaaaaaaggaaaatgtggaggaggacgcggggacgaattatataggggcggagaggtcgggaacagccgggagtggctcgatttcgcacgagttagtgggggaagttggaggtggggagagagagagagagtggcgggattcgaagtcgaatcccgcccatttttggggcgcgcgagggcgggagacccagggaaagccggtgacatgggctcagcgcgcggagtggggcgaaaagggcgcggaagaaccgaagggggtgggcccggcggtttcggcggctgttgccgtcgtggggcgggcggccggaggaaggggatgaccccgacaggtggggcccacctgtcggcgtcctagagagaggagggaggggcgcatgggccggcccaagaaggaaaagggcgcgcgcggcggtggggtggactgggccgacggcccaagaagaggaaaaaggagggaaaagaaaaagaaaaggaagaaagggtttttcctgggattaaaaattgcatgtgctcaattttaattggttaaaattatttctagggctctgaaaattccactaaaaatcttgttagtaaatttcgacatgtagaactcaagaaaaattccacatgccaattccgattattatttgcattggtttattagggtttactcttgcttttacaccgatattttcttgggaccatttataaattcaatttaggtttgggaggagaacttcagggtgtgacaatgcggctctcactcgtcgatgactaaatctcaatcgttgtcagggttacgggtcaggcataccctctacccttcgatatacgttacgtatcaacatggcatacccacgcgtacgcggatatttcctttatgatctaaggaaacctttcacgaaatcaatagacgggaagagtccttctcggataagaactgggttacctacgtattgagctgggtctggtgtgttcgagtcctactcggagaccaccagacctgcgatataaaagggaccccccggggagggcatagaggatcgaatctcagagccaacacaacccacacaggctacgaagccggagcctgcgaggggccacgtcgtcaagagctagtcgaatcaactcgactttaatctcgccggattcgacaagttccatctttcctttgtaacctgtgttttccaccatataatcccatatcaaatggatt

SEQ ID NO: 63614 - DNA, 1337 bp, Oryza sativa
ccccacaacttgcttacctttgccctcatcttcatcttcagatccatcaaaaacttttatgagttcttgaattaaccactgcatgcagtgcttcttcttctccttctccttcatgttcttcttcttgttcacatcatcatctttgactctcccatcatcttccttcttgcctctcccaagcttaggacaatgcgagcgaatatgatcaagtgctctatactcaaaacaatgattcggttctcctgttttcctgttcctaacatttttcatagctcgagaaaatttgttagatagcaaaaccaagtcctcctcctcgaactgttcgagttgatcatcggacatggcattaaataaagcaagaacagaagactttgatgaagaagcaccaagatccaaagaagttgaagacgaaaccaaagcactagacttagaatcacctttacaagaaggaatattcatctcatgagttttcagtttagtgtaaagcgaatccaaagtcaaagtagacatgttaacagactcctgaatagatgtaactttcatctcccaaatagacatgtcaagaccattcaaaaagtgacgagaaatctcagattgtggataattagcatcataagaagaatcaacagatctaagatcactcaaaattttgttaaacctagagagatagtcatctaaagcttctccaggtttcatctcaaatttaatgtactcctttttgaaaagatcacgacgaagttctataatatttgaagttccttgatgaaagtttttcaaagcgttccaaatctcatgagcagtttcaagatgagaaacacgatcataatctgaacgagaaatcccactcaaaagaatattgcgagctttgcaattgtgttcaaattcaagttttaaagcatcaatattaatttgatcaggaatcacataaggatgagaaaattttctccaaatatcataatcctcagccataatgtaagattgcatcctactgcaccaatgagaaaaatctgttccatcgaaaacatgaggcttagttgaaaatctattagtagccatggcaaaaactctagatcggttaaaatccaaagaagaaaacaaggctctgataccacttgtaggatcgaatcacaagaactaagccaaccagaggggggggtgaatggttgatatacccaaaaaccgaaaacttttagcgcaaataaaagttaccctcaaaatcgatgaaatcggtctgaccgaagttgatcggccggtctgaccgcgcctattctgccggtctgaccggtgtagatcgctcggcttgaacgtcccgaagtcgcctctgcctatcgacgccg

SEQ ID NO: 63615 - DNA, 2296 bp, Oryza sativa
gtgacttgatggtgaattctcgaggtctgggatgaagtaaatgactagtatgatgtcatttgtgtggtcagcatttaggcaaggtaatgcgatttggttaaaccatactgtattgtacgcttaattactaaggggaactaaagtcatctattatattattaacacagccttgaaaagaggcaccacattcgttgtgggagctagaaattcccacattaatcggagaaaaagaaaaagaaaaaggaaagaaaaatgagagtccaagtagaagtacaatttaaaaatagttgaaattcggaattaaaaataaacaatattaaaagaagtttccatataagaacccaatacgagattaatcaaaattcgaaataaaaataaaataaaatccaaaattagaaaaggaaaggagagtccaagtagaaatacaatttaaaaatagctgaaattcggaattaaaataaggaatattaaaataagtttcaatataagaacccaatacgagattaataaaaaatcgaaataaaaataaaataaaatccaaaattagaaaaggaaatgagagtccaagtaggaatacaatttaaaaatatctgaaattcggaattaaaaataagaaatattaaaagaataatccatatcagaacccaatacgagattaattaaaattcggaataaaaataaataaatctgaaattagcaaaagaaaataaaagaagagttcaagaaagaatacaatttaaaattagcaaaaattcggaattaaaaataagcaatattgaaagaacaattgtcacgccccgaactagccccgaacagaactagcccgtgacgctccaaattaacctgttaaccgataccagtcccaggaaacagtgctggtatcacaggaagacagattatcacagcaacataggtctctttattacagagtaggagtacagtcatgttgagctgcggacagatctcgagctcacaactgcattacaaaagggaacaacggaagccaagacttggaccaatcatcacaggcacgacttgggaactagaccgaaaccctaaaactcatcatagccgacttgctcctggaagaactcctcatcagcggcatccacttcatcttcttcagcaactgggggggagtattatttatatagagcaagggtgagtacaggagtactcagcaagccatgggaattaagtgtttaatgtaggtttcaaaggaaaggctgttgttttttcaattgattttatttaaacttctttttggaacatctaagtgagtgcttctcaaacgacacggataagacagtgcgtctcgtccggtcggagtatgtgtaatgtatcagtctttgaattgatcaaggttggcacccggccaacagctttcaaatggccacccgggcctagctgatcccatcagccacattttccaaacatcgatcccattccacaacagcaatttcacaaagtagtagtcaaacaaaactacgctaggaatcacctcacatctgcccatgaccgtgggcacggctgttcgaacagtttaataacctctgcagagggggtacactttacccacacgacattactaacccggatcacccagcctgtgcagaacggccacgtctggagaccttgaggctttcatgacaaggcatttcgaaagccgacacaggttcaccatatgccaacgagaggggtcccagaccaacaccaggataggtcccagaccatactgtgtcaggaaacccgggggttctccccggcaccaccccgttgaattcacatgtctcttagcatcatggctcccccgattagctaattactcagccaggggcatcccattacacccatgtggtcgcacttgtcttatgttcggatgaaattccaaggaaacggtccttagtgcaagagcgggaaaccgtactcccggtacgtccctcggtctgcgattttggaaattcatttagttcgcaagcaccgatccaggtgtcgggtttttccaagtcttttgtaaaacctcaagttttacccatcgttggatgttttaaatttgaggggaggtgttccgatgcccgtgcccgaaggcccatgcatcgaaacacaacagtcgacaaaggagttttaggtattcaataattcacggagggtaattgcaacaatttagggtttggggccggcaggctatctcgcaagccgcggccgaattacgtgtgttaaacctattcatgcaatatttgcggaaaagaaatacttaggtttaaattataggtgcgagatgttcaaaggtgacttg

SEQ ID NO: 63616 - DNA, 926 bp, Oryza sativa
gaaggagggatgtatattagacttgggccgagcgaagggaatgggctgagcaagcaagaagcggcccatcggctgggagaggatcattagacttttgctgagagttatttgaaggaatttgagaggcacttgaggtgggatttgaattccaatcgtatatctgaactcaaggatatatggagagtcaaggatgggcagcaatttgcaagttggacttcaaagagggaattagattggatttcgtggatgaagggattcaaggggtaggtaggttggtaggtcaagacttttagagagagagagagagagagagagagagagagagagagagagatgggctggaatagaaggaagaagtggacctaggagagaaaggaagaaggaatccaacattatggggaggtaaaatagactttcacagggatgactggaacgtcggttcaaatcgtttgaggggttattgatcttggaatatttcgaaagaattcggccgaacgatattcgtgagagaaattcggatacgaaggtccaaatttcgagaatggttttcgatgaatcaagggaagggttaggattcacgaggtggatgtttgaactagactggattcaaggattaggcaaaaatatgtggctaggatttcaggaatgaaatccgaatataaggatccgaacttcaacattatttacgagacaaaaacagggattcggactatcgaatttgaggattgcaattgcgggaccttcgcacgaagtaacctagaggtgatttgagtgcagactcaaatcttgagagatcaacggaacggatttattaggaggggaaatatctcagaagaaatttagaaacaggttttgaatacaagggtgagacccttttcaggcaaggacttttagagctagggttttggcatccgagaattgagatg

SEQ ID NO: 63617 - DNA, 647 bp, Oryza sativa
tagtggtaggcccacggcgcccaagactgtcattgcaagatggtctaactactgcgggctgtcggcacgtaagaactttgggatcctccataaagatatcggcacggtcacaaaatcctagaaagagcgagcttggacagctccggagaaatggttcacatttccggctgaagcaaaggataggctcaagtggaaggcattccataagatgggtaaagcttggaagaattagaagtcgaagctcttctccgagtttgtcaacccgcccggcaatcatatgtcgttcgatgaataccctcaaataaccgagtcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagtgatgccatcgtctatcaggaactggtgagttcactacttaacctaactaatttccatt

SEQ ID NO: 63618 - DNA, 6205 bp, Oryza sativa
  unsure (1)..(6205): unsure at all n locations
ccacgctgccgcctctgtcgccacgccaccgtgccaagcgccggcccgatgccgccacaccgccgttaacaaacacgtgaacgagaacgaacacgtcaacgtacgttgccgcgagaacgtgaacgagaacgagaacgatcgaacgaacgagagtgagaacgaacacgtcaacgtacgttgccgcgagaacgtgaacgagaacgagaacgatcgaacgaacgagagcgagaacgagaacgatcgaacgaattaacgtgaacgagaacgacaacgaacgtgaacgagaacgaacgtgaatgagaacaagcgaacgaacgtgaacgagctagggaacgtgaacgagcgaacgaacgtgaacgaacgtgaacgtgaaatgcaatatatatatatatgctacttcgtatttatcctaatacatattttttgtatcttgcagaaaagacgtgctgtcggagtcgtccctcaagccagagtggaagagctagccctagaaggaattcgtgcaggcaagtgacgtaataatataaatgattgttatatttgtaatgcaattaagaatattagacttgtaattagacttagcatataagattgtgtagtgttctatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtcatattatttgagttttaatgtaagattattttatttgtaattagacttactatataattattgactacggaattggtgcgactcctagcaattgacaattttagtcttaattagacttagcatatacgacagttacacctagcatacatgacttagattgttaaaacataaatgtctcgtgacttagcagatgtttcttgtatcaacagatggctgaccgcgatgaggaacaaatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgtgggcaacgaggtgcagcgaagaagcttgagggtcggcacatcataacagaagtggaagaagatggacgtcctagtgccccggccgaagccgccaagaagtatgtacgtcacagcggttgggttgtgcgggataacgtgcctgtcagtacggtgtactggcgaagaacaagggcacgcggagatcatgagacctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactggtacgagttcgttgcatataaaacaggtgaataagggcaggcgatgatggaaagaaacaaagaaaatgccgccaagaagaagtaccatcaccacttggggtcaggaggctatagcgtcgcgatgccgaagtgggaggagatggaggctaggttgattgagaggggtatcgaaccggcaaccgccaattggccggaacgatcgaagttctagtactatgctcatggtggaatgctcaacccagctgatggctcactggtcttcggtgatcagatacgagaggctgcgcgacgactaacagatgcagtggaagcctcctctcagggcacgttccaaccggacagagatagggacgagctgacactcgccctgcagactccagagcatccaagacgaacacgagggaaatgggtgattccttggaagattggtttcaaggaggacatccacacgtacaggagtcggatgaggagcaagagagataccgaggcgaagattgcagatctagagttccgggtatcgagctacgaactcagcatgcaagaggaggtggcaaggaaggttgatgaacgcatggccgcacatcggtcctatgatccccagccgaccattcctcctgcaatggtgagcccgtcaggaaaccgtagcagctgcgcctcaacggggcaggtaggatcacagagcatggacgccatgcaaacacaggacgaatcgacctatcccattgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggtgtcgggcatggccatcccaacggacccttcaggtacataccactgcaggccgattccagcaggatactcgaaggtcaaagttgagttggtcgaaggcgcgtacgaggacctcgagctggattaccctggaggagacggtgagacgcatctacgagacacaagccatgccattattctatggcgcaggcggtacgtcatcctccctgggcgacaagcggcgtcttgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccgttggtgaccggggaagacatgacgatagaagaatttattattaataccggtctaactacggatcaattgctaggagttgaaccaatagaaaaggcagaattgaaatacatgtacgaactcggtaaaccgcttgtcaagcctgagctggtgcagtccctacccacacaaatgtacaagttccatcagctgtacatggagatgagcgccaccggtagagagatgatcggagcgaggatcagggacccggacttcttgcaaggagatgatattctctggatcaatttcaagggaatctacgaagtataccagctggatgccctcgacgtctctattatgagttgctggattttgtaagtatatcgttcagttatatttcttaattactacgtctcctttaattaattaggtccttgtatataagtaaactatataaaataaaatactcctttttatcgttgtagaatggagattcaaagggcccgacgacggagggttttcgatactggattcatcgaccctcggagagtaaacgtcgcaatgctcgaccaatatccacaagaaacagaggaaaatctcgtccatctcctgaaggcgcagcattacaagacgttcatactgttgccgtacaacacagagttagtttaattttactgtcttcctacataccaaattttattcccgtacgaacttgctaagtgtttcatatgtaatgcatcccacgcacattgcagattccactgggtgcttttactcttcgacctgtcggcctgcaccgtcaacgtatatgactcaatggataaaaagagtctacgtttgacaaggttttcgaacttatagacaggtactggcataagttcctctgttaattaagaaattattgttatgttaattatttctactacgaatcatatctttaaactccttgtagggcttggtatcggttccgtcatttggtccgcggcaactggagagaaagacttaggcggaggttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagagtgaattctactacgatggaaacacaattcaccggtccttagcttctgagctagcagtgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatatatatatatatatatatgtatgcatatatatgtattgaaacatatatatgcatggtttatgtatatatataaaccatgcagcaacagggccatgcaaaaaaaaaaggtcagctcaacttttagtcccggttggtgttaccaaccgggtctaaagatcgatctttactcctggttatttcacccgggactaaagatagcgatctttagtcccggattggtactcccggtttggaaaccgggactaaaggggggttacaaaccgggactacaaagagtttctccaccagtgtgtcagcgccatgcatacgtataaaaccactttaaactattttttctcttaaattatttatccaaatcatgatctgattgcaccatttaattcgttgcaattaaatcttgaaaacaagaccacacatggatatattccggcgaaatttttttttagcttattattgaattatttttaaatgttgcacgatgttccaccaagtatatcggaattgtttcactaagtagatcgaaaatgtttcaatcgtttaaattgggcgttgtttcatcttatataaaaacaatgtttcaacaaatagcgaaagaatgtttcagttcactgcaacattagatctatacatagtgaaacattgtgagtacacgaggtgaaacattttgggtggaacaaaaaaatgaaacgaattcccttaatagagggtttccaaaatatgttggtgatttgttgtaaaagaatgtttcgttcactgcaacattagatctatacatagtaaaatattgtgagtatactaggtgaaacatttttggtggaacaaaaaataaaacaaattcccttaacagagggtttccaaaatatgtgggtgatttgttgcaaaagaatatcttaattcactgcaacattagatctatacatagtgaaactttgtgaatacactgagtgaaatatttttttgagacacgtggtgaggctaggggaacgtgcgcatgtggggggtgnagnnccgatcntgctccacccccgtcgatcgcccgggcttgagcattttcctttattatatcataatatgcttggttctaaaagtatattatagtagagatgactagaactcgaaatcatgcgcaaaatttgttggaaagagtccttttttttttttaagtatagcttccaaaattatatttcggacacggtgtgattccataaaggatatgttcatgaatgaatttatggttttttctcattaaacgcgaaccatatagtgcaaaaatgtccatgatacacttgttctggtatttattgcataatgtggctataccttatatattaattaattaattt

SEQ ID NO: 63619 - DNA, 3805 bp, Oryza sativa
tagtactagtactatcatgcatgcatagcatggagcaccccaagaatccacaggtttgtcacgtcccaccaccgtttgttgccatctccttttccttccagctacgccgccgatgcagctagccagctcccaaaccccaaccccatgaggccgacccattgacgaacctcaccggcctgacgcgcgcaggcgcagcctctcgcgctcgctacgctccggccccgcgcggccgcggatgataccaattccccggtgcatgtggcccgccacatggcgaggcaggcgacgagtgacgacacgagccgccgcgcggatcgtccaaccgcgcgctcgtaggacggcaggagtcgcgccgatccacttgtccttgcttccccgcgggagcgccgtgacctttgtcttcgctctcccgcgggggtgttggcctcgtctgtgatcgcaactgctcgcaacgcaaaggagttgagattgtccagaagtgcacgcttctccctcgatcgatcgatcgatacacgtttttgcgaacgtataaggcctcgcgcgggccaacgtgcatggataaaggcacacggcgcggttggtagtattatactatatgctgctgtcgggtgaagtcctccgatctgtataggatctgctacattatcattgttgttcagtatcgtatcgtcaaaatcaacctgcagtatgagtaccaataatgcttcggttggagaatgcaagatgtacttacactacgaggtgtgtcggacatttgtgtcagtcagaacattgagaaaaatacgaaatggagaaagacaggaagagaacaaaaggtacactgcgagaccaccgtggtagtgtactgtaatctgtgtgcgcccctgctataagaaatcggtttgtggataggttaaaatgactagcccatttccgtacagccggagtcttttggcctaagtgtagggtagtatctgtcgggttcatcagccaagtatgatcatgggagaattatgcatgagtaatgatggcggaatcctaatgatggtcagggaacgaaaattgccacttgagttccctttggagcttctgaagttttgtgatgggagtaattttacgttcttaaatctcgaggtatctatctaaaataaatggtatcttaagataattaatacctataactttggatggagattcacaaataaaattaaataatttttatgatcttgttatgccgtgggagtttttattagtttgtgtgtgcttttgtttattcatgtgtgagtttttgttaaattggtgtaataattatcttaaaaaaactaatacttaaatataccaaattttataatagaaagtacgatatcttctaaggatgtgttcggatggccccttttctcaacccatctctctcgtttaccgcgcgcacacttttcaaactactaaatggtgtgtgttttgaaaaaagtttcaatatgaaagttgctaaaaaaaatcaaattaatctttttttaaaaaaatagctaatacttaattaatcacacgctaatagatcgttccgttttctgtgctcactgtgctggatgggaacagaaccagagaacacaccctaaggatggtaaacttatcatttgtgatgattgtatgaacattcctaatgcacgggttctcagggtcaggtgctcacgacctcaggtgtcattgtgtcaacactcaaacagaaagaggaaatgctctagctacacatgtttcacttcatgttgcaagttacttttgtcgtataacaacatgaacagaacacaggttaccagaaaagtcacaaatgtcgagcaaagttggcaagacccagcttgtttgaaacacagaaattatcttgcttttattgggaggaatcgagatgtttcattatatatttgtcttctagagacattccatgttaaatttgtagaggttgtcatgctagcgaaagcagatcaatatcaaccatttcgttcttttttttaaaaaaaaaagccggtgacaggatctctgctagatatattaagaagagttggcctggcctagcttataaggaagatcgggcctaaaaaccacacaaccgaccaattaattaaaggagaactggtaaaacccacacgatgagccaaaaaaagaaaagcttgcagcaacaaaacaactagcacacaacatagcgcaaactacctacaaacaaccctactgaagagcaggaagagaagcccccaacaaggaaacaacatctaggatgttgctaaaactagtttagcacaccggactaggtatttacttacaagaagagatgaccgcttcaacaatgcccctaagggaaaaaaggcgtccattgacattgacatcgctaaagatagataaaaactgaataaggattttgccttaggctctctaaattgccaatcacctccataacaagatgaaggtgttgtgggttattgttacccagctcactacacgacataacagtttcgactctgccgcaacacaaactacacagcaccacggaggcgaacaacaacactactccttcgcccacaccaaacataaatagatggggatcattgttaccgggcttgccacatggacaagtaactctgacctttgcccaccatgcgaatgctcaccaatacgattccataaccaccacctccatgcgcggattttctccaagaaagtgttgttgatgccgaaggtcgctcatcctctgacaagaagacaccaaaatgaccaaactaccacctctcctcctaccatagggctcctcgatcggagtctagaagtagaatgaccttaagagggaaggagctctaaggtgagagaaggagcccagtcgaccaaacggagttccgctcaccgtccttcaaaccaccaccagcgtcgatgctcatagtgacctcggtgacaatccatcaagtggtattgcggcaagaagtacctgcaggctgtggcttctagccaccctacttcggcactctttgaaccaactccagaagctccgatggtctccctatgacaacttgtgcgacaactcttccactccaactccatctcgtgcagcggcgtcagtggcaccctccaactccaccttaacagcaatgctaacgtcgagctcccagtcacctgccagtgaagtgggcaccccattggccacccatgcgcccccaacttaccctgttggtaagtgcactgccctactccgacgccactcctctcgccaccatgttcccaacccctgcgcctctgtcgccaaacttgaatcgctgccaccttcacacctgcatcgccgccgccgccacacccaccatcggggggggggggtcgccactgtcagatccagataatcttttggatctggaataggtccaaccaccatgtttccctccagacgcaggttaatatagggttggatcgtcgtaggtggtgggatggggaggggatcgagagtgggggacaacggcatagagggttgcgtcgccacccaacaaggagcgaccggaggtatgtttttcctaaatcaaccatttagatggctttgtcagggattttcaagattagctcaggtgatttttcagctgcctcacgttgatactcctactccactagaaattcgtcctacctagctacatattcctactacgtactctcttcatactcgtaaaggaagtcgtttaggacaatgtttaagtcaaaccttaggagtataaatcatgaataactcttaagttgttaagtttgaaaatgtaaaaattatatgaatatatttatcttgaaaaatattttcataaaaatatacatg

SEQ ID NO: 63620 - DNA, 1166 bp, Oryza sativa
ctattgtgcttgatgagaaggatcacactattgagattctaaatgctgaaattgatagattaaaatcttcaatttctgatgatgataattgttaatcttgtgaagttttattttctgaaattaatgctttgcgagatgccaattctgttaattgcaaaaaattggaattttagattgaaaaatctaaaacgttggaatcttcttttgcgattggatttgctttacatgctcgtgttgttgatgagttgattttgacaaagaacgttttgaaaaaatacaaagttgctttttgtgcaagttctttggtcaatgcttcatgtgtgaataaagcaaaacaaaacaatggtgttttgatttctcaagattgttcaaagtgtgttttgaatgagatgaagttgaaagatgcttttgggcgtgttatacacatggaagagattgttaatcaagatgaggtgttttcttgctcaacttgtagaaaacaaaaaggtcttttggatgcttgcaaaaattgtgctgttcttacacaagaggtttcttatttgaaaagttctttggaaagattttctgatggtaaaaagaacctcaacatgattcttgatcaatctaaggttagcacacacaatcgtggtttaggttttgatccttatgctcataattctagacatcctcctactgttttgggtgttgctaggagaggtgaaattttgattgaatctgagcctaagaacactgtgcttaaatctgctggcatcatgtcttctttaaatgcatcttcttcgaaatcaaatgttgtgaatccaaaaccttctgttgttgcaaaaccatcaatttcaaaaccatctacttcacaaacttgtcgtgaaaagtacacttgttctttttgtggaaaagatggacatttggttggtttttgttttagacttgcccataaacaaaaaaaggaaagagaaattgcttttgcaaaacaacgttggcaaaaatcgggttttaattcgaggaccatggttagaccgacactaactagtcggtcagaccggttgccaggcccggtcagaccgcaggcacagcagcggtcaaaccggccttagggtgattttgcgcgaaattcaaatcggacttttgtgaagcaaaacggtaaattttctggtaagtctgattctgatttt

SEQ ID NO: 63621 - DNA, 608 bp, Oryza sativa
ctccctccgtttcgaaatgtttaacaccattgactttttatcatatgtttgaccgttcgtcttattcaaaaaatttaagtaattattaatttttttcctatcatttgattcattgttaaatatatttctatgtaggcatataattttacatatctcacaaaagtttttgaataagacgaacggtcaaacatgtgctaaaaagtcaacggtgtcaaacatttcgaaacggagggagtaggaagcaaatatgtaaaataaacatttgagaccaccgattgtttatgcgtgcaagtatgtcagtataatagaataacaaaatagagatattgtttctcatgtcatttgatagtttagtcctctttgaatagtgtaacaatgcccgtgctgacttgccatgctgacgacgacagacggagggagattttctatttgaaaccacacagtgattaccagtatgataaattaacaagcatcggaactcggctagtaggctgccaacatatgcattttatttcaaaccggaaaatgcatttttttttttttggtatggatcagctacaaccacagaacctcaatttcagcctacaaacgggaacagtgcaatatcc

SEQ ID NO: 63622 - DNA, 2297 bp, Oryza sativa
ttcctgcagcccattattaaaacaggcgagaactagtgatgcttgcgatgcatatatctgttagaataataatattccacagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaatgacggttggaggtattaccgactattccaaccgtcatagctgagctataaaaggacttcactctcttcacttcaacacacacctcaagcaagagctctctcattcctctcaagtttagtttagtagtatctagctggtagaatagaattagaataggaatcaggagtccggaagcgttcggaagagttcgggtatggctctagtagctttcctttcctcttttgtaagctttgtacttttattagaatactcttctatatacatttctggtattgaaatactttccgagtatatgagtacctactttacattatgttcatgttatgctgaatatactgctagcttatctgggagatgctttggtgcgggtatagtctttgcttatgcaattactctatgtcatgacgatgatattagagtagtatctgatagtttaggcgtgatgtctagattacgggatatcattatttggggttatatattgcggatgagaggtgggccgctgatggtaacagctcagtacgggtattccttcgcgcctatatataatcctaagttaatttcctggggagggtattcctccgtatttagccccggttgtatggcatgacggactgtcataaggaactcggcattcaggggtggcttctcgaagtatcaggagggcatcggatagagggtattagctagtataccagttaactagatgtatgtatactatgtatattagaagtataggaatagattctctttctcttttctttctacctagcttagattatttattatgaggatgagtagtaatggttgtgtgtcactctacccttggattatcttaacccctacttagaatatgattatcacaagtgatatataaattattagttgagttctctctacatgatcttcccacaggataaaataaatacgatacccttggaatactctcgggtgatatgctacaatagtatatccgtgcgcttgcaaatgaactctgtaaccataatataccagaagtatttatgcgccattgttgggaattatatttctaggaatgtcgttaagaaataccaacaagcgccgaccaccacgccgccagtctcctccaacaagacgcctgcacccaccgctgcgccgaccacccccgccactcggccgtggggcccaacaccccgcgcccgccgttgcacttaccaccaccttacccgctgcagtgccgaccacccccgccacctcggcccccaccacggcgcccaccgcctcagctccggccactgcggcgcctcctctccgccggtcgaggctcctgtcgctggtgccattgtccaccatcttggggatccctgttgcggcgcacggcgagcagccgccgccactggagctcggacagccctcctcgctcgcctgctcgccgtccacccgcctgtccgctccggcgctcaacaggaagaagagagagagaggggagacggaagaagagaggagtgaggatgaggaagaaatgagtgatgaaagggagatggaagggagtgaggggagatggaatggagagggatgaaagggagaggaagaaataagtgatgaaagggagtgaggggagatggaagggagagggatgaaatgagtgaggctgacatgtcgggccacgtgggccccaccattttaaataatttttttgtaactgacatgtgggcccatggtttttattatttttccgcgatagaattgccacataagcgccacgtcaatgccacatggaacgaagacctagtcaaacaagccacgtaggtgttgacggtcattatcgatcagtttcaaccgtcaatattaccaaaatagaggagaactagtgatgcttgcaatgcatatatatcttagaataataaaattccactatattaggtatactaacctcttgcagg

SEQ ID NO: 63623 - DNA, 3712 bp, Oryza sativa
ttttctaaaaacaactaagtgagtgcttctcaaacgaggcgggtgagacagtgcgtctcgtccggtcggagtatgtgcaatgtatcagcctttagaattgaatcaaggttggcaccccggccaatagcttttcaaacggccacccgggccaacaacttttcaaacggccaccggggcctagctgatcccgtcagctgctgatttttcaaacatcgaacccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtgggaatcagccacgtcgggagacctccaagctttcatgacaaggcatttcgaaagccgtcacaggtttaccatatgccgacgagaggggtcccagaccaacaacaggttaggtcccagaccatactgtgccaggaagcccaggggtcctccccgacaccaccccggcgaatccacatgtctcccggcatcaaggctcccctgataagctagttactcagccaggggtgtcccattccacccatgtggtcgtacttgtcttatgtttggatgaaattccaaggaattggtccttaagtgcgagatcgggaaaccgtacacccggtacgttccccagtccgcggttttggaaatttatttagttcgcaaccacgacctaggtgtcgggttttccaagtattttgtaaaacccaagttttacccaagatgtttttcagattttaagtttgaaggcgaccgtcgatactcgtgcagagtgcacgatttccgaggcgcaactgggtggttacaagggaacatggtatgacaattaacagaggaaggatcaaatgcaacaagctaggtaggtccgccaatctgccttgcagacgggacaaacagattaagtgcgatcctatcaatgcataatatttttcaaacagcataattaaatttcaaatataggctcaagatgttcaaaggtggcttgccttgctcgagatttggagcttgatcctcgaaatcctcgcactgcgggtcttcgggctccgaaactacacgcgaaacgggacaactcaacaaacggcgaaaataaagccctatttgtcggtgacatgggaccgggagtatcgtgactagaggcttgggcagccgcgctcacccacgtggcctgaccccctcggggggggggggtcgggcccgagggtgacatggccacccctccctctgtctccccgaggggtcgggccgctcccgtttcggccccgaggtctggggcgccccgaccccctgtggtgttggcgccacgtgtgtgggttaggtgagcacagcggcgctcacctaaccgcatttatgcgggttggacgagcgcgccatgccgcatttaatgcagcgcagcgcgctcgcttatccggtccgtgaccggtcgcagtatgtgaccggtcacagaccggtcagatcgcgggttaggtggcagcaggcggcctgtcacacgcctcgccccgtcccgtcggaatgatgagagcctccaggcactcgtccctagccggagccggcgtgctaactcctggagttagcacgccagtcccggccagatacattccaggcttcatcgcaaccattgcaaggaagtcattgtatgaagaaggacagacgtgcggcatgctaaactgacacgtggtggacaagaatgaccggtctgtgactggtctgacgccggtcacgtcatcggcagacaaaccgtgctctcacgttgcatctgcttccggcgaagtggaggtaggtatgacccatcccatcggagggtcattcggacagcggccattgcaaatctccgcccattaatgaaggaatgacagggtgatcccctgtgtcaggcgagtgacggcgctgggcctcactcaaggacaagctgtgatttagcttccaagcgaaggcgtgagccaagttctggtcaagatagggtgggtccccacccaaaagaagggtaggtagaagtggtgcatgtggtatccccttgagatataaaaggaggaccttgcccaccgaagaggggggatggagatccagaacaagaataggagggacgactctgagaatacctgagctcgtagaggagagaaagaggaagaggggttctagagcctgaactctcttgctctccagctctctgtaactccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagcaccgtcactattaatgacctctaagcgtgccattagatagatctcgagatttgaggaattttggaagttgaacggagtcaaacggatttacggttgggaagatattgaatttctaagattattggatttttggtctaaaggaaaaatgatttaattaaatcctttttgaaaaaaaaaataaaagaaaagaaaagagggaggcaatatagacttttctcgggcgactagggtgcggcccgagagaattggggcggtccggccgagctaaatgggccggccggcccaaggcggcccaaggcgcgcgctcgcatgggagggaggagagagagagccagtggaccgggctcaccgcgcgtggtcccgagtgggacccgcttgtcggcggttcggttcaccgtgcggatcgagcacgcggcgcgcgcgcgcgggcggggctgggacgcggtgcacgcgcgcggttcgcggaggaacggatgcggcgggcccacgcgcagcctcacggctcgcggtggaacgcgcgcacggggaggggctgaccggggtcggctcgacccggtcttggccgagctggcgccgacgtggcgcctacgtggctgccacgcgggccagcgggaggtagacgacgacgccggccggaacggacggcggacgacagcggcgagcggcggagtgaaccacggcgatacaggcgaaagcgagcacaccgggtggttgcacgagacgaggggagacgagccaacggctcggattcgccggaggatgcccgacggcggcgatttgcggcggcggcaaccggcggagggagaagggggaaacggcgacgaggtcacgaggggccgattcccggcggcgagagcatctacgcggctacgggaatccgatgctagcgttggattgggcggagctgcgccgagcgaggccggcgacgagcggcgcttccgagctcgggcggcgacggcggcgagcacacggcgagcggcggcaacggtcggggtggcgccggctagctatggggaggctactcgtgctactacccgagtctaaggggaggagatggagcgaggagggagaacggggagatgcactaccgtgcgggcgggcgcagtgacgagaggccgacggcgcgggagtaatctctccggcctcgggccggggaagaggaaggagagggcgcgcccggagtccccttccgcgtccttgctcgtgccggctcctccgacacgcgcaacaacgaacggcgacggcgaacaga

SEQ ID NO: 63624 - DNA, 704 bp, Oryza sativa
atataatgattagtgtgtgacacactataaaagttaataattaggcttttaggcgtataattagagctgaaaaaagtttttaccccttcccatttcgaatacacaagttcaaagtccttggcccgcgcccctggctacatcgtagaccgtgctgaccatgtttgccaataagaagataacatgcatgtccatgagaaacgaggagatgagatttacgatggagctcgccggagaagggaagctcaagatggtggccaactcatggcatccattcgaggaggcggcggagccgtgggagaagagcaccggtggtcatgcaacacggaaggtcattgtggagatgtgaaagtaatatattagtttgtcctaaaaaaatgatgggaaagattgagaaaattatattttggtctgaatgtataatttttgtcccaaaatggagtaacaaaacgagatcgtcccaaaaatatttttttgtctgttttttttgtacaccctctatcccaaaatataaaggatttgagttagatgtgacacatcttagattcatactatgatgtgttacattgaaccaaaatctcattcatattttggaacggacggagtacttatttgctagatgtgaaatcgatagattgtactgaactatgcctgggaagtttatggctggttggtgcgcggtttatgcctgagatacctagctactt

SEQ ID NO: 63625 - DNA, 1884 bp, Oryza sativa
ttcggcccatcgaccccgggggaggcaaaatagactttgcggaggaatttgatttggaaggatttggattcggaattgaactcgacgatagatcggggatttgagatcttgagatagcacgggcactagacaacaagcaaagaaacaaatttcgcaattagggtttttaagagataattttcccgctaggcgccacgacggaacgggcgctacaatgtatcacttttcaataaatatttttatagaaacaatcaatcaaagttgtgttttgaagaccgtgtcgttatcctaaatgacttcctttatgagtacggagggattattctgtacttacccacgctaccactgcatgtacagtactgtacctgatgaaaatcagagagaaaatagcgcagatgaattactggttgttggtcaaatcatgaaaagacggtgatgaccgcgtcgttatgcctagcataaaacctgggtcgcaaaaccaaataataaatcatgaagaacaagttaatgcagggtcgaactaccgaatcaaattcaatcaaaacaatactgaccgaattaatgaccagcatcgcgccatcgcctccttggctcctcgctgaacgaagccttgaccgttaaggttttttcacctaaaaaaaaaaaaaccctctcctgctgtcatgcatggctgcatatatacaggctcgctgctcttcagctaaacactcccgcgcgcgcagccaaagattcagaaccggcaaaacctgtagcagtagcactgtgcaagtcttccacaacacaaagcctgttccatttctaaccatgaagcttacattacttggcaactgtatccatcaccctgttcttcttctagtgatcctcgcctgcgccggcattgcaccggcgagcggcgccggcgggaggtgggacgtcctccagcgcagcatcggcgtgtcggcgatgcacatgcagctgctgcacaacgaccgcgtgatcatcttcgaccgcaccgacttcggcctgtccaacctctccctccccgacggccggggccgccgcaacccgcgggagcgcgtggtccccatggactgcaccgcgcactccgccgagtacgacgtcgcgttgaacacgttccgcccgctcttcgtcttcaccgacacgtggtgctcgtcggcaccgtcgcgcccgacggcaccctcgtccagaccggcgggtggaacgacggctaccgcaacgtgcgcacgatggccgcgtgcgaggcgggcgacgacacctgcgactgggacgagacgcaggacgcgctcgccgcgaacaggtggtacgccaccaaccagatcctccccgacggccgcgccttcatcgtcggcggccggaggcagttcacctacgagttctacccaacggccgattcttccggtggctctgctatctcactgccattcttggttcagactaaggatcccgaggagaacaacctgtatccctttgtccacctcaacatagatggcaacctgttcatctttgccaagaatcgcgccattcttttcgactacaagaagaacaaggtcgtcaggacgtaccctgagttggctggcggcgacccgaggaactatcccagctcgggctcgtcggttttactccccttgaagccgtccccaacagaggccgaggtgctggtgtgcggcggcgctcccgccggctcctacacctcaaccaaggacggcaccttctcctcggcgctcgtgacgtgcgggcggatcaagatcaccgacacggcgccggcgtgggtcatcgagacaatgccgtcgccgagggtgatgggggacatgatcttgctgccgaacggcgcggaggtggtgatcatcaacggcgccatggacggcaccgccggctgggagtccg

SEQ ID NO: 63626 - DNA, 2486 bp, Oryza sativa
acgggtatatgggcccatcaggactatgatttcatgatgtgcgctcacaaccgggagtatgaggcctgtaccctatgcgtataccattattgaagttaaggttcttagtactaatgctacataaccactgcgcaggcgacattggattctcctagtcattgtacctaagtggagtagggttacctaccttaactccaataagtccaaagattatgatttcactgaaatcaccaagggcttaaatatggcttggggcccatatgtggaaaagggtggtaggcacaaggagggcaaggacgaactttaccatgacaccaagttcgcatgcgcacaacagatcggagaccaatgtggttttcacgtgtgccacagcatgtcaacacttctaagagaggtgaaagattttgaccctgaggttgttgctaatggcgaataagctcatttcaataccaacattgctattcaaaacgtgctaacatcttgtttattaaacagaaaggtagagctggcctcaagatctcatccatcaaccccccgctatcagaggcgaagtgtgcaccttcattctggcaataataatgaacaagaaaggacgttttcacgtcaaatagactcatgaacttggctagataatttattgtgatgtaaaaaagatgttttcataatttcttgtgatgtaaaaaaatttgtttttatggagtgcaatgtaatttactttcatatgtgcaatatttatggtagtttactaaagtgtcatcaaatttgatcaactgctatttatgttgtactattcatctattttctcctttttttttccttattgacaggttgtggaggttcacaacgaacagaatacaagaaattttggtaatcatttgaggactttcatggggtatgaattgtttcatagggtatgaattgtgtgctataataaattaaattgttgcatatgtgatgttgcaaattgttgctttgtgatggatctgtgatatgtgatgcatctgttatgttgggcagttggggaatatatgatatggagggggaggggtgactggcacctgtgatgtttctgtttttcagagggcatggctagcaattcctgaggctagccaatatttagcatttatttttttttctgtcagtgatggtttggaagaaaaatccatcacaggtaacctcacctgtgatggactcgcaaacgtcggaccgtcacaggtgacccacctgtgacgggcctttattttcgggcccgtcacaggtgggtcaccctgtgatggctactatataccggagatcatcacctctgacgggcctttatttaggggcccgtcagagatgagacacctgtgatgagtcctaacttgccctaggctagctgagaccaacacctctgacggccttctattaacttgcccgtcagaggtggatgtcaccactgacggccggccacccgtcaaaggtgactggactcaccagtgaccactgatcactgaccaagcccaaagccgtcaaaggtgagggtttgggcccgtaacaggtgaccttgaccagtgtagtgatattataagagcattcctcatattcatacagatgttaatgaatctagactttctagcgacatgtgtttagattcattaacatctatatgtatgtgggcaatgctaaagtcttataatatgattcgaacgaagtacgcacgtggtaaaaaaggtaaatccacattttactgagattctaatcaaaacagtttttgctagttgctctacatttagttcggcgtagattttgctccttaattccaaactaagcaccttaaagtcaacgcactatttatacaattgtctatgagtaagactacagactataacataagaaaacacaatgttcaaaacataatttatttacataatatgataatccagcctacctcctattttcagtaggttaagctattcgtgtcggtatgtagtacacgtaatctttacatcagcccctgagaccattatagtcgaaaaaataatcttcttccgaacgcttcacaaaaagccgagtgctccaggccgagtttagttccaaactttttcttcaaacttccaacttttccatcacatcaaaactttcctatgcatataaacttccaacttttccatcacatcattccaatttcaatcacacttccaattttgacgtgaactaaacacaccctcaatatatatgacatagtctcccgagtgcttttatcgactagatgcacctaattgggtgtagcccctaactatgtggttagttaaaaaaactaaacatataatcaaagagtaaataattcaaccaaccgagtggatttaatgacatataatcaagagataataaaaaaaataccattgacaatcgtccaagtcccagaaataccatcgacaaatgtgagttccaagaaatgccagacaagtgtgagttccaacaaatgccagacaagtgtgagttccaag

SEQ ID NO: 63627 - DNA, 10049 bp, Oryza sativa
  unsure (1)..(10049): unsure at all n locations
aatcacgccgcctgatgcgccgccgaatgagggaggagagctagggtttgccactgtgaaccggtgagaagagaggagaaaaaagggagataaggatgggaggaggtgagggcacgcgacctcttcacatgcgcgagtcgcgcgcggtcctgggccgccccgtccggccgaatcggccggatgcacagagccggcatctggagggaatattccctaggtggtggccatatcccagtaccgcccatcatccaaacacctccaaaatttgggcggccatatcctatcccagcctatccctccatccaaacacatcctaagtgttgtctctgctagtttactggctgaagagagtaccaactaacacaagaacagatctaagcatggcacaaaacttcttcactttcaatcagaagttcagagaaaggcagtctcaccgtatcatgtcagagaaaacttcagcagattcccaagtgcatgtccctgaacttccgcttgattcttcctggacctacgctttcctgggattgaaaaatggcatggacatctcatgatcaataatatacacaatttaaatcagaatcatgtacatctcatagtcaacaatattcatcacaatctaaatcagaatagtttgcgctctcatcgatcaaaggttgccactttaattgccttataataatttaacaatgttgttttcttctacatagcaaatcaataaatcaaaacgatggaacatgaggctcaattcttgtaaatccctatcatctcatactgatattcttgtttaacttcattagaatgatagattacatatttacagtgattaagcatagcattatagaataaaagcaataggacaagagtgcaagaccatgactaattcagacattcagtgactataaactatcgattcaccggttgcttagttgttcttctagctgctgttgctcgccgcctaatctgctagctgctcggctgtcagcgtcggcagtctcgttgcccagtcgcctggtaccttgcgcccttgcctgctctgcctccatatgctgctcgccggctcgccaccgcggcgcccggctgctgttccatgactgcgcccgcctccgcttattcgctatcgccggctcgccgaagcacctcgttgctggcttgctgcttcacccaaccgcccagccacccagccgcgagtccccaaccctaatctatagagagagatgcgtgcgtgaggtcgcggccgcaccaggatcgcacgacgatgacgccctggatggatgagtgggggcaacgtctttcggcgaggcaccgcagtggcgatggggaggagagcacggaggaggcgcgttggatgccgggagtggcggagggagcggcggagagagggatcgagccatcgagggcgagagatcgcggtggttgtgaggaacgaggagaggtcgacgactcggggggtggggaggggatgcatgtgtctgcgcctacagcacccattttgaagcgttggatatctggatccaatgggtacaatggcgcgtggctgtcaccactacaaaattttaaagtagtagagattaccggcaaggatcggtatcgctacttgagtttgcgagaccactcgctctcacgaactgcggtctcgtgtttttattgtgcaagatcgtaatatcaacggtatatctgtgcaaataaaattacaacccgaatatttatgagagaaaaaaataaacggtatatttttaatttttttcctttttttctgtatgcttgtagttgtagctagcaaccctcttggtagtacagatggtttacaaaaccaaacgggtttttttagaaaaccgggagctccattagttggtctaataagccaatgcaaaagttaaaatttaaagttttaaacttgattttgaagttgattttaagatatttttaactaattttcttagctttggattttgaattgcttcgaaaagtatataaaagttttaccaataaattaatttttattccctaataagctaaaaatatgggcaaccgatgaggctcgggacttcctgggtcggctagctctgaaccacaatccgcttggttttccagttaagttcaaaaggaaattcaaactggataattgttgataaagtttcctttatccttgtttgatgaaaacaaaacaacgaacacacagaaaatagggaaaccctgtattttattaatcatgattcattaacatgaatgtttacaaatatatgagggctcccgcaggagttcgccttttgccttcgtgaggaatgcttaatagaaaggtatgctgactggaaattgcgtgtagtccgctgattcccggtgcatagcaatgaggctaccggttaattacatccataggatgagcctatggaatacctccgattaagctgcgctttgtgatcactgtcttcaaaattaattgctcgccgaaggttgaggttggtgcagatttaacggtgaatatagtgaatgtggaacgggtggctttgtttcgccaaaacccggtcacactacactaccctcacatcggtgtgcggagggaatttggtgaagcgggtgactttttcctcgtcggtgcccagtcatgtatcctggcctttatcaaacatagattttacggttgcttttgcctcatcggtgcccagcaatggtgtatctagctcccgtccgttttagacgtgttaatagtatagtgacctggccttgtcggcgctcggccatggttttgtctagccttatccatcagacaaatgaaatgagtgaatggctatagctttgttagctttggccaatatgtcgtccggcttcatcggtctcggacgtagcacaaatattgataaattggccatttcatctcatcgacactcggccacgatgtcgacgtttattttaaatctgcacacctcgccctcatggctagcgttgttttatttagcgaataatgcttgtcttcaggaattgtgagaaattgctcccgtccatccggtagaatttggagagagaaggaattgctcccatacatgacatgcacgaggcaatatgtgactcatccggcatgaatataaatatgtataaatcatggttagtctgatgccaataagactcaaactcatcccaagtttatataaataaatatccacatccaatatttgatattgataatttagacggtccaaccctcacgagggtcaggctcgccttgtatttatttgcagcctatattaatggcttgacaaagatggcgtgtacatgtgtatgcgtcactggggatacttatatatccatggctacaagttcacaacacatccacgatatattcatcactactccactttactgttttaccgtccgggctgcgcaactgcacaacgctacggtgtatatttcctccctctaggagataatgccgggctatgcataatatctgcacagcactacggtgttgttgtgttatcttggataagcggcttgacggagaacgagatcagcttgtttctgaagactcgccgatagagatgccatcagtgccggcgattacaggttgctgatccgcgatcacgcaccctgtgccatgcgcatgcatcttctttctgatctctctgcgaatatatgtgggtgcgggtgtgtacctctagggcatattgctgcttaatggcgcagcgcttgcgccgtgtgttccctcttcttcctccgtcgcggggacggagtcggtgccttttataggcagaggcggcggcaacgatctgcctgatctgttccgaatttccagcataagccaacaatatcacacgttaattctcctgacaagccgacgcacagatgagctaatccatccacgagataaaaaccaaacacacgtactggagtctggagataatcatgcgattaacatggctgatgacggtgggccccatgtgtttaatcgccactgccaatttccaaattagagataatgaccgtgcatgctcacgtagcaaagcaagtaacgatagcacttgcttatttcttttcttttaatagctccaatcttttgaatcgtacatcggatttaaaatccatttgaaccattactttctattcaaattatacaacaaaacgagtccaatatcgaatatattcggacatcgtgatatttgaaatctctaggcccacatgacatagagacacgcctcgtgtatattgggttgcaaataatattttcatacaaaattaaacgcccaataaatttttttatcttctatgaatttttagcacaaaaattcatcaaacaatccttaaaaataataccatggtggcagtgagaaaacaatctatatagtaaaaatatagaaattgttctaccaggtggataacaaattttctttaaggacttcaaaatgttgaagtgattgttcctctataattcttaaacataccttcaaatttttaaccgatataagagtctagcgtcaggggattactacttctcatgtgaatggggcaatgaactcctcgcttgtactgccttctaattgtacatgatataacatatccttaaaaatatgaatttagacaatatatgaatttagacaataaaaaaggatgcgtcacattatattaaattaacttattatgagacagaaggagtatagttgtgacggagctcgtggctcctcaccgggagaccgcgcaggcccccctttgccagttcggccgggggcttagggtgaaatctcaagctctctctctctctgtatgtggaaagatcgtctgccagcaagaaacacgagacaccggcgatctatacaggttcgggccgctgagaagcgtaataccctactcctgtgttttggtggatctgtgtatgaatgagctacaagtgtgagctgacttctcccccgttctaagctctcgatctggaaaagaatcaaccaaccccttctctctgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagactggtcacaaatcggtcattcttgtccaccgcgtgtaatcttggcaacgtgcatgtttgcccttcttcacacaacatcttgcctgtaatggttaggatgaagcctggcatatatcgaccggggctaacgtgtcatctctaagagataacacgcttaactccggcttgagacgagtgcatagaggctttcgtcttgacgggatggggcaaggcgtgcgtcagaccgccagtcgccacctaacccgtgatctgaccggtctgtgactgatcacagaccggataaaggaacgcgctgtactgcgctgcatgcagcgtgacgcgcttgaccagactgcaataaatgctgttaggtgagcacagctgtgctcacttatcccatatatgtggcgcagatttccttaaggggtcggggtgcctcggccctcggggccggggcaagcgcaacccgaccccccccctcgggggaaatcaggaggagggcggacacctcatcctcgggcccgacgtccccgaaggtgccaggccacgtgggcgattgcgtctgcctcaagcctctggtcatgatactcccggtcccatatcaccgacagtagcccccggcgttgtgccagagcaatttcccttcccaagggaagcggtctggcgtaacgccacccctaaagcctggtgacaggtgggaccggtctccatagttgggcaaaatccccaacggtcccaatccatgcacattggtattggtaactttggttgtccataatgggcggtctattcaagactgccacatcacttgagcagcgcgcgctggattcttccatcggggaggccgaggccctccgcttggcgggcgagatggggcccgacatgctttgggactcggtctcccgcatggatcgcgccggtcggcaagcgggcctttggaaaggccagacgaggacgcgccctagcaatctggaaggcctcgctccgcacctcaacaggatggcctgggttctcgaacgactccccgaggagcttgagaagaccattaagtcatcctcgagggacctcgcccggggggcggtcgaactcgtgctggcgagttaccaggcccgggaccccaacttctctccatggatggcgctggaggagttccctcccgggaccgaggacaacgcgcgcgcgcgggtcgggaatgctgccgaccacatcgtcaacagcttcgagggctcggcccctcggctcgcgttcgcccccagctccgacgaggagggcgacgccagcggcgaggacgacggtggcgacgaggccagcgacccgggtgcatttgaatgagcccccaggcccccgccaatcttaacttttttttttttttctttcttctaaggccttcatgcctcttttgtgtatagatcaacttaatctgcaatcaaaaatgatgaaaaattttctatgttaactttattttgctatgcatgtgagttgaggatgatctgtgccgtggtccttttgcgccttagcttgaaataagggctcgtgcccaagtcccggtcctcgaatggctcgggtcggggctagtgcctggggagatccgcatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaaccgagcccccgagggcaaggttgagcacgagtgaccttatttcaagttaagattcttcagaaggaaaaacggcacagacacaacctttaggaaattgaaacttcttttattgaaatgctgaaataaaggaaaaaggaatataaggaatatatgtgcatgtgtggtagcccccggccaaccctgcacaccaaaggggggtgcggggttggccccgagccaaaacctgacacccgaccccccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcagagggccgcgcgccgccttcgctcttctaagtagtcgaggtcatctctgcgaagctgatcttggtcagcctcgcagtacatggtggcccgaggagacctcagggtgagctcggatgggagaaccgcttctgcgccgtagacgaggaagaaaggcgtttccccggtcgctcggcttggagtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaacgcgctggacgcgttcactcccttcgcggtcctcaggtagagtcttatctgtgaggtatgtttggatctcagagatccaagcgatcaatctaagggagcttggagcactcccttcgggtcccgaggcctggactccgacgggcctcgggtgccggtctggcgcatccgtctcccctaaggggtcgggtcgcgctgacggctgggtaagcctttcttcaaaggcgcctggtggggtctgggctcgcgaggacgcgagccgtgagagttcgtcggctatcatgttatcccgtctgggcacatgccgaagctctattccatcgaaatggcgctccatacgccgcacttggcgtacataggcgtccatctgtgggtcagagcaccggtactccttacagacctggttaacgactagctgggagtcgcctaacaccaagaggcgcgggatccccagtccagctgccactctgagtccggcaaggagtccctcgtactctgccatattattagtcgctcgaaagtcgagacggaccaagtatttgagacgttctccagtcgggagggtcaacgtgacncctgctcnggcaccctgaagggacagaganccatcaaactgcatcaccagtggggtggtgtgagncagcttaagaggggttcgtgctggcctcggggattgagacggtctctggagccggggtccactctgccacaaaatcggcgagggcctggctcttgatagcgtggcgtggttcaaagtgcagatcgaactcagaaagctcaattgcccattttaccactcgtcctgtaccctctcgattatgcaagatttgcccgagggggtaagacgtaaccacagtgacccgatgcgcctggaaataatggcgcagtttcctcgaggccatcagaatagcataaagcatcttctgggcctgagggtatcgggtcttggcgtcccggagggcctcactaacaaagtaaacaggccgctgcacctttcggcggggccgatcttcttcgctaggggccgtatccccgaggtgctcttcgtccaagtggcctctcggggcacacttgtcttctgcgctgatgaccttggggtccgaagatgacaggtgcggccttcccacagtggcctcggggccgtcctgggagtcgggggctcctggcatcgttagatacgcgggcaaagggccagctccggtcgtcaggggcctcaggcctccgttcggctcgggggcctcttctccctgctctctcccgggtcgaatcagcacagggttagcctcggggtcaaagggtggtagatgcggccttcccgcagtggcctcggggccctcctgagggtcgggggcacccagcaccgtctgacaagcgggcagagggccgtctccggtcgtcaggggccttaggccaccgtttgactcgggggcctctcctccctgcttgctcccgggccaagttagcacagaatgggggtgcacgaaatgaggattgtcttcatcgcgctccacaaccaatgctgcactaactacttggggggtcgctgctaagtaaagtagcaggggctcatttggctctggggcgactataaccgggggagagttgagatatgccttcaactgggcaagggcattttcagcttcctccgtccaagtaaacggccccgagcgcttgaggagcttaaacaagggtagcgccttctctcccagccttgatatgaaacgacttagggcggccatgcagccggtgacgcattgcacatccctaagtt

SEQ ID NO: 63628 - DNA, 5197 bp, Oryza sativa
ggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagatcttggagaacctgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtaaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaatacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacaactccaattccaatgagtgcactaacacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcagtatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatattcatgtctataaacagtgagcttgctatgcttatggatgattcatattgagaatacaatgtaccgatgttaagcaccgtccctttttgtttaaggtagtgcctcgtattcatgtaatgagggagaaatgtgtaatacagacaagttccatgaggattcgtttgaaagatgcggatatgtgatcatgtgtataattgtttactgacaaaggagacctagggtctcgtgttagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggaaattaaaccctagtggtatagatacagatagcaggcaatgtatttccctgaaggtagtcagtgcagcttttgacgcaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaatagaaacatgctctgcatcgctcaaggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccatgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagataatctacagaggtcagattaaaagcacatctaacaacgaagcctcagattcgacagggtaatgattagacaataacaaatccagcaataaagccattgaagaagacgtcaaagtatgtcaagtgggatgaattggttctcttgggaagcataacttatagttagagtggttgacccttgcatcaaatagcagaagtagctatcacccggagaccagggaagctaatatgaggcagttggtggcgagttagaagcaaataacaagcatggtatcctagtaatgacaagcaggttacgacgcatgacatgaagttgataacttgtccgaggttgactccgaagatatgaatcatgagaagttctggaacggaagcatcacagaactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagcccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcttctttcccccccttcccttcttgggccggctcggcccaactcttcctccctctctctcctctcccccgcggcccatcggccttccccgcgcgcgcgccgctgacaggcgggcccggccgcctgcctcgctgacgggtggggcccacctgtcat

SEQ ID NO: 63629 - DNA, 11909 bp, Oryza sativa
  unsure (1)..(11909): unsure at all n locations
tgagtgcacatcatgtgcattttataaaactaatgagactaaataattagtgcagaaaattttgacataaattttgaaaataaaataaatgtaaaaattaaaatttttatttgaaattttaataggacaatggattttttatcaggagcattcataaaaaaaatgttgtgaacattggtatacctatctttatatgaatgctcctcatttttatgaccttttttaaaaaaaataaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacagtcaactgacgggaggggtatgcaagggatcaaaatcaaattttggggtatacaaggaagtaagcaaaattcaggggtatagaagggattaggaaaattttcaggggtatataagggattttctcttgaaacaattggcatagtgagaattgcactccatcatgtatatgcattgctcaagtatcaccctccggatcccagggcaatgagaacttaggctcatgtttgcattcagtgcatccactagcctcttaatgaatctccgcttgatctacccgtgctctagctcttgggaaaattcttcaggaatgagtttgcatatctatgaaaggccattgaggatttctagttctgccccttcagcatccattattctttccaacacctgtagtggaaccagcaatgtcatgtagcatgataaatatagttgtacaaactatagttatataattcattggtaaataaatgtgccttctttttaccaaaaatgacaaaaaataatagacagtgaatgcacaaatgatacggcatactatacacctctatattgcacttgtagtatgtattagcagggcttacctctcgcaaggtgtgagatagttcctttaggtctgattctgtcagctcatgttgaacgtgcaggcacatattatgcaacagactcgctgccacatatatgtatttatcatcatggattagaatcataatgaagcagttatgcgggttttctgatgacagcattaccagtgcttgcccgtcgacctttggcagcaagcaatcaacatctgaactaaaatgatccatgagaatcgaggaatgccttcatcagcctggtaatgagcattttcatttgtccaatctcctgccttgtgtctctgtcaattgcaaggtttctgaggatttctgccacgagcctccttagttctttttgggaatacgcaagaagcgcatctttgtattaagagaaataaagtttatttacagagatttgaaaatgaaaataaagaaggggatagggtaccggatggacaacaaaatgtaaggcctaatctcgtacaaaattttgcgaccgccactccgtggtcagtagaggtaactccagcattgccgcgttcgctaagcgccaaagcacggcctcagccgccatcactttgccacttcgacccaggtcttttgctgttggttgaagaccctgttgttccactccttccagatagtccaagctatcaaggctgcaacggtgtcgaatcctcgtcgctgagctttggcaaccttcattctcttgtcacaaagccatgagaggaaggagggttcattgaatggcagtatgtccgacaaaccaattgctcggagtgcgaaccagcacagttgacgtgactccgggcatgcgactaggagatgatcaatcgtctcgtcatcttgatcgcataggacgcaccgatcaggatgtggtaaaccctgtctccgcaaacgatcggccgtccaacatctgtttagtgccactaaccacaggaaatagcagcatcggggcggtgctaacgacccccagataggcttgtcctggaattggaccctccccacaaacatggactgataagctgagtgagctgagtattctcctgatgactcccatctccagatgattgaatctggctcttccgtgagggcatccaaggattgcaaagatgtccacaagctgaggtactctaggattgcttggatttcgaaagccccagatatatcccggatccatgttctaccttggagtgctttgcgaaccgtcctgcgattccgggttcttgctgcaaccgcggcatgcacagccggcgcaagggtgcggatcgacgacccctggatctagttgtcttcccagaagagcacgttcattccattgccgactcgacatgtcaaagagacttggagtaggttcctctccttttgcgagatcggaacattgagtccatgccatggcttttctggcgatgtcctcagttgccaagcccagcggcaccagagcgcaagtcccatgcgctcaagatcagggacacccaatccaccatacgatttgggtgcgcaaacacgtgcccaagcgacccggcaacttccaccgctagcacttgctttcccggcctagaggaagccgcgacggaccttatcgattccctttatcacccactttggcacattgatggccatcagcaaatagatcggtatagagctcaataccgcatttaccatagtgacccgaccaatgagcgccatctgctctgccttccataccggcaaccgacgggctatcttgtccacaaacggctacaggtcttctttgcgaagacggaagatggaaacgggcagccctaaataagtgcaagggaatgttgcgacctgacatggtagttcgtcctggatcagtgcaatgttgttgtcgttgcactgaattgggagagctgcacacttagcgaaattcatcccaagccctgtggcttccccaaagatgtgtagaatttcctttgctgtgctgatttcctcaggatccgaccgaatgaaaacgaccgtgtcgtccgcgtagagggaagttcggtagggcaggtgcagcggctgtaacagcccttcattctctgctttagagaaaagagagcttaatgagtccatagcgaggatgaacagcatgggagagattggatccccttggcacacccctcgccggtgcaagatagggttccccggtatgccattgatcaggacccgcgtacttgctattaggaaaagcatggcaatccaagcacaccaacggctaccgaaccctttgtgctccagaacctctaaaatgaattgccaggaggtggaatcgaatgcctgcgcaatgtcgagcttcaaaagcaaggaggattgcttccgctcatgcaaccgcttcgccgactgccgcactagcatgaagttgtcctgaatacatctcttcttgatgaacgcactttgattattggcaacctgagaatctagcttgggagctaggtggcgtgagaggatcttcgtgaaaagcttaacgaagctgtgaaccaagctaattgggcgaaaatcccgcaagttcctggcatctgggcgctttggcagtagcataatgaatgccttgttcaccttctccaaactcgaaccatccatacgatggagctgttggagagcagctagaacatccactttgatgatgtcccagcagcaatggtagaactgcccggtgaacccgtctggtcccggcgctttgtcgcaaggaatttccttgaccgcttgccacaccttttcgtcagtgaaagggtcctccaaatcggataacggctgccccggctgctcaaggaagctcaattcgagcgagaactcacgcggactgactgagctaagaacttcggagaagaaggactgtgcaagttacgccttctcttccggggcagttgcgacctctgagtcgaattccaattgctgaacaaagtttcaccgacgacgccaagctgcttgctgatgaaagaacttcgtgttcgcatctccttcttgcaaccaagtgatgcacgatctgtgcctagccattgtccgttctaaggaagagtacgccaaatacctcttctttagtcctcggtgcaggaatctttcttgtgccgagagaccgcgcacttcctccgctcgatcaagtttcccaatgagttctctaatcatttctagctgtagcttaacattccccaccttccgatcactccagctttttagggcacaaccaaccgacttgagcttggagtcaagcctggaaatgggatcgatgatggtacacgattccgaccaagattgctgcaccacatcagagaatccattcaatttgcaccaaaaattttcgaagtgaaatctccccttcgacggatgggccggcaaggttgaaaggagtagagggcaatgatccgagatcaaggaaggcagagccttgaggaagcattgagggaagagtttttcccagtcggcttcaagtcactccagggttgggttctcccacccattcgaccaggtaaaagcacgtccattcaggtggagcttgtggagagctagatcgttgatagtccgacggaaacgactcatcatccgatggttgaggttggcgttgtttttgtccctatcttggtagattagattaaaatcgccaacaactacccatggcccattacgcatacttctgatatcgcacagctcctgaaggaatagcaccttgtccgcatcggactggggaccgtagacgaccgtaatccaacaggaggacccattgtaaaaggatcctccttagttctttgattgctgctgctatctcccaagatctctgcaaggtttctcaataagaaggaatgttttgatatcttgtacctcagtgttatgccaatttccccttcaatgcttgtgagcctctgcagcaccttcaacgatgacattaacagaaccttctgttgtgcttcggaatttaccattgcacttttgaagcttgtgaatccaatgattttggggatcaggtcagttactctgtctatttccacgcagttattttgatcacaaccagcaaggctataaatgattgacatgcctagtgcagggaggagatcattgtctgtcaatggctgctcctttggaatcgaccagtacgccggtatcctctaccaaattctaggtatgtatctttggtcgttgatgtgcattgatcgggttggtgtttccagcaggttattgatgtttctctaaaaaagggttaaataattatatttatcttgaactatatatttttaaagaagccagtgtatttcttaactactttaaaagacaatcattttccttttttcgtcaaaaaccgctccctctcataaaaaaacatcatagaaaaccactcttccttgagaaaacagtccttaaaaaaatctcatgatcccaatataaaatacgtaagtagttttatataaaaatgatcaagtatgtccgtttgaaatgttggagtcttcatccgttactttgcattcccaaatttcaaccggcccaaatatggagtatatttcttttctacggaaaaaaaaaccgatttagcccatctatatctattatccatcacaaaaactacctaacggcatcatgtggtggtgcgacggtcacgggacaaacttaatgtgcccgaaccgttaccatctcacccccatcagctctctcatgaaagtatatagacccatgcgcgtcttttacatatgcgtcagtagggccaggtgataggttgatagctggtgactatgtgcatgcgtgcataatggttggcccaaggagcagttaactcctcttgcctactgtcacgcccggaatttctatccaaaattccaagcgcttacatgtgtgttaaaccctcgtccaggaatcaaccgaggcacacaataacaaattgataatatgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagatgaaagaacttaagacttacaacaacttaataattacataggccgaccggccaaatagacttaatagagaacagcggaagcttgactacccaatcacaagcacaccgactaggggtttaccccattaagttctcatcctagaagaagcaatcggaacccgcatcactcaaagactaagactaaacctgcaaacaaagggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaagagttgatgcttcaattaacaaagacaagttttaagtttcattattaacttcttcataattccatcataaacaatctcttattgccatacttaacaataagtcataatgtatcaccacatacacaactcaacacatttatcaatttcaaaccaatgtcacaagatcacatttttaaaacatagtctatactcatgacacatcaccaaagctctcatgaccgtgagcacggctaatcgattagtttaaagaactctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaataccatatgcacaccacttgccgcccaagtataaaatcacattttacacattttagttcgtaaatacccatcatattcattttattccagcaagggttcatgtataaaaattcacattttaattatagatggaatgagcatttgcatatttctaagcatggctgagcaagtagttgcacatagagcatatataaacccatttgagcacaaagagtgtactctaaccatttctaggggttcaaacagcaagaggatcaattattcaaggtggaatatgcagcaaataagtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatacttttgtaaagtgatttttactagattagacttcataggagtgtgaagttgtgttttctaagactaacacatttggtttcacaatttttggagttataatgattttcttatagattttacaagttacaacatgttttaggcatatagtgttttatatgttcatgacttttgagtgataggttcagaacatgctacttcctgtttaagttgaataaaaggaataatttggttaactaaaacatttttagttcacatgtttatgatctttactagtatggttcatattttataaactagagatgctctaatctaaactagcaatatattatattaacctagaaattgttatatgagctaagttcttctaattttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagtttttacaaattaatggctgctctatgttagtaaatccttatatgaatatttagagacttttactacacagtaagtatataatattatttcataacttggaaatacatgttttaatgatcctacagaacttaagtttactcaaattgaagctaaattgggttctacatcaatttctaaagtttagcttatctaaaattaatcattatagagattatagttttagaggcatttgatgcaaagtaagtaattacttttatttcacctaatcagagactgtatgatgatgaatctgtagaatttgattttgtttcaaaatgagttgaaatgaattttctatgcattttataagtttgtacatgttttatgtatgacttatcttagataaatcttagagacattatttgtacagtaagtgtcaagttttatattcctggaataaatttcataacttcaagaatctacagcaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgaggtttctaggaatcaacccgcagtcctaggcccatatgtcagttactaacatttttcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggagtctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcacgtgggttttgaggctcgatttaatcgtgcatgcgtatgataaggactctagggactactaggaggctcaccaagaatcaaacgcggctcggcgaagtcttagcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcgtcggcggccagagcgcgacggtgttccgagttgacgcggtcgcgttcccggagattggctgcactaaaagaggcgttcttggtggcgttagagacggcattgagagggaattacagaatgcttattgaacggaaatggagctcaccggattgcgacggcgtcgaggacttctctcaccggcgccggagttggcacccccgttcccggcgaatccgaggcggggtacctcggttcttccgcgaaacgagacaagggctgagagagagtntngagaagttgggtcgggcccgggtcggggatttaaggtaaccgggttcggccccgggcgggaaagaattggggcgaggggaggggaaggcctcggcctcttccgcgctcaacgcgtgctcacacgcgtggcgcgcgggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtagcttcataacttaatgtgtggaccaaattatctagtgttgaatttactggaggtaaatgattacacctagattccattttctttggttgcactcaaaaataatgggtagactgctcacagaaattaaacaaagatgggctattagaaagctagattgaatttttaggaggcttaaacagaggaggaaaattctagaaaaattacatttattcatgataactaatctagtgtttgaataaatcatttcccatgttcacttatgtgcagttcaatgtacttttggatgaaatatggttttagccaattaaatttaatttgatttcttttagttgtctgcttcaaccgattaatttgagatatcaacttgagtgttaacatgttaccaaattacagaggataagtttgtgctaatcattgtccacataaatttttccatgattttatcttgcacaaaatattttagagaattaagttgacctttgtttgtatatgtgttcccacttcataattgcatctaatattattatagggattacattaaacttgttttagactgagaagatgatatttgagtttaatattaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatgg

SEQ ID NO: 63630 - DNA, 6898 bp, Oryza sativa
  unsure (1)..(6898): unsure at all n locations
tcaaccctagtcaaactcacctgtgacgggctccaactatgtggccgtcagaggtggcctcacctgtgacgggcgccaaccgtggagccgtcacaggtaagaccacctgtgacgggcccaacactctgggccgtcacaggtgaggtcacctgtgncggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattatattatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaaaccactgttctgcactgtgcatttgctgtcttgcttgaccgtgtgaaaggtgtatccatttatgtcatatccttgccaggtggtgccactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccagatacctttcgcaaagatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagcacctgggttaagcagtaatcccattaaactctcgcatacattcttctcgacatgcatcaaatctatgcagtggcgaacttcaagatccttccagtatggtagtctccagaatattgacttcttttttcacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcatttccaacatgcatgacaacttgctgtgcttcgacttgcatccatcatacaacggcatctggcaatcttccaccaacttactaaacttctcataatctctgtcgttgtcctttgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcactatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacatctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcaatactgaccaattcatttgcccgtcacaggtatcccgtcagaggtgtgaggatcccatgggaagctgacgccaagtaggcaagtacccactacgtacacacatcttccaattggggtttacggaatgagataatccaaaaaataacattgacaagtatccaaatctaagaaatgccatcaacaagtgtgggttctaagaaatgacatcgtacaaacgattttgtctcaaaaatgccatcgtcgttagggttccgtctattccgcgccattaagtgctataggatgaacagtgtatttaatgacacgggatggacggaaccctaacggcgatggtatttttgggataaagtcgtttatacgatggtattttttggaactcactcttgtcgatgacacttcttggatttggacgcttgtcaattgcatttcttggattatctcttagggaatacgacctgatgtgatgactagtagctggaaattattcgcatttgtgtgtattatataggtgtatatgtatatatccgcttcgtggagtcagtcttgctgtttcgatgcggtagaaatgcaaattcttcctccgttcttaaaaatgtgacaacctagtaccggatatgacgcatcctagtactatgaatctggacatacatatgtccagatttatcgtagtagaatatgtcgcatccaatattagattcgctttttatgggataaagggagtagacttgagtttcttgctggccgcttcatactagctggagtagactgtattagagcaaaagtcattgtttaatcaatgtattgttagttaaactattactccctctgtcttaatatgtagcaatctaggatgggtaatcccatcctaggactacgaatctggatataccttatgtccagattcatagtcgtagtatggaacccatcctaggttgctacgtactgggacggagggagtagtagtattttcttccttgttccgtacgctctcctgacacaagtggcagcgcatggcagtcaattggttgaattgctcatgcctgctagcgcttaagagcaatgctaatagtatagctcgttgctgactaatagcccattactaaagtcagctactatgttggctgaaaacatctcataatcaaataattaattataacatgcacatattagtgtgtatgatcaagagtgaagtgtatccttgtagccatttgtaccaggactatatcagagaccgtatcaaccaaattctctgtagcacaaaaattacaaggcactatctatctattatattattaaaacagttttgaaacgagtcaccacgtttgctacgaaggctagaaatttccacattaatcgaagaaaaagataaaatctacaccgttagatcgtgatagtcctgaattataacggttaagatttagtaaggctacaaataagttttgggaactaacttaaatgcaatagataggaaactaaaaagctacatagcactcggccgatcaatgtttggctctgtctaaggaaacataaattaattaggagtaggattctgacgtaatcggattaggactcgggcatacatatttgaatgcatatggcgctagggcctgtaatctgtgactagagtcatgcaaattcaccatgacaattgacaaatatataataaaacataatttgttaagcgtttaaaggtgatctaaagcaatataaactgaactaataaatggcagagcatatatacatatatatatacgcggatacgcccatgcattgctaagagaataggaacaactgaacaatacatacatatagcacataccatatgttgtatgcacaagcctatagaagtaaaggccatagtcatatggctgcactggcttacgattaattaggtagtctaaatgcaaaacgccagcggctaaaggcatgcgcgtaattcaaaatatacttaattaatttcataaaagatgagtcatcacgggaaaaataattttatgtcataagaccttcaccttcatggcagcttctgttggatagtatagggatgagagaaatactgcgtaacgtggattgattgtattgagcctcaggggagggcgatatatatagaagtacataggaaggagataaggaaggattacagatatagaaggagtcctcacaaatcaattctatcctaaaacatctctaactaccatatttcatcagtcagaagtgcaatttgatatatgtgtgcacttttgggtagaagaaaaaaataattgtaattcaaaaaaagaatattaaaagaacggtctatctagaaaacgacacaagattaattaaaattcaaaaataataaaataaatttcaacattagaaaaaagtaatagtttaagtaggataaaagctaaaattcataattaaaaataagaaatgttgcaagaagagaccatcttaaaagaaacatgagatcgattaattaaaatttcgagtaaaaaataaaataaatttagaaattataaaataaaattgagagtttaagtaggaatataatttctaaataactgaacatttagaatgaaaattctcatat

SEQ ID NO: 63631 - DNA, 1766 bp, Oryza sativa
tcctgcaccccgatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagtgctattggtgcactttgtaaacacagagagaagtaataaagtcgtcatccactttaagagttcttcgatttgtgtttcaccaggtttcggcggtctaaccgacgactcatcggaccggcggcaaggcggcggtcagaccggcggaagcgaggcggtcagaccggcggcggcagcaggcacggtaggcgatctcggcggttcgaccggagttcgatctcggtcagaccggcgtgttccaggcggttagaccggtgcaactacttcggtcagaccgcgatccatcgatttcgagggtaacttttatttccgctaaaagtttttggttttagggtatctcaaccattcaccccccctctggttggcttagttcttgtgattcgatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaccgctcgcaacatcttttgagtggtatttctcattcagattatgatcgtgttgctcatcttcaaactgggctgcagga

SEQ ID NO: 63632 - DNA, 558 bp, Oryza sativa
tatgctccctgcaatctaaacactacagattgaaattttctgaccgttagaaatgttcaattgcacatcatgcgagcaactgatttgtttgcaatgtgcatgtgtcgccatttatgaacagactaaattctgacgcggttgttctctttgaccataaatctgttctgtgaacaagaaatatgaattggttgatgagctcattaaatctctgtagattccagctcaggatcggaggacccatcggctgtggttcagaagtgggctcgacctgctttgggatggaaagaaaataaggcggattacgggagtgtgcgacttgaattattgatttagccttgcagatagagagttggatccgctttccattggtcatctagtctaataggcaaccctcgcctcagtgaggaacttttgtccgagcattcttgttctacaattaatcggagtgaggaaacttaaaatactgtactatgaaaaagagtaatagtcgacagtgaataaatgagatgggcacatcaggttacacgcctgccccggctagctaagaggtcttttgct

SEQ ID NO: 63633 - DNA, 4474 bp, Oryza sativa
cgcgtcgcctcctcacaccccgccgcactgtgcgtgccgatgtcctcgccgctgagtgtgccacggccgcgccgcagtcatagcagccgcctccggcccccgtccgcgtgcgtgcgcgccgcctccgccgcccccgcctgatgtcgtgcgtgtgacagagacaggggaagagagacatagagtgagactgtgagagagagaagagagaggaaaagagaggatatggcaggtgggtcccatatttttttataaatagaatgctaactgaattgctacacgtacgccacgtagaccaaaaccaccgcggattgggtcgagggggggtaattcatccggtttgcatagttggggagggggggggtgaagaatgtcgtttttgtggtttagaggggtaattcggacgactgcgatagttcaggggggtaatttgtactttttcctattgaatattgaacattgaattctgaaactgaactggcattattttgaagaaaaaaataaagataagtataaaaaaatcccaatcatgttatcttattaaagataagtgatcagggttcaagttgatatggaaccatattattaaatgtttaattttgattattttcctagccatgtactgaagtattgtctaattaatgacaccggaatatgcaatttgacctctttgaattacttgacatttgaattttttctaccttagccatgacggttttgtaaggttgccttttatgatacctgtatagttagatgcaatctttaaccaatcgaagtagacgtttttgtgtatttttattttttttttacttttcagaaataaggaagaaacacaaattggaattgcaaaacttgatgctaacaaagcatccgaatagggcattacatttttttttcatgttagcaaatatcaatggtgtaattaatactactcacctgataaatacataaattccttggcaatgctactaccgagtcattttttttgctcgtgtgcatgaacattttattttcctcttctgatctcaagtcccaacccctattaatttatttctttaggtttctgcttcaacgtgttaagaaataaaaaaactactgatcataaacaaggctatttgataaagcagattaccctaatctaaattgggcgcggcaaggccgcgcgtctatgcatagtcagtactatagcctcactaatcctcgtcgaggaatctccttgccgccctagaagtttgagattgtgcctgactgttttggagtctgttcagcagctccttcagcgcctggggattgacgtcggactggagtcggctcaacatgaaatcaagcatggtatgatagtcttcttcacggagctcctctccattcttcagagtaatatcacacaatgtgtccagaatctgggcgtgacaggcgcaggctttttgtagagaactttcctttcaaagagagaggtttctagtgatccttggatccaaacgttttgtcccttgtggctttgcccatctcttgtattctgatcggagtcttgggtagttacgaggatttaaaatccattgctagtgtttccaggaacacaaagtatatgatacttggatctgaacgttttgttctgtttcttggaaaggctttctctgttttcaggaacgcacattcacctcgcgacatcagatcctttcaaagaaaactttacaaagacattggatgagagcatgttagacctgaaaacacaaactttacaaagacattggatgatagctagggtttcccttaccgtaaaccacgcggtaaccattggatgataacttcactcccccgcggtaagacagaaccgcgtggtaaccgtcggaaaccacgtgaaattcgttctcaaatatttgaattaaaaaatcgatggtttcagcgtggttactgtgcagtttcgcgtggtaaccacgaatatcgcgcgattaccgctaattgtgtagcagaacagagaagctgttagaaaaaattgaaaaaacatttaaattcatgtagaaattgggaataattagaagaatatagaggaaacttgcaaacataacttttggggtgtaaaatacaaaaaatcaatatgacctttttctatattatggacttcaacgcaattcaacatttcgtagcataataattcgacaacaataattcaacaacctcacatttgaaagcattatgatgtccacatgaagctgaaataatagagtccacaatagagagagcaatagagagagatgagaggaccaggagatattttctccacttataggccttaatggactggacagtagtacaagataagaccttattatttttttcatttctaatgtactttcggtttttccctcaaaattgaatttatctaattctttttcaaaaaaatttcttcaccatccgccactaaaaatgaagaactatatccacgattttttttcagttttttcagaattttgaatgtgggcaaaattcaccaaaccctaccaccggtaacccctaccgtaccccgcgataaacgcgcagttatcggcattaagagaaaccctgatgagagcatgtttagccttctccgttttgtagaaggaaataatataaaaatagctcctatataaagatattcatttgtttgtaatccaattgtgcaccaccaccgacaaaccctagaataggtgtagaataggtgatatttactggaccggcggcgtctcctcgagtaaaggcttccacccaaattgcatgactaacaggtcttacgtgtaaaggatcatgtacccatgattcaaaatttccttgccaagcgacataaaacagattacccgaaaaggcaaaaatgttataataaagacattcctcactaatatcatcatgacattggaaattaactaatatcatcatgacattggaaattaatctcaaaatcatgtgcggtagcgataccaacccaacaaaataaaaccagtagctagtgggggtccttagctatgccttggcactactagaaaacagcttttcacaggcggcctaaacaggtttttgcaggcggacgagtgcaactgaacgattgtgaaaatagttacttttcacaggcggacaactagtccgcttgcgaaaatagcacctggcattaaaaaaaaaaagggcagccaccgcccactgccgttccagccaatagcagtagctttccattctcctcccattccctcatccagattcaacatcaaaccaaatcaaatacacaaaaacataacagattaacagacatcgtagtggttcacaatcaaatcaaatcacaaattttccatggatgtcgtcatcgccgtcgcacggacgcaccccgccgccatctgccccgtgccgccggccggtccgcccgcccgccggcctcccccctccccccttcggccagatctgggagggagggagggaggggagccgccgccagccgcctcgcgccgtcccgcgccgccggcctccccccacccccctccggccagatctggagggtagggagggagagaagccgccgccggccaccccacgcccgacgccgttcgcccttcacccgacgccgtccgcccctcgcccgacggcatccgtccttcaccgccgtccgccggcctcccccaccccctccggccagatctggaggggagggagggaggggagccaccgccggccgccctgcgcccggccgccggtccgcgctttgcctgacgccgtccgcccttccccaccggcctcccccctcccccctccggccagatctggaggggagggagggaggggagccgccgccgaccgccccttccgccgacggggaggtgaaggggaggggagaggataagaggagaaggggagaggaaagacacttagaaaaatatcagcccacgtgccacatatatataccacgctaattttcgcaagcacactttatgtggtccgcctgcgaaaatagcaggcaccgcttaagtggtccgcagcgcccttcaccccgatttgcatttttgtaggcggctatttggctctaagggtcatgcccgtctgtaaaaataaatacctaatattggcgaaaatgctttttcagtagtgtggctaaacctgggaaacacacaactcatctagttaaataacatgtgcactaaccctcttcctagcttcaaaatgggattaatcggtgctactctagttagctaagcgaggtggtattattgccgctacaggtgttactgctttctaccttgccgagctgctatgcagctgcaactactgttgctcaacactagttggacaaaggcccaaagcctctgttgctgctgaaggcgagctaagcagcccactacctcaacataccctcatccttttttctcttttttttttcatcaattatttttggggcacaccacggttttactttttttcaagtgcaagtggcaaaagttattgccgaatatattagaaagat

SEQ ID NO: 63634 - DNA, 740 bp, Oryza sativa
ggcgaattcgagctcggtacccggggctgagcacaaaagtgttggctacgtggcatgccacgttggcggtcaaacgtggtcaaatgacaattggactaggtgtggtacattaaaccaagttcacggacctaaacatgtaattttcaagttcacggacctaagtgacaccaccccacaagtttaaggaccggccatgtatttcactctatgcctattcattcttctatcaatctcattgttcttattatgtgcaagtgcaacctaggcgccacctattatggcatgtcaatctcattgcttttttagaacttttcttcaatgggaatggtgcaaaatgtgtgaatcttgtttattctacaaaagttctatattttgaggcaactatcatgaattcgtgatggatcagagagtagttgttttgtgatggcatactgcagttgtgtgtaatagacatgtcaatactagtaacactttaaacttgctttcataggattcatttattaaggattggatgatttgaagtttatcatttaggtgactttaatgtgttgtcaacctttcatgtataatttgtgtaataggcaaaaggatatagtctctggctatgcataggtgtggtcaattcctgatgctaagtttgtctgatttttcaggttcggatctttcttgcttcctggttccttgccacattcttgatggtttctgtaattccgcctatactgcctggtccaagaaacttg

SEQ ID NO: 63635 - DNA, 1332 bp, Oryza sativa
tccacagcatctctttctccgaatctgggacaaagctctcatgatctccgcgtgcccttgttctgcgccagtagaccgtactaacaggcacgttatcccgcgcaacccaaccgctgtgacgtacatagttcttggcggcttctgccggggcactaggtcggccgtcttcgtccacttccgttatgatgtgccgaccctcaagcttcttcgtggcacctcgttgcccgcgtcccctcttctgtccaacggagggttgacttccactagcctcctcctcctggttcccctccacatccctttccacgtgcccctcctggttcccctccgcatccctctcaacgctcccttcctcgttcaaatactggtttggatccttgttcccctcttcttcgttccagttctggctgcttccctccgcgattgtatcgtacaatatctgttcctcattgcgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagctagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatactaagtctaattacatgcatgataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattaaatccaatagtcttaattgcattacaaatataacaatcatatatataattacgtcacttgcctgcgcgaattccttcgagggctagctaccactccggcttgagggacgacttcgacaacgtcttttctgcaggatacaaaaagatgtattaggataaacgcgaagtaacatatattgcat

SEQ ID NO: 63636 - DNA, 689 bp, Oryza sativa
ggcgaattcgagctcggtaccctgtaattcttttgagatatactttgtatttcaatcaaatataaagcacagcttcgtctgttgaattgtaagtttgctatctagaaatgcacctgaaactctgatgccttggggggaaaaaagcatcttgaacttttggaggtctgaccaaaggtttttggcccccaccgccaccttagggaagtccataaaatggctgttttgtggttgcataaataacaaatggcaaaagtttttactaatggattaaatttacccttggacccttggggtgacacagttgaaaaatgcactttgttgaaagtcaaaaactttcttaccccgtgatgttggcagcattatggtttatggtgaaacactggcttcagcctgtaaaggtgactttctttggttccttgcaggaccagaatgatccatctttcatcactttccaaattgcagtgttctaaaaactggttggtttgcacacagaagtggctaatattagtatctacggagaagccaaggataacgttagtgttcaatgaccattgatctgcattgttagcttttaggcttgtgtaaaataggaagctagcagccagcacacctgcacaagcaataccaggacctgtgtccactgaagggtgaggatgtgaagcatatatctacaaaaaagatcctctaac

SEQ ID NO: 63637 - DNA, 10310 bp, Oryza sativa
  unsure (1)..(10310): unsure at all n locations
tctttcttttaaatttagattgttcccattttttgtgatttaggttgtctataaataatttgcattgtttagaatgattttgagtcacaaatgtttagaaatagtttgatttaggttgtttagaagttttatgacttaggttgtttagaaagtttgtgacttaagttgtttattataaattatttaggttgtttagaattattttgatttaggaagtttagaaatattttgatttaggttgtttagagatttgtagacgtaggttgtttagaaatgacttaggttcaattgtcattaaactttgaacaacttaccatcaaaattgattactacgtcttacatgtacttattatttactacattgtattgttcaattgttttctaacttttttgaaatggttggttgtcgttatttttcaaaaggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctacaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgggctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatcgctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggccgacaggcggggaggaagccggcgtggtgaggccggagaggaggaggaagtcagcggccgacgacgggcgatgcggcggcgatggtggcggaatgttggacaagggacaggcgcagcttctccagcgcatgcgaggcgcaggacgagcggcccacggttgtcacagcaaggaggggaacccggtgcctggggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattggcccttatataagccaaggatgcctggatttttcattttagatcttttttaaaaaatattttataaatagacccctacaaaaatnttattntccttttggnaaaatttggggggaatttccccctttttttttccgggccgggcccccccaaaaaccccggggaaaaaacttgacgccgtaccgtggccccaaagacgttggtggcgttccccggcctatcctctatataaaagctaaatcactaatatgaaggggaagtgaaccatttaaaaaaaggatctatttttaataagaaatatttatatgtaggtcctcacaataaataacattggcaccgatgacctatttataaatattattttacaaataagtctttttttcaaaaaatatttacaaataggctatcggcgccaatgacattggtgcactactacaggagatgtcataggtgtcggtttctaaagttaagggattaaaagtggacttattcctatttttttcctctcttggccagaccagcttttttccctttcagcccatttaaatttttcacccttcacaactgtgccgccaagatgagcacttccaattgtttcttgtcgtgctctgtcagcttctgtcccgaatgtaacagggtggcgcacgagttaactgtgttgggttgtaaaattgttggtgtccagggatattgctggttcctttaacttaataaaaataggtttcccataaaatagaatgatcagcatcctcccttctcctccgaaccacactgtccctgcacagccgagccggccatggcgccccgcccgaggcttgctcctgcacacgaccgcactctaggatcgcagccgcaaccacctaccgcgcacacgcgccgcaccaaggtgaccaaccgttcgacggcggtgaaagctaatcacgagccacacacacaagcatccgaagagtaatgacttaattatctaccaatgcttataagcgaaaatgctggaccttggtgactggcacaaatcgcagagaatgataccgttcacgaaccgtgcaatgtccaaccaacatgatcgaaatggtcatatccatctatcccatacttgtcatttccgtgatgacacccattcctaagtgaagaacacacacgatgctgtcacggcaagtactgttttggttactgctatgtaacatcagttaggatcgacctgctcgtttctcttagcttgtgtgttgttagaatgcagaagtgtgcaaattaacggagaaacagggtgaagaaagctagagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatcctacaagaacagaaaggtcacttattagacccacccggtcaacacattcaagatattacttctttcggggctgcagga

SEQ ID NO: 63638 - DNA, 538 bp, Oryza sativa
gggataactcatctttaatggttcaaaaaaaaatcccttttaagatatgactatcagggatgacccatcatcgatacaaggttatctttctcgggtcgtagttgtaatatgtcacggatgacccataacgggtcacaatcatatcccatcacggatgatatatcgaccatgatggtgtaataagatgtcccgtgcatgagtgcatatcctcaagggcatgagaagaaactttcacaatagaaattgtaaccgcatctccttaagggcaagtggctcgtgcctgagtgcatcgctagggtttcgtgacaaaaagtaccgcataagtgtttcttgccatgaacaaaaatactgcaaactgaaattttgacgaaactgagattatgaacaaaattttaaaaactaacaaagataaagacaaataagacaaacactgagaaagtacaaaatttaaaattcctaaacaatgtttgttgaaaaccaaaccaaaacgtaccaaactaaatcatgtttagtagctaatgaaactatgaaattcaca

SEQ ID NO: 63639 - DNA, 819 bp, Oryza sativa
  unsure (1)..(819): unsure at all n locations
ggtactataagattaagctcgggctctggtgcaaagcactacctacttccacatgtctagtgggtaaggcttagtttgtgccacagtctggttataaacaaaagtacacgaatgnagatgcacgaagtcgggggtcgatgcacatctctaggacaaatgaaggctacacgagctgcggcccggtagtcgagatgtcatggcacagggctggtgtcctgctgctaggggctcaatcctgcctgcctgtcccgaaggttccgcccgtaggtggggttgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgcccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaa

SEQ ID NO: 63640 - DNA, 638 bp, Oryza sativa
gccccacgaagtcgggaggcgacgccccatggcctatctggtgatcttgggcctgttcgcggcccgcctgccgatgtcctcagctggggggagctccaagtcgggatggggcacctcctcgaagctggcgctcgcgggataagtcgcgatattgccgaggcgaggacagtggcggcgtcggcctgtactcagctcgaaggcgtcggcctgcgcattgacgaagccctgaagcaggaatgccgtcgatcgagccgatatgctggagggcatgtgttggcttgcatatgagatcatcatccgcaattgcacctcgagtttctccatgaagggttcgctcgttctcggaggactccggcggagatagaccacctggcgaagtcgatggcgccgctggcggaaaaagttttccagtctatggactggcgttggccttcttggtagtctttgtaccctgtgatagatatcttagaaaaaatgtatatgggtttggacttgtgtaaagttggtaagaaagattttgcgaaatagaaaagaaatctatcctgatgaaatcttttactctggatataatcgggaagaatgttttctcagttcacgactttggtcagtcgttgagtcgtacacttttcctagcccca

SEQ ID NO: 63641 - DNA, 5406 bp, Oryza sativa
aaattttaaagaaacacaccaaatcaaatcctttgaatgaattaactatgtataggtatttattatattttattaatgagaaaatgaaaacatgtgtatgtgagttttttacggcagtggcatttagttgaatccagatggcatcaggacaatatgattttgcacagattacaatttgacaattcgatcatatgacaatagcaaatatacaaatttctcaaaaatattagcggtgaaataatttgacaatagaggagctatcttataatgagcactatggccaagtcctttttagcttatttactggatatatgaaatgatttatttcttcacgctttaaaaatatgttttcttaaaaagttcctgcttagacatttactttaaattaccttttaagcttattccttaaaatatttaatttttccatctggtcaaatcactgtataatatgtggcaataatgtagctagattatctaaatcaaatggggtagatataccttgtaaacttctccatacccaccactgccaagtttgtgcttttctgagaaattgcctgtaattttttctaatagagcaaatgaaatatcccttggcccttccgacttgtcttccatgctattggcctcagacctacttgacctcttcgctcccacgtccctttcaactaatacaatttttttatgagtacattatacagtatatggttaaaaaaaatgcatggtgcataaacttcatgagcaaaaaatgatgaaaagctaatgaaagaatattttggtcacaaaattttaagagtaaacagccactgagtgtacggaagagttatcccctaccacactagtttgttctttccctagtatgaacggaaactacagtactgattgccttgtaacgttttattaacggaaactattataagcaaaggtatgagattgaccctactattactaataagaatctaaatatatatccaacacgatgcttgtatgatcttaaaatcctagattaattgtatcatcttcgtcttcatgtaattgtttgagatcaataaatctcattttacccaaaacattgatcttatgtattcttataaaatctatcttataatcttatatgttggttcgtctcaagacgttaattgaactaccctaagccgtatgtgaacacaaaacatatgattgtaaaaatacaggaaaaacaaaggaatgaccgtttgattaaaccgcaggaaaaacgcaggaattagatgagagagatagactcaaaggaaagttgtcaagaggttgaagctcttgctaaattttctccaaaatctctataagattgtccattccatagaaatctcaaaggattggatatgattcaatcctttgttttaaagggctccatagaaaatttttctataggattgaaatcttccaaaattcctatgtttttccttcaaatcaaaggggcccttaatatttatagtgtaatttctttcgttgttaagaagagtgggtcctagtcatgtccgctttatttttaacccacggctgatatccacctttttttctttcatctccattacgttttgccacagtcggactcaacagaaagttttgctacaccccaaaagttagcttaagagacaatggatttccccacgatcaaactcatcagcgcacgatcaatatgtcagcccaactagaaagacttaatgcatcccaaaagctaacccattagcgcatgaccgatatgttggtccaatcgggagaaagccttgctgcatcccatcagtgttaaataattattaagtaattattcaaaaacttttgtgaaatatgtaaaactatatgtatatatgtaaaagtatatttaacaatggtagaaaaagaattaataattacttcaattttttaaataagacaaacggtaaaaaaaagttaacgacgtcaaatatttagggacggagagagtacgagaaaattcgaaagtaaggaaacgacataagtgttttaagcagaaagaatatactctgtttcttcctagtacgtatatatctctccgtacgtaatctctagaaagaagaaagaaatctaaatactgaagtagtactatatcagtctatcagtatctagaaacgcattatataaaagaaaaattccagtatgcaacgaaaaaaagcttggtataagaacagatctatgtcaactaatcgatcggaaagtatataatgcgtgtccaattaacctttcttccacaaatggttaatttgaggggaataagtacctaattaggaacggttggatatccttggtctggccggcatgcaactgcaacggctgacggaggagaaagatcgagctatgtcgtcccggccttggttgctcgaatcctataatactatacaagtgatcctatgtagggtgtaattaatatcctaactatatcttgtatatagaagatgcaaggcgggggtgggtgcgcacgcgcgaggagaaggatcgaattaaggtgacttatcaatcctcggttagaaatttgacctgtcgtggtcaagtagacaatgcaagtaccaataattaagcagttgcataattgcatcaacatttcactctcaattataatagataattaatttcttgaccatgatcaagttatttgtcatgttttagcaaataaaaggtaggtgtgagtctttaactgccttttggtcggacgataactgtaattttatcccgcacgttttggatgtggatgagtaatacatcttcctttccccgaaaaaaaaaactacatgcatgcatatgcaggtgcatgtacgtgcgattagccggggtcaaagtccatgcaagaaaccggtgtgggtgctaatctttaattttgtccacgttatctactaaaacatttagaggtagtgtatacaatacgttatctctatatagtaattaactctaatacacagccacagtgttaatttattcgtccatctactcttcctctctctctccttaattttatcttgaagtttatataaaaattgtaggtagaaaaagatgttgtaagtgggttataggagttgccacctcacattttttctaagttaaaagaaagagaaaaggagagcgaaagaaaacgggttacaaatatgtagtcaacagtaacgctctataaggctttgtggagagagttagctgtaggactaattactactcccaccgtcttataaaatagaggattttggaggaagtcgaactcctatgctttcaagtaaaagcttgacgtgacgcctttggtccaaaatagttctagatgtgtcgcatccctctaaaatcttttatattttgggacagaggaagtattgatgtagtatgaatatgtagctaactattatatagatatgctacatagattaaagatgatatggcaatagatagagtaaagcatggtctctctcctctattctactcttatccgtatcatcaagttcttattgtaatttctctaattaatacttcttccatcataaaatataagcattttttgagtttttcactgggatcgagtaagaagagggatgaaattaaatggaaaggactatgattagtcgagattataggaagtaaatagaggaattgaatgagagatggttgtatatagcagaaataattaagaaagcagctggagaagtgggtatatttataataaaatttgaacgttaaagttgcaaaatttcaagacgaagggttcgagtaaataacaatatgaacatcaacaagttgccaaacctaacgatatgatagtattaatttatccagctaacaatttatgatcctagcttgttgcttcgtaagaacaagagaattgctaggaatcaattggaatactcccaaatcattagctcgcttatgtacctggctagtgcaactaggcctgatatctcctttgctgtgagcaagttgagccggtttacctctaacccgggagatgatcactggcgtgcgcttgagcgagtaatgcgctatctgaaaggtactatggaattggggcttcactatactgggtatcctgcagtactggaggaatatagtgattctaactggatctctgatgtggatgagatcaaagccactagtggatatgtcttcacactaggtggtggtgttgtttcatggaggtcttgcaaacagaccattttgacgaggtcaaccatggaagcagagctgacggcactggatactgctactgttgaggcagaatggctgcgtaatctattaatggatctgcctattgttgaaaaactggtgccggctattcttatgaactgcgataatcagacggtaattgtcaaagtgaacagttctaaggataatatgaaatcgtctagacatgtgaaaagacgattgaagtctgtcaggaaattgagaaactccggagttataacattggattacatctaaacagctagaaacctggcaaatcccttcacgaagagactatcacgaaatgtgatagacaatgcatcgaaggagatgggtttgagacccatatgagttatactatggtggtaacccagtctatgtgatcggagatcccgtgaattagaacctgggaagaacaagccattagttaactacagaagagtaccattctataccttctctaagtgaagatgcatgtactcttgtgagctgtaaggcagattggctatgccttaatgagttctgttggctttaattagcgaagatgctcctgcagagcattcttgaaagaagtcacctttgtgagcttgactattggtcacagtctatgaagatgttgggtgaatcttctaggaagcttactaaagaccaaggagtatggcttatacgctccacccgaggggtaatctacagacggtctagtaccagataaggctctgagtgaaacttgcttgcacaagacttacaattcaaggcgtagtccattgttcaagttgtgagtatgtgtagattggagttctaggtggatgttcaaccttaattggtctccatcgaaccgctagtatataaacagtacattggaaaaggcaaatctcagtgggattttgagctttggtgggggattgttggaattaatagatggggcttagcccattcgaagattaattctttagaaaatcacaaaagcctacctcatgggatggcatgcatggggagtttagtaccaccttgcatattctaggagaatgggacctccttaaaagggaggatgccctcctagccacttgaagcatatgtggtggagagaagagggggaacacaggcgcgcgctcgctcgcctggcctggcctgggcagggcagggcaggcggcgcgcgtacacgatgtacgcgtcgaatggtctgcaaaattggctcatcacccttgcgcagatgcagcctccttt

SEQ ID NO: 63642 - DNA, 1684 bp, Oryza sativa
ttccgggcctccctgtccggaacctccgggtgtcggggaatatatatactcaaggggagttagaagccctattctctctcctcatttcttctctctccccgacgccagccctagccgccgccacagtgcttctagtggcgattttcactttcatccaatcaaattcgtttcttcttcgtggattcatccacattggtggctgggaggttctttctgtgatcgattcgcagtttcttctctcaaggtagcacttcttgattccctctctcggttcattgtgtttttatcccgatctctaaatctgtgaacctagggagaaaaccacttggatagtcttgtttctgctaccttgtagatcaccgatctataggatttgttcacatgcactggcttttttttgagtcctctgttcttcttttttgccggccggaagttccggtgttcttgcacccggaacctctgggcgctgtccagccagcctgtcattcttacttctcttaatttttgcctaactactgcactccaaattgttgattcctgttgcagtaagcactatgactcgtgagaaaagacagaaagcctctcaagatgtgtccggtgatgagagtcctcctattcggttccctcgtggtcgtttgggtaaagagaaagttgttgagggcggcagtggcagtggcactcgtacttctcccaggtttacaaggcaatcaagcaacctaactgttcagattagggatgttgacagtagtcaaggaagtgatgcacctaatacaagaggacgggggagaggtggtggtcgcagttctggggctggaagggcatctcatgatttccctgtaggatctcgtgagaatcccgttcggctctacaagactcttggttttgacaccactcctttgcaccacattagaagacccaagtccaactaccttcatcaacttgccaagtgtagaagagattgtttgattgatccagagacacagcctgaggagtcacagaatcctcgcttcaggactttcactcaattggattggtataactcggtgattatggctagagaaaatccagtggttgagatgaagtggattgatgtcgcgtcccaaaacgactctaaaatctatcctcgaaatagtgcaaagaataattaaaattcatgagaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagtggaaaaaggttttataaaaagaaaatcctaaaagaagttcttttttcccccctttttccttcttgggccggctcggcccacttctccctccctctctctctctcctcccccgcggcccatcggcctccccgcgcgcgcgcgccgctgacaggcgggcccgcccgccgctctcgctgacgggtggggcccacctgtcatcgccttcctcccgccgcgcccgccgccgcgcccgtgccctagcgccgccgccgccgcggattgcgccgcatcccgccttccccgcgcgccttaatgaggggggaatcactccccgtgattccctctcccgtttcccccgttttcccctctctctctccctcggattcgtccgatttcctt

SEQ ID NO: 63643 - DNA, 1136 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgcggccctgc

SEQ ID NO: 63644 - DNA, 562 bp, Oryza sativa
tgttccaaatccccaattacagtcctcgcacgcgtcgttggtggcctatgctatcaccaagttgctgtcggtgaggaatggagccaatttgccgtcatcgagggagggatgaggaaggatagattcggcgagggaggccgtggctggctggcggtggacctgaaccccctctaggacaccccaccgtgcccgtaaccctgttttggcctcttggccattatccgtgctccactgggctgccgaatccacgccttcaagccttcccgccacccacaagcctcttcgtcacaagatctgctgcccatgcgcctcctgcagccagatctgctacccaccaacctcgccaccgcccacaccactctcctcccacagacggatccgctgttcaccagcctcggcccttcccgccgccagatccgctgcccgcaatcctctttatcgctggacccactgcccatgtgcctcccaccaccggatctgccactgaccagcctcggcattgcctgtgcaccacccaccaaccttgctgctcccgcacactgcgtggtcgtcgccgtcttgg

SEQ ID NO: 63645 - DNA, 3176 bp, Oryza sativa
ctcttctgggatctttgcataagtaagccaagggtttattcaagaccgcggctctttggagcacctcacaagagagtaggattcatgtgatccgaacttcgggaaaaaaatcgtctttgtctctcttgtgcatgatctttgtgtgaatctgctgatattctgcaatcttcatcttgttcctctgtgtgcctaaacttctcttgctaggacctgtttttcatctctgttttaatttatctctgctgcccggaagttcctggctcaagaactccggaagttccaggctactcatcctgcccggaagttccggtgttcatcaccaggaggttccgggccctgtcaatttaaccgctacgattgttgagaaaatttcaggaaagcctattcaccccccctctaggctacatctctgatcattcaattggtatcagagcaaggtgctcttgattcaagcttcaccgctttgagtgatccacgatgtcagacttagggggaaagaacggggaaaatggaaatgaagatgaagcaagcagcaagggaactccaccacccaagggagctactataccttttgattacagcaaacttactattccctctcacaacttcgtctccatgccttctaggcgtgctcctcaatttgatgggacatattatgccgcttggaagcacaagatgaagttgcatctaatctctttgcatccaagtatttggaaaattgtttgtacaggtattgtataccccatgatgacatggagctcacttcggagcaagaacaactcatctaccgcaatgctcaagcttccaatgcaattctctccgccttgaatccggaggagttcaacaaggttgatggactagaggaggccaaggagatatgggatactttgcaattggctcatgagggatgtcccgccgttcgtgaggccaagattgaattattggaaggaaggcttggaagatttgtaatggatgacaaggagacagcacaagagatgtatgataggatgatgattcttgtcaacaagattaaaggacttgggagtgaggacatgacaaatcactttgtggtcaagagacttctccgtgcatttggtccatgaaatcccactcttgtatcaatgatacgggaaaggaaagacttcaagagactcaccccaagtgacattcttggaagaatagtgtctcatgagatgcaagaagaggaagctcgtgaagtgagacaaatgatgaagaatgccgccatgatcaaaaatcaagaagttgctttgaaggcaaaacaagaagaagagtcaagttgtgaagaaagtgaagatgaagaaatggcttttattgtcaagaggttcaagcactttctttacaagagtggctatggcaaagggaggaaggacgatgacaagggaaagaggcaatcaaagagagcgtgcttcaattgtggcgaatatggccacttcattgccgattgtcccaagtcaaatgaagctaacgctaagggaggcaagaagaagccggagcgtgctcatgtggcggaggcacacatggcggaagtgtggtacttcggagatgaagaagatcccgaggtcaagcccaagcccaagtcaaaagacaaggttgaaggagaaggtggtgttgctaccgtcgccttcaaatcatcctcttcaagcaaggagcgtctcttcaacaacttgagtgatgacgacgacgactcctaccactactcttgcttcatggcccaaggccgcaaggtgatgactcaaaagccctctcaaacttctcttgatgttgattctagtgatgaggaaagtgataatgaattagatgatgtgcttaagagctttagcaaacccgctatgcaacatttggttaagttaatgagagctttggatagtaaagaacaatcactcgaaaggcaagaagaattgcttattcttgagaagaaaagaaaccttgtcttagaggagagcttagctaaagaatgtgctaaaaataaacaacttgctaatgagcttaatttggctaatggttctttagctagccttagggatgttaatgaaactcttcaagaaaaatttgctaatttagacaaaagtcataaagatcttgaagttcaatttgacactctttggaatagcacctctcaaccaaatgtggtttctaattcttctaacccttctactagcaatggtgtgctaggtgttacaatattgatttgaactcttatgctactaatattgatgctatgcaagctcttaagaaagagaatgaaaagttgtgcactttggtgaaatatggatgcatcaagacataccattcaaaagatgccctttacaagaccatcaccgctcatcctaacaaggatggacacgggttcgggttttcgggtagaagtcctgtgtctaagcgtgtgatggtaaatgggaaagaatgcttgatgtttgtgcgagaaggtaaagctccacaagcaagtgaggtgactggtcttgtgagctgccagggacccggaacatccggacaaaccgggcgaaacctccgggtgggagtctctgtctctcaaaaattcccaccagaaagttccggccggtttgccaagaagttccgggccaatggccgtgcacaagacatgaccggaagttccgggcataatgccaggaggttccggccagatggtctttactatgattcatatgtaatttccaaaaatttagagggaaaagtgggtgcttattttaatgggaattacaatgatgagtaccgcacttgtgtgtgggtgccaaaggctttggtaactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtcttgatgaggagaacggaactcgtgagaatattgtatttggagatgatggtaaaggaaaggtaattggtctaggtaaaattgccatctccaataatcaatctctctctaatgttcttcttgtcaattcattaagctacaatttattatccgtttctcaattatgtaagttgggttacaattgcttgtttaccgatgaggatgtgaccgtcttttgaagggatgactcctctgtagcat

SEQ ID NO: 63646 - DNA, 551 bp, Oryza sativa
atgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctagacgaggattttatgcacaaattagttcggaaattattagtgaatttccgggcgtgacaggggagctgttcgactctaccccagtcttgttgtgactgggacttggggtaggagtgtagccgggggtgtcgacacggtcttcgatcgcctcgtccgcggccttatcagccacggcctcctcctctttctcctctgcttcctgctcgccgtcgcgtacttcgg

SEQ ID NO: 63647 - DNA, 1006 bp, Oryza sativa
cgtcctcctcccgtcggccgtgccggcgaggccgccttcggcgcgccctcgcggctgccaagtgggcccggccgtcagccgcccgcgcccggccgcgtgcacccggtccaccgtggaccgtggggctgacgcgtgggccccactcccgtggacccggtccgcgcgccccctccctcggctgacgcaataaatgggtttttaattaaaatttaaatgaagaaattcgtaaatatccatttaaagagcatataaacttcaaatggctttatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggtgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgacattattattgctattgttattattaccttgttcaccctagaataaacaaaaccccaactagtggacactctatttatggttccactagtatgaatttaggtagatgcttcgctgattaataggacaacattaggtggttttacaactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaagattaagctcggcctctggtgcaaagcactaccgtacttccacatgtctaatgggtaaggcttagtttgtggctcagtct

SEQ ID NO: 63648 - DNA, 7445 bp, Oryza sativa
aagaaatcgatccgagaaaaacaaaactcggttttggagataaactcgaaaacgagttcgattcgggcaagatactcaacgatttgctccgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgcttgggcggggagggggcatgttgggccaaactcggcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagtgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgctgccgttcgtccagccatgcgccgccgtcgctacggtcgtcgtcgtcactcgggaaggccaccgtcgggatcgccaagtcgccgccgtccccgtccgccgcttcgccgccgccgaagaccgccggagcgccgtcgccgttgtcgacccgaagagcttcgccgcttcctcctcgtcgctgccgccgtccgttggtcttccgccgttcctttggtcaccggtgagttcgccgcgtcgccctctacccattggtgccctccgttcgcgtcgtcgcgccgccgttcgccggcgagcatgtgagcccgagtcgccgagccgccgccgccggggtgacgtcatcgctgacgtcatcggggtcgtccgccgtgagccggtcgtggaccgatcaatctcggccgtccgttttggatagggttgatctcggtcgtccgttcgcgtgaaccgccgcccgtgcgcccggtccaccgaaaccctagccgctgacgcaataatccttcttttccttttcaaaaataattcattattgcgtcataattcgattaaaatccatataaaggttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttccttgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttaagtggttctgaaactagttgttgaaacttgaagacgccaatgtggtcaacttatggaggttaagtcaagtggatcgataaataagaaggtgatggtcgatctgaagggccaagtggtcaagatggaatgaagtttggatcctaccttagaacctatgccgccaaagtgtctttgaagaatagttagtaggatagaacgtttgttgtttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttaactttagcgtaacccctctcctcctatcttctctaatctgcaacagatggtgaacactcgtgctaatggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttaactgattttcttcgtgtgaggccacctaccttttctagcactaccaacccagtggaagcaggtgattggttgcacactattgagaagaagttggaactgctccagtgcacggatcaggagaaagttgttttcgcttcacatcagttgcaaggacctgcatcagaatggtgggatcatttccggatgaacaaagcagaaggacaaccaatcacttgggcggagttcacggaagcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagaggcagtgtatcaagccactccaaattggtgaatcttcttccgctggtcaaggacagtcgcaacagttgaacatcggtggtgagatcaaatcagagactaatgaaagcaatgaagttaacatcgagcaagctaatcagccggtgccagttcagcaggatcagtctcaggagaataacagtagtggaaggaagcagcaggtatgtttcaactgttacaagccaggccactttgctagagagtgtccgaagccaaagcatcagcagccgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttagaataattatcggagttatggaataagatagactgcagtttacctattccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagcgcgccgccgccgccttctccttccaaatccgctcgattctttccttttccggtgaaatctttagagggg

SEQ ID NO: 63649 - DNA, 57182 bp, Oryza sativa
ggaataagaaggatctcggtgcgggtcgcagggtgtccagtgttaacggggaatcagcgtgcgccgaggtagagttgacctgcagggtgctgctatctaggtatgagagagagcgtgggcttttgtgcgcgaaagggagacaaccgtctggggggaaggcgccggaagcgcggtttagtgggataaagttggggagagtggcggacggggatatagagttggaggtgcatctgtataggggtgtgggcctatagagagatatacagacaggcacctatatatatgtatatatatatatatatatatatatatatatatatatatatatatgcacatatatatatatatatatatatatatatatatatatatatatatatatatatatatatatatatatatatatataatattgtattatacattctcttgttttatagatgaacccttttcaatgggaaattgtatctttttcactagaaccaaccaccaaagaagtccatttctatggttaacaaacataactccggtgccccacttacattacaatatatatttcttgcacgcatgatcgagcactatatatatatttatatatagtagacacaaagggtcctacactataatgtgcactcaagcagatatcaatagtgcttcagaaagttctccatgcggtgaaattaagacatatacaacagtgtgtttgtactacattctactcgtgtcaaaaacatggagatgttgttttgggaactaatatgcatggccaccaatttaaagtataaccccgatcaacaattagtttctattacaatatatatgtatatatacaacctaaaggagttattatattataaaagtattattcaacacggcactatcacagaacagcttatcagtgccggttcaagataactcgatactgatgatggttttccgtcccaaaatacaagcttgcgccatgcatatgttctcttggcactgatggggagatatcagtaccgggtcttacaaccattcggcactaattgtttggcaacatatcaatgcggagtgttgctattaatcggcactgatgagtaacgcatcagtgtcgggtcttgccagttggagcgtgataactaattttggtaggaaaaacatcagtgccgggtttttaagagtactcggcactaatgccactcacatcagtgtcaggtattcttatgatccagcattgatgatctcaaccatattatttttgtttatttaggatatatgaacttaaccttttcatacgtactcggattgcaacaaaacatatatgggaattgtagctctcaacgagatctatgattttgtagttgacaaatttttcatttgaattcttttaaatattcaaatccataatttaaatctcggtaaggatggctcaaaaggaaaaaaaaatattcatttgctaacaagattgatgtgtaggtgagttggtaaagataggtgcatgagaggagaggtttttaggttcgaatctacaccatgacaagaattatatttgagttgaagaaatagtggttgcaccttcatatatacatagctatacgcttcttgacgtcaattcttgtttgtaggattatttacacttgcatcctatttgtgggtgtgtccaatgtctcacttcacagtccatctctcagtcgtgccgaacaatgtctcactgcacacagtccatctcagtcgtgccgaacacatataatgtactcaatcatgctaaagtgaaattgttgcaacataatgtttgcacaagacttcaacagagagatgaacgttgctaagcactcctgtcgtctcacattcctataggagaaatgtgcatgatatggagaaattcttttctctgaggaaatccttgtctcttttctttgcggggtgtatggatgactcatttgatatactttcagctagaaatcttatgttgttgagttttgaattttgctgcgccctcttacgccaaagaaaagatcgattctttttttttgttgcattgttgttcttgtgtttgtgaatttggagtagtcgctacacaccatatatattgcaagattgccaaacattttgatttcaagggcctacatttaatagattgagattataaaatgttccatgcgactcccatgatatcctggacaaatactcattgttaatatatctaattgcttcgtataccaaatagaggaatttttatggtccagcaggcagtttcagtaccaaatctcgtccattggattgaagggatctaacggtgtttggcatggaagggcatcactgtaatttagcattagacaagcgattgaatcggcttgagtatcatgaaagaaaccctacgtcgttttctctcgatctgaaatcatgtcagcgctgctcctgggagggaggttgatttgctcttggtttgtacttccacggtggcgcttccttcgtcgctacaatcgttatcgttgatttcatcgccaccgcgttcatcactggagcggtcttgctgttgttgctgttgcactcctcgctaaagcgctcatcgacaccgcaatgctcgctgccagcaacaaacaaagttgggggaagtttcgatataacttatctgtggggcacgaaggatggtgagaagatgaaatccccgaaggtattcaattgggcagagatcaggaaggagtagatgaagacaaatgtgtcattggattggattcatgaggtatgatatattctttcattcaatgagaggacgaatatggagagacgaccgcgcgtggcgctagctgggagagaggatgagtagggagaaaaacactacgacaccacacaaggataagacgacacaagtgcgttccgaaagcatgcccatcctacctagcttgatcggacggtcagatttgatttgttacaacgagatataggtacctcaagataccacttgttggatcaaaacaaatttctttagggaaagattgtccccagattcatttatttggacagaagagtaagtttagtattattaaataatttgcaactatatagcttaactacgaagctaacggcccggcgagaaataactaggaagctaacaagttggacaatacagttgatcaaacgtgaaaccagaaaatttttacttgtacaaacatgcgatgattaatcttggtgatgaacaattgtcaaaggtaagtatttattgaaaatgcagtgaacagtgttttctgactgtcggtgaacagtgtgttggcactgggagcctgtcaaactaagcaatgcgcaccaattagatcggaggtgtccaggtagcccgacggtcaaaccggcagactctgggagggagtcagttttgggttgttttcgtgaaatttctagattgtttcatatttatgactactaaatcatttctatacatatgtgatattgtttgtgtgctgatatgagtcaagttggtgctaacttgtactcggacatagagtttcattgttgttcatgtgcatgtgttgcttgaggccgtgggagtatagctggtgatggattgggactaggcttgtgaaaagttaaggtctagacaatcaatgacatgatgcgggatgctcaggctagacaacatgcacgtggaggtgaaagttttcatatgacatatacctggtgttgtgtgcgtttagaaagagtcaaaatttggattgcagtacaagtttggaaacattagagtgcggagttgtatggggatgctctttccctggtttgataggtttcctatatatgtgatcaatattcctagttgtagttggattcgtaactaggggcaaccacgttgtgggcacaaatagaagaggggttgattctaaaagatttcgactttctaggagatgagtgttagggtttgcttcaagatttcaatcctagttcgtgaggagagatgagtccattagatgtattttgtaaacacatattgatgcaataaagttttgtcgatacatgtttttctgggttccgacacggtcagactgttaggattatgccggtctaaccggcggcgagcaaccggtcagaccggctgtggcgagaaggcagtaggcaaggaggtggcaatttgaccggctagactacattggtcagactggcggcaaagtgcggtcataccgttgtacgtatggcggtcagaccggctacgccaaggatttcatcaggttagagggtaatttttttaattctatggaaagatctaatacgaatgttatacaagggtaatgattatataaatagaaagtatagaaattttttgttgaactaatatacacattttaggaggaaatattatacgtagaaaatttaacattttttataaaaaacactactagaaaaataatttattgccacgaaaaaaattgtagcatcaatgctaaaattgttgcaatagatacatgttgccacaatcttaaaatcgttgctagccgtggtaataaatagcgtggtaataggttattgcaacgatttttatttagttgcaataaattttgttattgccataaaatgtatgtggcaaaaaatatatattgcaacacttcatatcgttgcaataaataactattgccaccactctatgtgtggcattagttctacgtaccaaattaaatatttcaatattaatttatcatcctaactattttcttttgatatcttgtcatggctaggattcgaacccaagatctctccttcacgcgcgctctccatgaccaactcacctacgcatcaattttgtttaaaaatacatataattccatttgagactgcttaactgagatttgaatcatgaatttgagtatttaaaagatttcaaatgaaaaatttaaattgtagatctcatcgagaggtataaatttcatataaaatttgtcctaatccgtgtccatatgaaaagaataagctaaattatgagatgataaattttttattgcaacgtatttgttgatcatggcaatagaaaatagtgaaagtaccatgtattgtgcaaattgccacaaaaattaaatttgtggcgatagaacatgtttttttgcaatagcaatatttttatggcgatagctcatttcctattgcaacaaaaatactgaataaaacaacgattgtaaatcattgcaacaaagtatagttatttgccacagaaaaattatcattgcgatagtacaatatattgccccaaattattttcgttgcaattaattggtggcaatagctcaattatcttgtagtgaaaatgaatgtatatcatttttaaggatggtaaatataatcattactcttgtataacattcgtattagatgatatgtaaacacaacaaatatgctataggtagcataaataaaatcaaacatatactcttttcaataaataaaatattttaaaattttgatgatataaaaataatcttgtcgtggaaaaacctaatgcaacgcactcatgaatataatagttttatacaagtgtctacacttccaataatatgctgcaaatatttctatattccttccacgcctaagagaaaaattgaccatatcttagctattaaacggtcaactaacaacatggctataaatgtgatcaaaataaaaattcaagggcatacaagggagtgaataaaacttacgggtatataagggatcagctaaagttctagggacatgtaagtaattttctcttaaatattttgttcacatagttagggaatatggccagaaacaagcaacaattaattaggtcctcagtgctaattggtttttagaattaacttgcaagcacctcaaaaaacacaactgcaattaatcttttgaattgtgtgtgttgatccctatgtagctaaacatgaaatcacataaataacctatgaaacttagagtggagacgatactaaatggcaacttcagtggaattaggaatgaaaagtagcaaatgtaatatataattaaaaaaacataatgggctattaataacttctctagtaatagaaaattttggcctacttcttcaactgtccaatgctgaaaatgtttctttgattttggtgatttcagcataaacatcttggattaatggacgatctccaggtgactccagagagcattgtagaccaattttcagcatctgtgtgatacatctctccattatgctcatttcatcaacgtcattatctaaatcatggttccttccttcatgtgtataccgtggaatgatactggcctctaaaatctcaacaacattatgtggatatgcacagtccactaatttgtgaatgtttagcccatccttgaacatgtcatcagttggatgctttcctgtgagcatttctagcagaataactccatagctatagacatcgcctgcagttgatatttggcaacccatcccatattctgcattcaatattaacagaattgttttaaaaatattctaatttgctaagctggcttcaagagacagtatatgaagtaagtattcagtccttaaaataacaaggttagtagcgaaagcaagaattcacatgtgaagaaaacaagcttaaatttcttggatgatagtcgtatatgtatttctgaataagatacgcctaaattagtcaatatgaagaatatatagaagcatgaatgttcacctggtgcaatatatccaactgaccctcttggtcctgctatgcttgataaactgttaagccctgctgaagaatggttacagataaagtcactaacatgagcaaccatgtcctcatccaaaagtacattacttggcttcaaatcacagtgaacaagcggaggtgtgcaccagttatggagataatccaaggcagcagcaatgtccgttgctatctgtataattgatcctagacctaatggtcttctttgtcgatgtttttgtacttttggatgaagccaactttctaggttaccattagccatgtactccaaaattagagctttaaactcttttcccattggatcgaaggaggaacatagactaatcacatgcatgagatttcggtgccgagtgttccttagcacctcgcattcagccaagaagttatttgatgctccgatttcgtcaagtttgaataccttaatggcaactggctctgcatcaattttgaatctacctatgtagaccaccccaaatgccccggaaccaaccaagttgtctgatgaaaattcattggtagctttggcaatctcagcatatgtgaacttccactccttacaagactgatcaatttgctttcccaggttatttcgcttcttgtaaagaaatgtggcaacacatatcattaggaatgtagcagcactagcaagtgggacaactattgggatgatataggatttcttgtttgttttggatgatgttgatgtgcaaagtggtaattgcagcattgaagaccctgtgcataattccctattcccttgtacgaacaccttacttgaattgctaaatacaccatatgtaggaaccattccctcgagattgttgaaggataagttgaggagctgcaaagagctgaatgtctcaaaaaattttgggatttcaccagacaagttattctgtgagagatccatctcattgatgcctcttaaactcgtgaaggagtccgggatactcccatttagaaaattcacttctaattgtagggactccaagtgaaggcactcaccaagtgtatgcggaatctctccagataattggttgttggaaatgttaatagagtcaaggttaattaaactaccaatcttagatgggatgggtccactaaatccattgtaagacaaatctaggccttttgaaagtgaggagatcgacaagagctcgggtggaatgattccattgaaggtattacatgagaggttcagcattaccaaatttttgcaccttcctatgcttgaaggtatggccccactaaagttgttctcttggagataaagctcacctaatttttcaagttttccaattgattgtgggatttccccagaaagattattgcgatgtaaccctaggacaaacaagtttacaaggttacaaagtgtttcaggaatgtcccctgagattaagttttctgctagatgaagaacagtgaggttattgaggtttcctatctctgaaggtatggtccctgcaattctgttgttggtcatatataacgtttgcaagcttcctgggagattgccaatggaactaggtaagattccatgaatcctgttgttatccaaatatattgccaccagtttggtagagtttatttttgaggacaaggatgtccagtctacagattcaaataggttggcaccaaggtccaactgggtcaagttttgcaaagcccagaaagaaggaacaacaccagtgaatgtgttatcacggacctctagcacttgaaggttcaaggcattaactaaagaggttggcagtgtgtcggtgacatgggaccgggagtatcactactaaaggcttggacaggagcaatcacccacgaggcctgacccccttgggggggtcgggcccgagggtgacgtggccgccccccctctttgtctccccgaggggtcagaccgcttccgtttcagccctgagggctgaggcgccccgaccccttgcaggtttggcgccgcatgagtgggttaggtgagcgcagcggggctcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaccattacaagcaaggtgttgtatgaagaagggcaaacatgcagattgctaaactgacgcgtggtggacaagaatgaccgacatgaccggactgatactggtcatgtcatcagcagacagccatgatcccacgacgcgcctacttccgacgaaagtggaggtaggtatgggccgtcccatcagaagatgattcggtgggcaaccatgcaaatctccgtcgattcatgaagagaagggaagtcaaattggtaaaaagagaggcaagtccccacacaaaaaagagaggtggtgcatgtggtatccttgagatataaaaggaggaccttgcccactgatgagggggattcggatggggagagctagattgagaaaaaggggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcatctggcgcgtcagatagggggctttgcgtgtgtttttctaagctctcgtattctttcgtgggcgccaagcttttcctgttcagcccaatggccgagcaagcaaacgcgcccaacctttctccgagcatcagcggagacgacggggagccaaacccacgccgtcgagctcgtactccaccgccccctccacgccaaagtcctaggcgggaggaggcgctcaagagggtcgaaggatccgcgacttcgacatccacgggtgatggagaagggcggcgagatggggagcgtcgcatcctcgtctacggtgacggcagcacgccccagggcacgctccaagctgcgggcgcgctcctacgtcacccgcccgtcgtccctgacccggagtctccagcccaacgttggctggacgacgttgccaaattggtcatgacggcgcggcagcgcctagatgctggtggacggacctccgccacaaagacctctggtactgctgccaccggctccgcgtcgtcaagacgaagggcgcggcgagcggcggccgctgttcgccattcggccgccactccttcgtcaacgcctccgacccgggaagatccgcgtggggggccggacgtccgcaccagcatcgagcgccggcgtaatggccgacgtgctgcccacgcaacggagggcgcctcctcgtccagagtgtcacctcaacacggacgcggggatcagccctccgtgcccctggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgctgggggtgacgacagggtcatggcgaatttccttcccatggccctgaaggggcaggcgcggggttggctaatgaacttgccacccgcatctgtccactcttgggaggatttgtgccaacagttcactatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaaaatcgcctccaaagagccccagactaccgcggagctttttcagctcgcggaccgagtggctcgtaaggaggaggcatggacccggaacccctccggttccggtgtggcagcttcggccgcccccggatccgctgctcagacagggcgacgtgacaggaggaggaagaagaggtcagcccattccgacaacgagggtcatgtcctcgccgtcgagggcgcttcgcgggccacccgaaaggggaggcctgcgagcgacaaaaagaagaaggccagcgctcctagcagggagcgcccaaccggcaagtggtgcaccgtccacaacacctcccttcacgacctcgcggactgccgcgcagtcaaaagtttggctgagcggacgaggaagtgggaggaggagaggaggcaggagcgccgtgagggcaagtccccggcggttccttccggcaatcggcgaagtgaggccaagcagaaggcccccgccgaggacatcgatgatggcgatgatgacctaggtttccaagagcctggggccactattgccactgtcgatgggggagcgtgtgctcacgtttctcgccggagcctcaaggccatgaagcgagagcttctggccgcgacccctactcatgaggcgacgcgccgggcgcgatggtcggaggttgccctcaccttcgaccagaccgaccaccccctgtgcgttgcccggggaggacagatcgcaatggtggtttcccccactatttgcaacgtgaagctaaggcgtgtcctcattgatgggggagcagccctcaacatcctttcccccgcagcctttgatgctatcaaggccccggggatggtgctccggccgtcccagccgattatcggtgtgacgccgggtcacacttggccgttaggtcatattgacctcccagtcaccttcggtggatccgccaatttccgcacggagctggtgagctttgatgtggcggacctcagtctgccctacaacgcggtcctagggaggcccgcgttggtgaagttcatggcggcggtccactatgcctacctccagatgaagatgccgggccatggcgacctcaaagtcgcgctcgcttgtatggagcagcgcgcggaccacctcgccgctgcgtccaagcccgagggtggcgacgaaaggcttagcacctctgtccccgccgccccgaggcagcggatgatcacatgcgacgaggtcccggtcaaggaggttgccctgggcgacggcccgtccaagaccacacgggtcggtggtcttctggatagcaaataggaagacgcgctcgtctccttcctgcgggcaaacgctgacgtcttcgcatggagaccggcggacatgcccggggtccccagggaggtgattgagcaccgtctcgccgtgcggccgggcgcaaggccagtccggcagaaagtgcggcggcaggccccggaacgtcaagccttcatccgcgaggaggtggcgcgacttctggaggccggattcatccgcgaggtcatccatccggagtggatggcgaacccggtcgtcgttcccaaggcgaacggcaagcttcggatgtgcatcgactacaccgaccttaacaaggcatgtcctaaggacccttaccccctgcctcgcatagatcagattgtcgactccactgcggagtgcgaccttttgtgttttttagatgcatactctggttaccatcagattcgcatggctagggaggatgaggaaaaaactgcgttcattacccccataggaacttattgttatacgacaatgcccttcgggttaaataatgcaggtcctacttttcagcgtactactcgaatttctttgggtaaccaaataggacgtaatgttgaggcttatgtcgatgacttggttgtaaagacgcgcaaccaagagaccttactctcggatctagcggaaacttttgagagtctccgctccgcccgcatgaaactgaatcccgataagtgcgtgttcggtgtacctgcgggcaagcttctcgggttcttggtctctgcccgaggcatcgaggccaaccccgagaagatacgagctatagagcggatgcgccccccagcaaacttagggatgtgcaatgcgtcaccggttgtatggccgccctaagtcgattcatatcgaggctgggagagaaggcgctacccttatttaagctcctcaagcgctccgggccgtttacttggacggaggaagctgaacgtgccctcactcaattgaaggcgtatctcagctctcccccagttctggtcgcccctgagccaaatgagcccttgctactctacttagcggcgacaccgcaagtagttagtgcagcattggttgtggagcgcgatgaggaaaatcctcattccgcgcatccccaccctgtgctggcttggcccgggagagagcagggaggagaggcccccgagccaaacggtggcccaaggcccccgacgaccggagctggttctctgcccgcttgtcagacggtgccaggtgcccccgacccccaggatggcccggcggccactgcgggaaggccgcacctatcatcctctgaccccgaggctaaccctgtgctgactcgacccgggagagagcagggagaagaggcccccgagccgaacggtggcttaaggcccctgacgatcggagttggcctctcgcccgtttgtccgacgacgccaggagcccccgacccctaggacagccccgaggccactgtgggaaggccgcccctgtcgtcctccgaccccgaggtcgtcggcacagaagacaagtgcgccccgcgaggccacttggacgaagaacgcccctgggatgcggcccctggcgaagaggatcggccccaccgaaaggtgcagcggcccgtttacttcgttagtgaggccctccgggacgccaagacccgataccctcaggcccagaagatgctttacgctattctgatggcttcgaggaaactgcgccattattttcaggcgcatcgggtaaccgtggttacgtcttaccccctcggtcaaatcttgcataatcgagagggtacaggacgggtggtaaaatgggcaatcgaactttctgagtttgatttgcactttgaaccacgccatgctatcaagagccaggcccttgccgattttgtggcagagtggaccccagcacccgagcccgtctcaatccccgaggctagctccgacccctcgcagctgcctcacaccgcccattgggtgatgcagttcgacggctccctgtctcttcagggcgtcggtgcgggggtcacgttgacctcgccgagcagagacgtcctcagatacttggttcgccttgactttcgggcgaccaataatatggcagagtacgagggactccttgcgggactcagggtggcagctggactggggatccgccgcctccttgtgttaggcgactcccagctggtcgttaaccaggtctgtaaggagtaccggtgctctgacccgcagatggacgcttacgtgcgccaggtacggcgtaaggagcgctattttgacgggatagagcttcggcacgtgcccagacgggataacatggttgccgacgaactctcacggctcgcttcctcgcgagcccagaccccaccgggcgcctttgaagaaaggcttgcccagccgtcggcgcgacctgaccccttaggggagacggacgcgcctgaccggcccccgaggcccgtcggagtccaggcctcgggacccgaggggagcgttcccagctcccttagattgattgcttggatcactgagatccaagcatacctcacagataagactctacccgaggatcgcgaagggagtgaacgcgtccagcgcatttccaaacgctacgtgctggtagaagggaccctctatcggcgcgcggctaatggaatcctcctgaagtgcattcctcgggaacaaggcgttgagcttctcaacgatatccatgaaggcgaatgcggagcccactccgcctcgcgcaccttggttggtaaaggctttcgtcaagttttctattggccgaccgctctcaatgatgcagtggatctggtccggcggtgtagagcgtgtcaattccacgccaagcgaatcaatcagccggcccaggccctgcagaacatacctctttcatggccatttgctgtctgggggctcgatatcctgggaccgtttaggcgggccctgggtgggtttgagtacctgtatgtcgcaatcgacaaattcactaagtggcccgaggcttatccggtcatcaagattgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacctgcccaccccagaagcaatggccaagtggagcgcgccaatgcagaaatcctcagagcccttaaaaccaagaccttcaacatcctcaagaagcacggcaattcgtggatcgaggagttgccagcggtgctctgggcaaaccaaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgattacttagaggagcgaaggcggcgcgcggccctccgagccgcgcgctaccaacagagcctgcggcgctaccatcagcgccacgtctgggcccgatcactctgcgtcgacgacctcgtcctacgccgcgtccaaacgcgtgctggattgagcaagctctcaccaatgtgggagggtccgtatcgagtgatcggcgtcccccggccaggctccgttcggctggccacgggctacggcacagagctgcctaacccatggaacatcgaacaccttcgtcgcttctacccctaaggaggatcaggtgtcaggtttcgggctcgggccaaccccgcacccccctcgggcgtgcagggttggccgggggctaccacatatgcatactcttatttctcttatatctgtatttcaataaaagcattttcaatctcctaaaggctgtatctgtactgttgtttccttttgaagaatcttaacttgaaataggtcactcgtgctcaatcctgccctcggaggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctagacacgtggatctccccaggcactagccccgacccgtgccttttgaggactgggacctgggcacgagcccttaatcaagctaagacacaaaaggaccacgtcacatatcatcctcatctcatacacatagcaaaatgaaattgacacaaaaaatttcttcatttttgattgcagattaagttaatttatacaaaaaagaggaccgaaggccttagaaaaaagaaaagaagaaaactgaagattggcaggggcctaggggctcaatccgacgcgcccgggtcgccagcctcgtcgccattgccgcccactccgccgtcatcgtcctcctcgtcggagttgagggcaaacgcaagccgaggggccgaaccctcgaagctctggacgatgtggtcggcagcgtcccggacctgtgcgcgcgcgccgtcctcggtccagggagggaactcgtccagcgctgtccatggagagaagtcgggattcctgacctggtagctcgccagtacaagctccaccgctccttgggcgaggtccctcgaggataacttgatcgtcctctcgagctcctcggggagacgttgaagagttccggccatctccgagaggcgctgggcgaggcccccctggttggcggcgtacttcacagtccgcccgccccagaggcccacctgccggccggcgcgatctagatgggagacggcgtcccgaagcatgccgggccctacctcgcctgccaagcggagggcctcgacctccccggcggacgagtctagcgcgccctgcagatcggcgatggtgtgttcggcagctgcgaggcgggcggctaagtcgctttcgcccgcggccgccccgccgctgcgcgccctcgcgtccagctccttcgcccgcgcctcgagctcagcggcccgctggttcagtacggccctctcggcgcgggcaccttctagattacggcgcgcctgctcctcctgcgctgcctcgcggagggacaggctttccgccagccgttgcgacgcggcctcggccccctcgagagctcgctcccgcttagtgagcgcgtcctcgcggaggcggagtgcggactcttcttcggcgcaggcggcctcgtgctccgccagcgttgcctcccggatggcaacggcggcctcgcggtccgccaggtccctctccacggcgcaggcacgctcttccagcgccatggcgcgggcctcaagggtttcttcgcgccgccgggatgccacctcggtctccgctgcccgccgttctcgggcagcggcagcgtcaaggaccccttgggcggcgtcgagcttcttccctagctctgcctcccagctcccgtattgaaggcggagggtgtcctgcgcctcgttcatcacggcggtggcgatgagggcagccccccgctcctcctccatctccttggcgatctccgccagcaccttcttacgggcttcaagctccgagacgtgccggcggtgagccttacggcccacctccaccatggcctccaccgagcgtcgcccctcttcgacacgcgcccacgcggcgtcgagctccgcccgctctgcttgcagggcctccacctgggcacttaacccgtccaacaccgtggtgttggcggcggccaaggcctgcagaaggggctccgcgctcagtggggcaacagaaggtatggggaaaagccgcctcggagaggatgccgcgcggctcggcccaccgatgaacgtgccggactcggggatgtcctccggacctggttggtcctgagcgtcgcccgagggggtgggcccaagcgatacgcccgcggcctcgtcgccagctgccccggaagtcgtcgcctgagcgtcgcccaagggagagggcccaagcgacgcgcccgcggcctcgtcgcgagctgcctcggaagtcgccatcgcctcgtcctggcgagcccgggcggcctcctcccgagcggcttcctcggcctggcgagctcgggcggcctcctcccaagcggtttcttcagcctggcgagcccgggcggcctcccgagcggcctcctcggcttcccgtaggcgatctgcggcttctcgccggtcagattcccgcctccgggcctctgcggccgccggatcctcgacttcgggctggccggccttggaatggtgggaggaacgcgacggggtctcactaaaacagaagaaagatcagaagacaaacaaaatgggtgactgaaaactcgcgttgagaggatgaatacagccatgatgggcgtgggacaaacctgcgagggggtcggttaaacgaccaccttggaggggaaatgaggtttccccgagatggttctgtctcccccatcttgcggagccacttcttctttcgctccccctcgggctgcgacgtcggcgtggctccctccgggcgcctgctgttggcacgcgccgccccgccccctcggggaggagatgggggaggggatcctccctgcttcctcttcccccgggcgtcggcagggcggctgctccccgggcccccgtcgcggggcccagaagcacgaccccctctcggggtagattgttcccccctgcggctcccgcccgcgccctcgtggcctcgaggagcccgctcctccgacgccccgatcgcctgcataatggtcaggatggaggcgcggtctggatcgctacagagggggaggactccttggggaatgagggatgcctccacggagctgagattcagcacccgttggactactatcttgaagtcctcaggagcccagtcccatctgactccctgatgggtcctcatgtagtcttcggacccggtgtactcccaagcgccccgggcgcgtcgctggagcggcgcgatccgacgacgaaggtagtcgccgtacaccatggcccctgtgagcccctgggatcgcaggcccgccaggcggtcgaggacggcgtcatagccatctcccagatcaaccggagcccgccagctggaggcctgcgccgggggctggctcggaagtcggaggcgcgcttcgtctgcgaggggggtgtagaaccagtcgctcttccagtcatcccacttcttgcggaggacgcaggggatgtagcggttcagcaccggcccccgcggctggaagtagcagccaccaaccaccgacggcggcgacaccgactggacggtgaagaaccaccggaacagccgaagggatgggcgcactccgatgaacatctcgcacaagtgcgcgaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagtctggcgccgggtgtccctcgcccagcatgactatctcccggccggtggcaggttccggcatgaagcggcgcggcagcccggcctgcctcttgctcacaatgcgggaaggcggcagcacgctaccgtcaagcagagcagagccccgtgccatgacgccggaggaggaaatgattgagagcgagcgcgtgtggcgaaggtggggcacaggaaagaaggagttagggcgcaagtaggcgaagacaaggggaataatggcgaaaggaaggaagcaaatcttttcctcgatgtctttatacccttgccaacgctgtgcccggctcctcgcttctcgcgcccactatttcgctccctcgtttctcgcgcccacgcttccactaatcccattcgcccgcttgcggcgcatgaggtggatatgcggttgtggcagtcgagatagatcatatcgtgcgcgcgttaattacgctcgccgaccaaagcgccatcgccatatctccaggcaaaacgaaccggctcgtcccgattcgtgcaatacttgagtaatgtggcagtcttgaagaggccgctcattattcacagtcaagtcaccgttgccggagtgcgtgatttgagaccgctggatttctgcccaactgtggagatcggtcccacctgtcaccagacttttggaagtggcgtcacacctgaccgcttccctcgaagagagcgatcgccctggcataacgccgggggctactgtcggtgacatgggaccaggagtatcactactaaaggcttggacaggagcaatcacccacgaggcctgacccccttgggggggtcgggtccgagggtgacgtggccgccccccctctttgtctccccgaggggtcagaccgcttccgtttcggccctgagggctgaggcgccccgaccccttgcaggtttggcgccgcatgagtgggttaggtgagcgcagcgggactcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaacattacaagcaaggtgttgtatgaagaagggcaaacatgcagattgctaaactgacgcgtggtggacaagaatgaccgacatgaccggactgatactggtcatgtcatcagcagacagccatgatcccacgacgcgcctacttccgacgaaagtggaggtagatatgggccgtcccatcagaagatgattcggagggcaaccatgcaaatctccgtcgattcatgaagagaagggaagtcaaattggtaaaaagagaggcaagtccccacacaaaaaagagaggtggtgcatgtggtatccccttgagatataaaaggaggaccttgcccactgatgagggggattcggatggggagagctagattgagaaaaaggggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcacagtggaccatcaaaatgatttccttctaggatcaatgtttcaatgtttggtagagtgtatccaatgttggttggaattctcccaaaaaggttgtttacccctaggccaagataagtcaaagtcgagattgtgtaaagagatggtggaactgtgccggtcaaattgttataagccaagtctaattcttgtaaatatggaattttggttatgctatctgggatatttccttgtaggttgttttgagcaactaacaaggaagatagggaactcagatttcccaatgcagctggaatacctccaaagattgtgttgtttgtaaggatgacatgcagaatcggtgcggatatcagtggggcagaggggattgaccatctaatgaagttattacttgagagatctaaggaaagaagagatgagctgttgaagagggcagaagggattaccccaccaagtttattttgtgacaggtcaaggtatctgagtgatgagcaattcgctaagataggtggaatactaccagttaggctgttatatgcaaggacaaccatggacaatgatgttctacttcccaaagatctaggaatactacccacaagcttgttattagcaagcaaaagatatttaagattaggcagtgaaccgatcccaggagggattgttccattgaggttgttatggctgagagcaatttcttgaagaagtgaacaattagcaaggtttgatgggatctcaccttcgatgttgttgctccacatgtcaatgacctcaaggtgggtacacgatgatatggtatccggaatcatccctgtgatggaattcatgcctaggtttaggttcctgagctgggttaagcggccaatctcaggaggtatgtggccactgatttggttatccggcatgtaaattgttgtaaggaagctcaggtcggcaatgcaagggggtatttggccagtgaggctcagtgatttaaggcgaagagcgacgacgcgagctgcaccctggttgctgcatgtcaccccatgccaatcacagaatgcaagtgactcttttctccatgagtccagggctcccaaaggatcagagaactgtgatctgagacaaaggagggcttgccggtcggcttctgatgtgttatgggttctggatggtgctaatgaacttacacaaggacatgagctgacgatgaggatgataagtatcagaacaggttgtgccaataatgctttctgggctgctgctgctacaggcatcttgctctcccttttgctagctatagcagattccttacagattttggtttgatgaaactggaacatgctggcatttatatagagcacaagcctagtgaccactatgagcgtgtgagagggggcagacaagaatttgagtgggtgatgcagaagagaatcaatccctggttatattggtcaccagtgacgacacaactttgtttgtttggactaaaatttctctgtaaactgtgggtgtgttcagctcatatactttgactgtttccataaagcaacttttagaggcattttgaagtggcaggttgatgtcattgtcagcgtagagtcataatccaccacaatgcaacgcgctcttgattcagtacacaggtcagtcaaaaattcactatgtggtatatatatcacttagatggatagttattaggccacccgtcatatgtttagttgtctactccccgtatgtgatcattggcatccttcgtacgtttggttgtttactacttctatgtttatagaagaaatcccttatatttatagtgctcattagtacaaaataattgatatagatttttctgcccgatatgtcctaaagtttcataaaagatgtgtgaaagataggggttttcgtacagaaaaatttttatgtagtagtgagatgtataaaaatttttagtataaatttgatagtacctgttaataccggagttaccaaatattacgggggaaactcttgataccttattaagtacggtataatcactctaaatatttgggttgaagggagtagtagtacagttagtcgccgactattacatgcccttttttagaatgacgacgaagaaaatagttaagctgccaagtcgccgtaactgtttaattagtgcacggaaaacgaacgccacaaattaaagccaaagaatccaccagttgaccctgagtttggccggctgaaaaatacatccatcatataaacaagtgactcgaaacatccctggtattggcacaatggcactgaactgcagcatgttgtggttttgcccatctctgtcgatgccctggacttcaaaaatttacagtccacacttatgctagctaagtgtatgtgcgtgtgtatatatatatataaatatatatatatatatcctctaatcgactttgtcctgcacttgtgcttcgttattctgaaagctgaatcacaacaaatttcctagacaaattaaattagctagctataattaattgagatgaacacgacaagtttcttgctccagattctgctgctgctagcgatggtgattcttatggcaatggcaatggagcctgctgctccagagacaatggcgcgacgatctcccggtaagttttatttgattttctcatgctgcacaggccacggaatctgaaattatttgtacgaggtttgctccagttcaacaaaaagtatctcgaggtatcggtatctcacgataccaaatcgtttccgatcgttggatctagctaagaaaaatggtcattattagatctaacgattgaaaacaggaaacgatttggcaccgtaaggtatcggtattttgaggtacttttggttgttatgaagcaaatctctattcgtatgcatgttttttggctgtgttcttccctcaagattcatgacctcatctatctcgttttttgtgcctacgctttctaaactactaaacggtacgttttttttaagtttctatatgaaagttgctgtaaaaatcatattaatctatttctcaatttttttttaaactaacacttaattaattatatgttaattcgtcacttcgttttgtgtgcaaagcagagcatcttgctgccatgtgttcattcatgtagagcaattttggaactttttcatttgtcaaaaacttttggcccacttgctttgcattgcttcatgtctgcgtcattaattttagcagcatgcatgtagatctatgtatttatcataatttaagaattgaagtgattgattattggtctctgaaactattttgattttgggatttctgtgcaggaaacgtgaatgctaatcacgacccgtccaaacaatctggttctgcagtgcaccccctcaatacaccatgcaactacccaggacaagctggttgccctcattgatagttcgtgctactcagaaaaagatgaaattaaataacagattacaacaataagcgccaatacatgagcgtctggttatcgacctcgatgtgtccaattaaaccttgtactcgacctgattttcacctaatgaacgagtgctttccgctacatattttccctattttttatggttgctacaaatgcatggatgcatattacacacatgtcgatcagatcgcgcgaatgatgagaaataatttcgtgcaaaaattaaatacgggaatgcggcaattctcgtcaaaccatgcaagacctatcaaattttgtttgaagaaatcatttgggtgtggaaaatctctctcaaggtgatcctccattctgtgcaaccatacaggtgaaattcgtagtcgatggagagaagaaagacaacaagatcaggccgcgcagacgtacgatcagtgaggaatgatggcagtgcgacggcagccaccattcgttgctctcctcagcagggttagcatgcaatgcattcccgatgcctcacatgtccatctacgaattttttttttaataatggaatgaaacatttcggcctttgctcatcagagctacagctaatgttgatctacgaataaataccgaaaaagatttatcactgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttgaggtgcttaattaacacgcagccgtcgaccctagcgtgaagggcgacgttcctatccatcgtgttttcccacatggtatcaaagcgctgaagttagatcccatctgccatggctagctcctcctcttgcacctcctccacaacaaatcccttgttcggcttccatgtctctgagaagttgaacaagcagaattatcagctatggtgtgcgcaagtgctgactatgattcgcggagcacgccttgaggggcacctgaacggcaagaccgtcgctcctatcagctatggtgtgcgcaagtgctgactgcgatttgcggagcacgccttgaggggcacctaaacggcaagaccgtcgctcctaccacccagatcgaagctgaatagaagaaagaagatgacaaggcgaaggccaagatcaagatcgacaacccagcgtatgaagagtggtttgctgcggaccaacaggttctcggcttcctcttttcatcgctgtcaagagagatactatcccaggttgccacggcaaccacggcggcagaagcatggacgatgatccaatgagatgttcaactccaggacacgcgcacgttctctcaatgtgctgttgtccctcaccagcactaggaaaggaactcagacaatctctgagtacttcgccaagatgaactcacggcgtcaggaaaacaatgcgatgctgaagaactaactgcttttattttgaatggattagatgatgattatgattctgttgtatcggctctagcagccaaaactgaacctattactctgtcagagacatatgcacaacttctgaattttgagaacaggctgaacctacggtgagaaggcaatctgacggccaacgcagcaggacgtggtcgcggcaacactccaagtaaccgcggcggcagtggcgtcggccgcggcaacggtgctcgtggtggcttcaatggtgctggtgccaactccggccgtggaggccgggtcatggacaacagcagcactccggcaacgacactcggcctgtgtgccaggtgtgctacaagcgcgggcacgttgctgcagattgttggcacaggtacgacgatacctatgtgccagacgagcgtcatctcgctgcagccgcctcctacgcctatggtgtcgactccaactggtacatggactcgggggcaacagatcacatcaccaacgagctggacaagctcaccgtctgcgacaaatacaagggaaatgatcaagtgcacacggccaatggagcaggtatgaaaatcgagcacatcggtcactctttagtgcacacccccatgcgcaatcttattctcaaaaatgttttacatgttccacaagctacaaaaaatcttgtttctgcatctaaacttgcctatgataattctgtattcgttgaacttcatggaaaacattttttggttaaggatcaggctacgagggaaacaaagcttgagggaaggcgacacaagggtctctatccacttccatctccatctcctccaaaggcagtctatggtgtggcaccatcttttgcaacatggcacagtcggctagggcatccatcgagtccaatagtgtctaaagttattagtacaaataatctaccttgtcatgacaaggctagcaaagagtctgtgtgtgatgcatgtcagatggccaagagtcatcaacttccttataataaatctactagtgtctcgcaatttcctttggagcttatttcatctgatgtttggggacctgcccccatttctgttggtagaaataaatattatgtgagttttgtggatgattatagcaagtttacctgggtgtatctccttaaagcaaaatcagatgtttttcgggtctttcatgaatttcaagcccttgttgatagaatgtttagtcaaaaaattattaccatgcaaactgattggggtggcgaatatgagaaactccattccttttttcgacaaataggcatctctcatcacatttcatgtccacatactcaccaacaaaacggggcagtagaacgaaaacatcgtcatatagtagaagtgggtttatctcttcttgcacatgcatctatgccactaaaatactgggatgaagccttcctagccgccacatacattattaatcgagtcccaagcaaagtcatttcttttgaaacacctctagaacgcttgttccataaaaagcctgattatcctgctcttagaacctttgggtgcgcctgctggcctcatttgcgtccctataataatcataaactccaatttcggtccaagcaatgtgtgttcctcagctatagccagctccataaaggctttaagtgccttgatatctcctctgggagagtatatgtttcacgagatgtgatttttgatgaaacagtgtttcccttttcacaattaaaatcaaatgcaggcgcccaactaagagcagaaatagccttgcttccatctgatcttgtagcgcatgatcaagggggagagcaacagagtgatcatgtacttgattttcctaatgccactaatggtttggatgattcttccagcagtacagatttttgtggtacagatgaacgcgtggacctaacacattcggcaacggcatcggatggagtgaatggagcgggaaactccactccgggatcggtgcctgacgtgaccagggagacagcgcaggcgccggaacagcagcaacatggcgaggatgctcaaccccactcagccagcgagacgtttccaagcagctgcacttcatcggctagacctgtaccacaccagaccgtgcctgcactgggtcatgatctgaccggtactagtgctgacacttccactgatggcgttgctgtgcaggacatcgagcaaggagctgaaggcgagctcgacttaaacagacccagaacaaggctacaaggaggcatcagaaaacctaaggtgtataccgatgacactgtaaggtactcctgcttcacctctacaggtgagccctggaggataaacactggaaggatgcaatggatgcagagtatacagccttaatgaaaaataaaacatggcatctcgttcctcgataggaaggtaaaaatattattgattgcaaatgggtatataaggttaagagaaaagctgatggaagtctagacaggtataaggctagattggtagcaaaaggttttaaacaacggtatggtatagataacgaagatacttttaaccctgttattaaagctgctactatcagaactgtcttgtctatagctgtgtccaggggttggagtctacaacaactggatgttcagaatgccttcctacatggagttctagaggaggaggtgtacatgaggcagccacctgggtatgaaaattcctctaaaccagattttatttgtaagttggataaagccttgtatggtctaaaacaagcaccaagggcttggtatgcaaggctaagtggaaaattgcaacaattaggctttaagccatctaaagcagacacatctctgttctacttcaacaaaggcaatgtaaccatgtttatcctgatatatgtggatgatattatagtagccagttccaccaaggatgcagtgccagctcttctacatgatctaaaggaggattttgctttgaaagacctaggagagcttcactattttcttggcattgaggtcaataaggtaaacaatggtttaatattgacacaaggtaaatatatatctgatttgttgaaaagaacaaatatggcagattgtaaaccagtaaatacacctctatcaactacagaaaagttgtctctacatgaaggtgatttactaggacccaatgatgctactcagtatagaagcatagtaggggctttgcagtatttaactctgactaggccagatatatcattctctgttaataaggtctgttagtttcttcatgctcctacaacagttcactgaacagcagttaaaagaatcttgaggtacctaaaatatacgtcaagtttgggtattaaatttaatagatcagtgtttactcttgttagtgcctttacagatgcagattgggctggttgtcttgatgatcgacgatctacaggaggatttgctgtatatcttggctccaaccttgtgtcatggagtgcaaggaaacaagctacagtttcaaggtccagtacagaagcagaatacaaggcattagcaaatgctacagctgaggtaatgtggattcagaggctgctaaatcaacttggcattcaagcaccaaggtcagcgaaaatttggtgtgataatattggagccaagtgtttgtcagctaatccagtttttcatgctcgcactaaacatatagaggtggattatcactttgtcagagaacatgttctgaacaagctgcttgaggttgaatatatttcttccggtgatcaggtagctgatggattcactaaaccacttgcggtgaaacaattagaaatgtttagaaacaatctcaacttgagaagtttagattgagggggagtgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttcaggtgcttaattaacacgcagctgtcgaccctagcgtgaagggtgacgttcctatccatcgtgttttcccacaatcaccataatatctaaggatttatcgagtacgcagctaggaaatcgagcagggcttctggatgatgtggctagcacgcgagggcccttttatagtcacaccttttgccattttcaatatgcttcagccttcagcaattactgatgggagaattggcactggtgggaactctggtaaggagaattgccattgtccatttgtttatatacagcccgttatgtactttgtattttcaatgttatggcatgttaaaaatgttattatccacaatgtggacacatctttaataccttttttcaccagcaaattaaatcagagtaaacatattacacatgacaccgtagaaaaattactgcttgctggaatgcagctagaaaagttcagcaagtaatgaattgacacaagtttttttactgttgctatgataatttgttaatcaagacctaacagtagcaacatgatccaggaggatagtaatttgacttgaaatgggaggttatataggatagtgaacttttgtttgaattggaaatgggaggggaagggaatgggaggacgcggagtgagaactggaaaaaaaacaaaaagaaaaggacagatccgagttatgaatattccctctgcttcaaattatagcaacatggtactggattggtatatattgagacaaaaggtaatagcatgcaatgccttatttgttagagtaaaattcaatttagcccggttcttattgccaatgtggcttatttatgaggcaaaattgctacatgacactcaaaatttgtgtaatttgctgatagacattgaaaaaacgtgtcacggctgaaagacatagtaaaaaactagtaatttactagaggacacttttggctgaattggattgataaattcttaataaagacgataatgtccctataagaccacatacttcaaacatgatgttagcgtaaaaaacttaaaaattatgcaactctaaatttgccatcacccaagtacatcacaagcatacattgtattccatcttcgttgcagtctcggctcaaaaagatttggactctagtggtattcttgtctttttaaagaatttctctctccaattgagctgaaagtgtcctgtcggcaacttaccggcttttcagagtgtctttcagccgtgacacgtttttacgatatctaccagcaaattacacaaaattacacaaaatttgagtgtcctgtaacaatttttgcctatttattagagtagatttacaaaacttgagccactgcgctaattcatttgcataggttggtactggttgctaggtgccaatccacagcaccaagagtccaagattcccatgttcggtttggtggaggccttggccatgagcagcggcgacctgacgttatcaggatcattgtcgcattgctgcaatatatataatcctcgttttgaagggaacctctccttttgctttcttgcagctagcagtgccgctcgagctgcagcaccaggtgacctgcgattttgcctcgattatttgctgccaatttttcactccgcatcgtcacgcggtctgaccggattcatcatcttctgtccgtcggtgttttcgtgcaatagggagtaaaggccgtgttttagttcgtgtgccaagtttttttaaagtatacggacacatatttaaagtattaaacgtagactaataataaaaaaaattacagattctgcttgtaaaccgcgagacaaatttattaagcctaattaatctatcattagcaaatatttactgtaacatcatatatcaaattatgatgtaattaggctcaaaagattcgtctcgtaatttatacgtaaactatgcaattggttttttttcgtctatatttatagctctacatatgtgtccaaatatttaatgtgtgtccaaatattttatgtgatggaatttttgaaagtttgaagggatctagacgctgccaaaatctggctgtgtgatgggcgtatggatgccagaggccgtcttggaggatgcgagcgctaagtctggtcaccggtgctacctgatgtgtgagcaaggagaggacgacgtactggagcgagatagctgcgaagatgcatggttgcaatacatggttagaaatcctggtccaaactgaaaacacaacacttgctatatatgcatcggtccaatatgaaaatctgatgacaaataagcatggcccaagatgaaatttactctatttattatatatgtttaattgtactatttgtcgcaagtatattttaaaaaatattgatggatggagctttcaaagtttaataaaatattgttaaaaatgttactaagtttcccaaaaaaaaaacgttactaagtttgagaggaatgactgatatatagaattagaggaagtactaacaaaattttgatctaaacattaagtatttaaatatttatatatgttcggagggagtagtacagttagagtctgtttagttgttgcctaacattgccataactcaatttgctatagatgtggcatggcaaacaatttgtggccacaagtgtggcaatgtttggctagaaaatgagtatacgacatgtaagcccatgaaacaaaaaagtgtggcttgccacaactgaaacaaacaaccaaacgctaagctaacaatctgtggcatgcttaacatgtggtgtggatgtgtggcaccaaaccaaacagccccttttcaccagcaactaaacaaaacaaaggaaaattttgttcccttttttattcctttgacaaaacaaagaaaattacgctgccaagtcgtggtaactgattaattagtacacgggaaacgaacgtcacaaaggaaaagaatcttccagtaggccctgcgggtggccagctgaataatagagccatgcatgcatgtaaacaagtgactcgaccttccctagtatatgacactgatcagaatgtaattactttgcatgatgcttttgcctaactctgtggatgccttgcacagtccacacttatgctagctaaagtgtatatatatcctctaatcgactagcatggtagatatataacccgcatgtatgcatctttgttgtaaacttgtgcacttgtgcttcctgctcctctgaaaattaattattcaatcagcacaagttttcctaggcaaattaattagctatctaactgattaagatgcatactactactactactacaagtttcttgctccaaactctacttctgctagtgctggtgattcttccgtccacaatggcggacattgcggattctactgctccaatcggttgccagagctgcttctgcgatgaagccgcaacaccgtcagcaaacgaagggcagatgcagttgtcgattcaggctgcaacaggcagacgagggcgtcctcctttcatcccccattgcgatggaaatcctcgtaagttcgttgcttcatgaatccatatgtatatatgtatctgttttctcatgccatgcatccgtgtacagcagtttcgaaactgtttttgttcgttaataattcttcttgttttatgtttaattagcgcgtggcacgtagaccaaggtatattcatttggcctgtttagtagggtttcaactcttaaatttaactcgaatagttaagtttggagtgaagttgtcgagcagcataaaccatctctacctgtttagttcattattttgtgaaagtactgtagcccatttcacaccattttggatagagcggaaactatttggttggactctagttctagaaaagattgggctggagctcaaactctaccaaacaaatcttgaagtataattctcagtgcatggacctttgcttgattttggagttcctgtgcaggaagggtgggtgatagctctgatccgtcccctctacctggttctgcagtgcaccctcccagtacaccttgcaactacccaggccaacttggttgccctcattgatatatagttcgtgctactcagaagatgctgaaagtaaatatcagacttattacaataaagcgctcatacatgtatgtttggtcatcgatctcgatgtgtgaaaccttgtacatccctgatttttcaccgaacaaacgagtgctttccgctacatattttgcctatttttgtgatactatgtgtacatgaatgaatgttaccatggaaattgtgagttgtgacacgacggatcacccaaataccgataaatcacgccaatcgaactatatttgtattatttagtatgaaaatctctagcttgtgttgtttctgttagattgatctctggccaccgagtcagagaattgcgcaatcacaccaacgtgctcctaacgttttgagtaccgattccctcggtctcgagcgcatgttgctctctctcgcgcgatgatcggacacgctatctacgtaacggacccgcccccgatcccctcaacgcacacacatataaagggaatgatatcccgttggtgacgatcgacttacggcatacccaaaaccaaactgtcagactatcgatcttaaggtgcgttggaggggaacgaagggcgaattccattgccactaccgcacagtgatggagatcttaaggtgcattgaaagggaatgaagggcgaattccatcaccattgctgcacattgatctccatcactggcggtctactaccagtacaccgacacatctaatggcttgatcaagatccgatcaataaaccaccaaattccgcataagaaattaggtgatcatgcatagcctaagtgcatgattttaatatttaattcattggtttgacaatccttttgtccttattgccatagttacaattttgcatcaagaccatttgatcactagtccgatctactatatagtatagggtagtatggtctaccgtaaagcaacttaaaaaacaaatatggtgtcaacatcatcttgtccttcatgatctatcattgcatggttcgacaattcttatctccttattgccatagctacgatgttccatcaagacctttgatcgcttttggttttcctccacttatacaatgtattataatgcaatgccgaaccttgtttgacaccttaaatttcgttggacgaacgcattagggtgtaagtgaaaaagctctcctatctcggtgatcgatctttcatgggaaaaaaagggagactctcgattatgtgctatcatacatgtgaaatatttagtcgatcaagggaaagaaatcaagagcaagccacggacacatgattagtagcaagcgatggcaccaatatcactgctgtaatccagcaagatagatagccacgtgattggatgcaatacagtcctgatgcctcgcatgtctatataaaattaaactctggaaacatttatcaccacaatatcaaggatataccgagtgtatcatcacatgatacaactttgagtaggaaatcagacatgactccgggttgatgtggctatatagcacgagggcccacttacagtcacaccctttcgttttttattgtttcagcaattggatacgcatttggcactgttcaagttaagctacgatatgacgaagtgaccaggtgagtgagaacgcataaatgcaactaggcgtgtgtgatgagaatgtgagacgcatatcaagcgtgcatgatgttattatctcctagttaatctcttggtaccaagtattgttactagatggtaccaagaatatgttagctcatcaactcacctttggagcggattagattctggtagtgacacttgcctgttttggcacagcttcagctccagcttcatcacctctagagtcggaacccaaccaaacagttttagctccatatctgaaatgggagcagagctgggtttaggaatctctataactctactccagactcaactcctaaagctaaatttaggagttaaagctctaccaaatagtcccgaaatcatacgtaaaaggcgtatgatggagtgatggatggaaatggaatcgatcgccagctagttcagtacaatcacacaagatccatcgcaattcccccgcaaaaaaaaaaaagatccatcgcaattcaggatcgtgccgcgccaccaaatttgttctccaagcccagtcgtccggcccactctttctgtatagtctatctggcccatactctatccagtccagttctatctggcccatattcgctttagacagccacacttgccttggatattcagagctcccctgtagcatcatgtgtctgctcggttctccaagtcaatccctcaaagttggctacttcacaattaatgacagtacagtgtgctgctctaatcacaaaataattctataaatatcaagaaccaatatgttcttgataccatgaaggtgcgcgagaatatctgacgaagaccagagctcaactttttggaggataaaatatgcctaatgcctcacatacctaatcaatatattatatacgtactctactaacatacaaaacatgaaatgaccgaccaacaaacacgtctcaatcgatcagatcctaggtaagcatgcatgtagttcttttgtgaggcagtcctaaatgtaagggctataacgtctgtgtgttatttctcttctgttatgtatggacctttttctatggggaagggtatcttttccacataacatcaagctaccaattaatgcagtaactacatatctatattaaagtaaataattactcctgtacccactggcaattagatgtcctggtgttctctcacgcatgatctagtattaccccttcgttattatagtgtagtaatcccttcgttattatagtgaagtaatttctttgttacaaaaggacagttgcttcataaagtcaaagccatatcaataattggctgtaccagtcacaacaggcagtaatgagatgtagcttaataattggttgtaccgtgcttgatagcaacgatgagcgcggtggtgcttgaacacaaggatgaagagtataatgcacggtttgcggtgctctataagcattttacattggtgttgtgtgggagatcaatcttatcttttgagataagaaagctcgcagtagaagtctcaatgataccatgaagtttccagcccttgctgaatttacacatacaacctctctctattggcttgcaccaaaaggccaatttgtgttgtaggcatgcaaacttggtgggccaaaagatcctgatacctcacaatcctagccgcctctggtataaaccaatgaaaaacattattctccttcaaagtgtttttatcatggaaaatcaaatttgctttactcgaggagtatgtaggtcacccacctagttatgtgcttggagagatagctgtctgttactctgtttcatggtttacctatatcagtcttgaaatgttgcaagtgaataggactgatcagcatccgccgtctgatcaatgatttgtggtgtagattatgcaggagtccttgcctcgtgaattaggggcctggaaatcctcacggcccaataggcttctacttatgcacctcttgtagtcatatggttggagtccggagaaaggagatggtatcattggcaatagatgcagaggcggaggaagaggttaactccagacgatttcacgaggctctgtggctgggatatgcctctgccgatggacacgaaggcaacgtcggatcccagttggtggatgccgtgttggtgccaccgatgcacctgcagataccgtcaaatcctagtatttttcttgcttccattgctacttttctgtggaggacactcggactttatattattgttgctaattgaaatgaacatatcaagttaagtggttcacttactctccccttggccgaatgcaaaagtcatgtggtctcttaggaggcccacctaaaaaaataaacttatttttgtaggcggatctattaaggggccacatgagaaaatgtatttttcttacgacccgtgaaacttccttcgaatataatttttgcaggcacgacctgttacaacctgcctataaccttcgtatagaaaaatcgtttctgtagtagtgtatactgcgtgcttcaggaaaagaaaaacccaccataattgaggcagatcctcggcggggaccctgccctaacgaagaagttggttatactcgatttttctatagatattgaggccacttaattttcgttaccaaagcttgagctgctatagaaacatgagttgacagtagaaaatcaattctactgtatgaacactgtcttaattttcatgcaacaaccaactataatttactcggctaaacttagtttagttagtggaaagcttgattgagcataaacgtattttactcatcaagccatacacaatcactggtggagaaaccatctttgatcggtcggcccaattccacaatagtctcggttccaataaaaaccgggactaaaaagcatctttagtcccggtttaaaagctgagggttaccaaccgggactaaagatcatttttacttccggttgaagaggttgtcaggtcgtgtcaggccctaattatttttagtcccggttggtataaacaaccgggactaaaaattaccccaagccgcgtgcaatgtttatctcttcgcgtgtccattgtctgaccctcctcctcagtcttatccttaacttttcttcccctccacttgttctcctcctcactcctcctcttcctcctccccttcctctctcccctgtcttcctggcggcagcaggcggtggccggcgcggagggccggcggcggataaggatgggttttgaaccggtgttaaggatgggttccccagcagtgataaaaactgccttagaaaaaaatattttaaagcttatctttcttcagctagtagtttttttttaacaggacttgtactaactgcctggtaaattgcttcaggataggttttctctcgtcgaaagatatatattcaaatactccctccatcccaaaataaatgcagttttccattgttcatattcaacatttgaccgttcattttatttaaaaattttatagaattagtatttttatttttattagatgataaaatatgaatagtattttatgtgtgactaatggtttttattttttttataaatttttttaaataagacagatagttaaacgttagacacagttatccacgactacacttatttttaggacggagatatatcgagctttgtcatggagttgtgcaaagcgaacatgcctctgttatgtcattgatgattgggaatcatgtccagcaacgccagctgatctgaccacttgtcagcctcatctcatccagtgctttgaaggcctttccagtactaaagcatttattacagtgcaggatactaccaagtagggctgtcaacgagccgagctcgtctacccaagctcgagccgagcctattgcaccttcgagcttttaggcaagctcggttcgagctcgttcgagctcgagctcggtgccgagctcaaccataagtagtataatatatattttaataataatatcttaataagtataattattttctagttaatcacactaataaaaagagtagaaaatgattaaaataaatatattgtgctaatacatgctaatttattgtgtaaatagatacaaatatatatatttatctattagtttattatattaataaggtgaacatgcaatataaactatacacagccaagctcgggtaggctcggtagaagctcgagctcggctcggtaaagctcacgagcttttgctcagactcgagttcggctcatttggagctcgagccgagctcgaatcgagcctaggacgagccaagctcgagctgctcgcgagccacgagcttgcttttttgacagccttactaccaagaagaacctagtctgccatataggttgaggttccgataaagatcccaccctcacggtgcaggtcatgctcaacacgatgcttccccgccagtctttttcagttagattccacaccccttctctcacttcactagctgctttttcagctttttggaggaagcaccccatgtccatgcatagcaccgagcgtccatgcaaagcaccgagggtccacactttttctcctccacgacatcacgcggtgacgaagccacgcgccagcatggagcaaggcctaatccttctcgtttggcaagatggcttgccgcgagaatccaacaaaatgctggcccttattgaatttaatctttaacgtcttcttttgttggcgatgcacccaaatatttatgtgagagacccattgtgtttttcggtgcattgatacctcctgatatctcacaagcctatatgttatacgcgcagtaacaaatgaaacatcaaacatttatttacaagattgtgagcatggtacaatggtagaaactagattattatctctcatgcagttgtgggtaggtgcaagcagaacttgtagtgcacaatatatggccggagcctagagagatctcttctctgcggtttacttatatgcaacttgtttttcatttagttgatgtatattgtcctggcttatatgtacgatgcacttaatcaaatggtgcaagtctatttaatgttttagattttcttctgacaatgtaaattggttgtaccacccacaacaagcagtaatgagatgttgcttaatatccgaagaagtggcagaggtgcttgacagcaatgatgagcacggcgttgcttgaccacaaggacgatgggaaacaaatcccctgattttgtgcagcctgcagttgtaccactgatatgtgggcccaggcacaactgcaaagtgcacaaggcctgaggagtctaacccaggatgatgaatagtaggatgcatgctttgcagtgctctagagtctagtggtgtaggtgtggtgtgggtgatcaatcttatatctcttttgagataagagggttcatagtacaagtggaatgcccttgccgaatttacacatgaacatcctctctcgagcatattgcaccgaaatccctatttctgatgtaggcatgtaaacttggtggacggaacgatcctgatgcctcacaatcctacccgcctccggtataaacaaatgaaaaacattatcccccttcaaagtgttttatcaaggaaaagcaaatttgctttactcgaggagtatgtaggttgcccacccagctgtgcatgctcttgtgaaccatcggagcgagcttagaagacctgtgtttgtaggtgccaccgttgcacatgcagataccctcaaatcctagtaattttcttgcttctgttgatgcttttccgattgcacatgcacccgatttgtgtggttttcgtgtgaaacgtttgcatatgctgattcgcttggtacgcttggtaatgccaatacgccgtgaagttgctactgctgaatttatacacatgaacagaatctcttgagcagcttgcacccaaatgcccatttctaacgttggcgtgtaaatatggtgggtggaacgctcccgatgcctcacaatcctacttgtttatgggatcaacaaattagaaaaaaacaccaccccttcaaaatatttttctcaatggaatgtgaatttgctttactcgaggagctagtacgatagaacacccaccaaattgtgcatgctcttttatccagtcttgaaatgctgcaagtgattgggagagatcaccgtacgccaatccgatcaacgatgtgcggcgcagattgcgcaggagttgtccttgccttattgcaaattagtagccgtcacctcctagtaaatctgggccgcagcttctggacctaaaagtcctcatggcccaatgggcgtctgctcatacacacaggcctgcatgtctcctcctcggtaacaaatgaaaacacactgttaattcatactaaatgggattttgcttggaaacctagctgaaacatttatttaactgatggtaagtatggtactatggtagaatctcgcatacaaatttgtaacttgtcagctctcccaaattctgagaaagcaggctggtcggactatactagaaagccatgcatctgtactagaaaggtagaggagtgctcactgatctctgtagatgatggacactctgagtcgctggactgaacatcgagcggatctaatttggaaggaaatcttcttgaatcgaacattccatggatattaatttctgtatggttcgaactactgtaggaggaacacaactcgatcaaatttcgtatgattggcttcgtctgctaattctggttcaacaagcatgcagtcctgctgttatgacacaacaaggtcttgctgttcgtgttgcacgaactatctacactctcctgatgtttgcgcttccataggatggtgctataatggtggcaaggtttagacgtgataaaaaaacatggaggtatatatgtttgggatattggagcctttcatggcaatgtaactagctaccatatccttctcctaagcacattaagaaaaatgactccctaaataataaaattctatattttttaaaaaaatattataattccatatcgttttttttccatcagatgtcaaaaaactatagaaagtagaatattttcacctggtacacctaagcattctagatcaattgttgtacaacgtcaatctgctcgcacattctttccggaaagtcggcgtgcttaaacactgctttcacatgatgcttcaaccatatatctgatcatgaaaaatgttgaggaagcctttgtaccaattactcctgatacctcacagtccaatacgcattagacatgtataaacgatatactaacaaacatatctatgcaggaacaagggacaactgctctgtttatggtaaagtgagatagatcactacctcacgtgagtttgagccttgagcctattcacctttgcggctcttatataagcatagacacacattgtatattgatggtaattaccttcgctatttttccttttaattaacaaacttggtaatacatcaaaagtgcatccgattgaatgatgtggtgtgggcaggtactacattttccatcattatttggtatatatgaatactagagatttcgtactaggacagcatcacaatttaagcatgtgtggtattgtagtactatcaaccacatgtgcatcttaaaaacctaaaggaaggactacatgtgcatcagtgtgtgggcaggattacaaaaggttttgagagttggtatctcagttaatgtgcactaccgtagaagtgatttttgccgggtggggcaaaaaccacaattgtcccggttcagcaattaaccgggactaaaaccatttttagtcccggttttttaggtgcaacggaaagatatgatgtttagtcccggttggtaacaccaaccgggactaaagatcatatttaagtcccggttgtgaatgtgtcagaagttgttactaatcgggacaaaagattaatattaatccatcagttctcattttttcacttgcagttgcatgatccgtaaatggcttattgacattggaactatcaaacatgacggaaatagctaatggcagataagaacgtctatgaatccagacatccagtagaacaaacttgtggcatgcatttggtttctatcagtgtatcatgcttctctagaaagctataggagcacggtgatctgtagttgatcgacatttcgggccactggtctgaacatcgagctataggctctgatttgctaggaaattaagactaataatatctgaattcaatattccctggatattaatctctagctgaatattgtttgaaccattttgaaggagcacaactcagtcaaatttcatacgaatgacttcgtataccagttccagttcaacaaacatgcacttatgcaacagagtcttgctgttcatgttccacgttctccctacgctcttccgctgttcctcgctgtgacaagaaagaggatggccattcgattggagggctgatcagaggaccatccatcaccggatgcaagcaacgcgaagttcactgtcactgcgatgcaaagcagaagacgaggccacaatcgctaggctgtagaggaaatctattcagtttgcataataggtgagtatacttccacactcagcccatcctcaaaacatggtgaacctcgcaagcttcagctgtgtgctgatcgcatgctgcacatctcgggtgcagtatctcttattgatgtatcctgataatgtctcctgatgctccatatgcctatgctcatgcagctgatatttgagagattgaatggcatatgcactgtttaggtttttatgggagtttttggtttgtgcaagtggagggggtcacttgataaaactttgtgacctatgagactgaggttctctcttacatatatgggcagttcttcttgattgaacgaatgtatagttggtacaaacgagctagattatttgcttcatattaacagggccggtcctgatatttccaaggcccagagcaaaataaaaatagagaccctcaatgggtataatatgtagattttttttttcttaatgattgtagatctaaccaacctaaaatacgatgatactacactagactacgtcagcttatacttattaaattattgtaactattgtggagaaaacattgcaaacacaatccaattgcctattaataattccatgactttgagaaaattgtgacagcatcaagtaattcatgctagcatttttataagaaaattcagtgataattgtaattgtacgtatcaacatgaatcaggatcaatctgtatttagtggtggttatatatattaaataccattaataataatctcaataaagaagagagagagagaggagaaaatgagtgggacggtgaataaataatctagtcttgggattaatcaagacgtggagcttggagatcaatctacgattctctgcttctattggtaatcaatacgtaaatgtagcctatgtaggtgcatggccggtcggggcccttgtcacggtgggcccagggccaccgcaccgctcgccctgccccagggccggcgctgcatattaaaatacagagcagcaagagaatggacttgtggcttcgcattattgttgataacacattaccgttattatttacatcctgattaaatggactgttcttggcaagggttgatatttaataaatttatggagaaagttaattctgtaccattaagaagaagcacacactcaaaataaacaccatcaattatatacttaaaatttttattaaacttcttcaaaacgctcttaagccgtcagttgatgctctaataaattaaataaaaacctagaaaatctgagaaaaaaacatatatccctcgattttcacttaaatcgacagttccaatactataaatagttagattagatttcttaaaacaaaccgaccaaattcttatatagtctttccttcccttcagtaggaaaacgtacaaatattgaaacattgaccttccttttcttatttttccacgtatatagttgagacaataataattattattattagcgataatattttttataaaatagttactttacaaacatttaatatattatcatatcactctttacaaactaatgcaaataaattggctctacaataatatttaaaaacaaagttgacacccattattttatattgtgtacacattatttcagactaattttaataaaaatatttgtccatcgatttttacttaaatcagtattaaaccatcataactatctttaaataaacaaagcctcgaaatcacaaagattttgagaaaaaacacacattccctcgatttttcagttgaattgatatatgaccattgtattagacttgaaaaatcttgctaatcaaccctcctgatcattccggctaatcactcctcctatctcgaatacgtatgtacttacttgttacaagtaaaaagaatacatacaaccgccaaaccctctcattggatatatatgattaaaaaggactaatcccaccttacctcattgggttccatttatcatatagcatggcattatgagttgctccgcatattgcatataaaccatgctaaggtagttggttgaaaagctatatttgttaccattaaatttaaattgtaggactgcatgttgatatgtgttttcttttcaaaaaatattatatagatcacacatataacaggaaagcgagatctatgatatgtctttgttaatttgtatgtgagtatgtgataaattacatcattgagactttccctgcatatataaatctggactcttagttgtaccaagtgctctctctacttgttaaattgtatctaagtatgtgataaattgcatcattgaggctttcccttacatatataaatttggagtcttggttgtactaaggccctgtttgtttcagcttaagattatagtaatctagattattaaatcagattactctaagctggattataataagctgacatagaataagttgcagttgtttgtttctttggattattggaagcatctaagggtagcgagtctttagccacttaataatttggaaaaagctcctccagaggagattattagattatactaatttggcttatagataataataatctagcataataatctacttgtttgtttgaggttactcctaataatctagattataataatcctaagctgaatcaagcagggcctaagtgctctctctactaattaatgtgtatctaagtatgtaataaattgcatcattgagactttcccgaatttagcccacaaacaacctaatctgaaattcactcatatggagatttgaactcaggaccttggagtgctactcaggtcactataaccactagactatatgctctttcgcgatctactgaacctacaacgtgcaaactataagcagctaatgtaattatgttaattatgacaataatcagtatgagacacccatagggctgagaggcatctggagaatgtgacaaccatttgcataggttcctagaacgagtgagctaagttgaagtcctagttatcattctgatcctcttaggtggtgcatgtgcatatcaaaggaagtataggctgtgttcgctggagccggttctcaaccggaatagtgcacacggaaaacggaacggtccattagcgcatgattaattaagtattagctaatttttttaaaatgtatcaatattaattttttaagcaactttcatacagaaacttttttaaaaaaaacgcaccgtttagcaatttgaaaagcgtgtgcgtgaaaaacgagggagataagttgtaaaacttggagtaagaacacagccgtagtcgctgtaggctcatctaatgtgggtatcgaggcaagcgctgaagagacttgttagtacttgtttctgctacttgaaactcgatcatatctgctaaattaaaattcgaatttaaatgggaacaatgcatatatatcaatttttctccctgtgttaattgatcgctacgattgtatatgtatagttttatccctagaaatgcaaataatagatttgtaaatacattatttgtacatcaaaatgttgttgagttcacatagctcaacctttttcccacttgcctgagacctcaatgtcaagatgctcctatcatatcaatggaatacctattatagcaactccgtttttagagtccgtcctcatgacaagtttaacctcacaaagtttagcaatgtattactcgtacatcccttcaagaatgcaatacctccgaccaatgtgtcgtgacagtggctcctgatgcttcacatgcctatgttcatgccctcgacatttgagagatcgaatggcatattacattgttttggttttcatgtgagttttcgcaattgttttgtgtacgtggtgaggatcacatgataggcctttcctatcaggcagtggcgctcttataggcaacttggttggtaggagcaagtcagcttaattggttctcaacaagatgcagggtacagatacatcaatctacatagcagcaagtgaatggacttgcggcttcacattattattgaaaacatgaatgattaattgaatactgtgcaggctaagagttgatattggtttaatttatcgaaaagtaattcagcatcgtcatgaagagacacatacattaaaacaaggagttacatcaatcaaaatgacggcggcatcttagcattgtggttacaagcaagtaagaaaatgatccattgaactctctgaagtcatggcttcatgggtatattctaactggataactgtatagagtatagacacagaaaaaatgatcatgaattacgtattacagacctaaaaattcatagaaaaagttatctaagtaacactgatatatatagaaagattttagaaaaatcgtactagtgatgtgtagagtttttagcaaaaaatttacttttggataatcaaacctccatcatgtgttgttgttaagctatattaattgctgaatttagagatgtggatacaatgaatgggaaacgacagtcatgtgggggcgattcttaggttggattcttttcccttctttccgaactcaccttcctctttttccttgtgaacgcttctcaaactactaaacggtgtgttttttaaaagttttctatatgaaaattgctttaaaaaaatcttaggctaatacttaattaatcacatggtaatgcgcaacaccattttctgtgcgggaaggtggagttacctcccgaactcagcctcaatgttgctatggttgagttctttcccttaacagagccaactctatttttctaacaaaaaaattagccgaatttcgcacgcagttaagcaaggctatttttggcccaatcctgccggtctgaccgcgaccgtcaaagcaacacaatcttgttcatcatctgaaaatcaatcatctccacaaccacttcaccaataatctccaaatatcaaaaccaataacatcaaatgccaattcttcatcacaaataacaatcaatcacactttgattttacatggttttgccatgccaaccttttactttgtttgtcctacctatcctttccacctcacttgccatcttctccttgtcatccataacaatgaggcgacacttggccactacccgttggattgaagcttgattgaagcaagtagttgtcgtcaagtttgctgaagcaggtcaaggacagcgaaatggttcaacatcaattaccagtcattttgaaggtggacaagtagcctcgcaattcagacgtagtttaggtctcggattgctagtttcaggttaccctctcttgctttctacacccacagatctagcacgagcatcaacactttgggtatcgatgtctagcactccagatgcttcgcatgcctatgttttcttccaacatggatgattggaatcatccgcacacccttcccactggtattgtttttgcataggtagatatgaatggattactggagttttgtgcacttcattaccacaggtcttatttatgtcagaatagagactgttgtaacaccccaggaaaccacgtacctagagtgccagaccaaaaacactcgaaaccactaactctcaaaattactagaaatttcggcagagtctcccctgtaaatacggacatccacgacaggcaattataagttaaactaataacaatatcattcccacaatacgatccatccttataatacatggggaagaaactattagaaatctaaaagattattacaagaccgaaccataatatagtttaagtatcattatggacctaggcaatatagtttgatagtgtgcagataaatgtgtatataagggtgctacttcccgcccatgcatgttggtctcaatatgtacctaaaaccaaataaaacacaagagtgagtataaaaatactcagcaattacaatatggaactagaaaacacatatagacatcattggcaataaagcatgaacagaaggctttctttctttgataggaaacacattttcaaacaccaagtcaaagaagatagtagtttccatccggggcaggcatgaattgaaatagtagtttctatcccggacaatagtgaatatatcctagcatttgccggcaaagccgagtaaacgtgatcagcaattacccacaggaacttgaataaagaaccaaatttcactcccatgactatgcatggtacttgaataattgaaaccagaatcaaagaaccaaattgaaaccatattgcacattcatggcaagcagggaacttgaattatttacccagaaccagaatccggaatattgaaacaagaataacgtcgtaaacataggataaacatgaaaacctaaatggcgtgaacaacgatatgaatataagcagtcacatgtcacatagaaatatatcggaaataaatagatagagccaactatccatcaatcacacacttagttcgtcatgcacttgcctccaatgaagggttggtatcatgcacgatctgaaggaccaccacctaatcacaaacaaaacctcagcaaacacattcaaacatgcatataaaacaatgaaaaaaggtgaacctactgccccatcccatcaaaacgcgataacaaggaacgccgcttgcactataaacaatattgttgcttcaaacctttatatcttgaaatatgaaaaggctatgaccataaataaatctacagaacaaggcctacaactcttatgtggaaattatatttttattatgccattaaaatggtctaatttgcgcttgaaagcaggcttcagaatctgtccagaatttcagactatccgcactaaaacaatcataactggagttttacttgcccaatcagggtgtactttactaatatgaaaagctaagaaaaacctctacaactttgtctataggcgtcttggctgattccactgtttagcccatccaaaaatagttcaatctactactatccagattatgacataaaacaacagttatactcaaaaattcgtatcatctaaaccacttgagataaaatcacgcccttggtcagaagatagatataaatattatctacaactttctagttatacactttcgcaaaaaatatcatttagatctccgaaacttcgaaaaaccgaaaaactgtaaatctgccaacgtgtagaacagccaaattcgaaccacaacaaacaaaactccttctctaaccttccttatccacgaattaaaccactaaaaccaccctagaacaactgatatgacaaggggaaagcctcacctagggtttctttagagaacttgtgaggagacaataggggagactgtgatccaagcttattgatccaagctatgaaagtggagatctagggagagcaatttgctgtagaggggagaaatgcgaacataggagaaggggaggaaggaggcgccgccagggagaggggtggtggcactatgatgggaggtgggagttggttcccctctttctaggttttaggggagaactaatgggctgggtttataggccttctcatgttggcccacttctaaagatatatttttttatttatttctgttaacatctttattttaacaagtcaacccaaactaaaaaaataaatatcttttaatatacggggtattacaactgtattaaatccgcaaccaatgctggtaaataggaataggacacattgtttttagatttggcaatggctctccgtgatatatttctttgaaacaaaataatttctgagaatgcgactagtgtgtatttgacggctgtgacgacgcgtgcatggttcatatatacagttgtcttataggcagcattcttcactagctgactataaataatccttagaggatatcaaaattaatggcgtgtgtgcaccaagaccaaaagtttgttgcaattttgttgacatttttctactcaatgatattggttattccactgtagacagctagcccaattaagaatgcctgcctcttgagggccgggagtaagtaacttacatatgaatagaaaattttggaaccctcattgcactcttaaaaagcactaaaagaagaactacaatgccaaatagtactgtttggaatagtttcaaaacgttgtgcgagacggttactcagttattgtgttagtggtgaatgggacgttaattcatcggttctcatgcttgcactagcacgatccactggactgagcatccaacggctcagatttgcatcgaaggtctacatgaattcaaacattccttggatatatattagtctctcgaatatggtccaaacaacaacaggagaaacacaattccatcaaatttcgcatgaatggatttgtctgaagattctagtcagacaagcatggagtcacagtgctctcaaatacagcacgatctttctgtttatgttgcatgttctctctatagtctcccgttgttaagtaattaacggaagcgagaaaagtaattaagggaagccatagtcaactacaggtctgagggcagatgtacagtatatctaccggtgtcaggtgacaccgatggtatcttacaaatacaatatgatcctctgtgtttttagccaatgacaccatcgattaaagctcactgaccccagcagactaactaatttactctagcccacgcactaacagctagtaaacaatatactccgtattttgttttagggaaagccagaacaattttgctgttgttagtattacacgtgcaacagttgcttaattcacttctcgtatagtatagttctgtttataaatggtggaattaacctagcccgttgatttacttagttttgacatgttaaacaattaataaactagctagatgaaatgttacattactttgtttttatttagtttatactttaacaatgtagaataattaggagtagaacaaataagagctttatggagaaacacccaagggtcttcctagcttcacaaggtggtgggctatacgaccggggttcgaagcctcaccccttctaatttctaattatttgatattaagtcattctctaatggttgtgtctttttaataagagctttatgtatatattaaagtttgcaaaaaaaatgtttctttatactcgagaagataccataagttacactctctttttttccattaatcaattacatcattggtatatcttaatttttgtgagaagaaaccacaaataattagctagaaagtatggtgtcgtctagtcttataaatgctagtaccgtaaagtatgtattacattatgaccccggtggctccaaatccttgatccgccccgtctgaccagaggaaccactgccagtgacggagccaggatttcaaagttaggtattcccatctaagcgctgagccgctggccgcccctgcccctcgcggctaccggccacccaaccggcttgaccgcctgagcttggcggagtgtcgggtgccggccgtcgtggcaatggcctccccctccgcggtagcacgggccagctcccgccgccggttgccgccttgcctcgtcgcgccgccgcctagggtttgcaaatagggagcggcgcgagggagccgagctatggagggatgggtcacggagggagagcgagagggcgccgtctggtagagtggtggctaagtgggtcaactgatgtctgatgggtcacgacaaagtgggtcgggttggtaggaggcattgcaagaggtcggttgggtcatgtttggatcgaagagttgaggatttaggtgcactaatatgtgtacatgtatatatattagaagtatgcttattttttcataaaaaaagttgggtattcccgggaatacccaggaaccaaggtagctccgcccctgaccactgccgcctgccgctgtgatgcgaagcaaccaagatgccagcatcgctaggctgtcagtagttgttcctcagttcggataacaggcgaccggaaatatttttagagtccatcctcatgaccaggttcacatcacaagtttcaacgatgtattactcgtccaaccttccaagagtgtaatacctctaaccaatgtgtcatgagaatggctcctgatgcttcacatgcttatgttcatgccctcgatatttgggaggtcgaatggcatattacattgttttggttttcatgggagtttttgcaattgctttgtgcaagcggtgaggatcaaatgatagaaccattgctatgaggcagtggtgctcttatatataggcaacttggttggtaggagctagtcagcttaattggttctcatcaagatgcaggtacttgggtacattgatccacgcagcaacaagtgaatacaccagtggcttcaccactcgggtatattgattgatgatattaaaaacaattaataccatcaatcaatatcacggcggcatcttagcattgtgatcacaagcatgtaagaaaatgatccgttagaactctatgaagtcatgagcatattctaactggataaatgtacagagagtatagacacagaaaattgcacatgaattaagtatatatatagacctaaaaattcttagaaatggttatctaagtagcactaatatagaaagtttttagaaaaaatcatattagtgatgtataaagtttgtagaaaaaacatacttttggataattgataacaccattagcgatttaaaacacaagtgttgttgttaagttatattaattattaaatttagagatgtggatacattgaatggggacagtcatgtgggcattggcgattctgtggttcagtccttttccataatagagccattggtgaaagtatgagagtgattaacagtagaatataacaaattttaataagaagtgattgatgggataattaatactctgtagagataattattttgggacaatttctaagtatctagaaatacaattattttagaaaagaaaaagtatctagataaattattttagacctggataaattattacttttttttctcacacgctatcctgctgcattttataccatcgatatatgatagcactatattgatgttgcggtcccaggcaagtgggaaaatgattgagctacgtgaactcaacaacaatttgatgtacaaataatgtatttacaaatctctttttttcatttataggcataaaactatatcatatacaatcatagcgattacaacattatataatccagatccatcacacagggaggaaaattgaaatgcattgttcctatttaaattcgaattttaatttagcagatatgatcatgtttcaagtagcagaaaggcagaaacatgtactaacaagtctcttcagtaggggtgtaagtgggcttgtccgtaaacccgtttatagacaaaattagtatctaacctgcggattggaccagcgggttacctattaatttgacttatttatgaattatcattaatttaacctaaaagtcaactcgcgggttggcccgcttgcatccatagtcttccatagtcttcagtacttgactcgatacccgcgttggatgagcctgcatcgacttcctccttcgccatgcaccgcagaggatcacacgatgcccatgtatgttctggaatgataactagggcttttactttgctaactcgtactaagaacctatgcaaatggttgtcacattctcctgattctctcagccctatgcgtgtctcatactgaatgatgccataattaacataagctgcttatgatttgcacgttgtaggttcagtagagagagcactacaaatgtttggatctcaaaaatttttggccaaacgttgcgtgtcttatactgaatgatgtcactcacgctgtaggtccaagactccaaatttatgggtgtgtttagatatctcaaatttttttttgcctaaaatatcacatcaaatgtttggacacatccatggaacattaaatgtgaaaaaaaaccaattgcacagtttgtatgtaaattgcgagaaaaatcttttgagcttaattgcgccatgatttgaaaatgtcatgctacaataaacatttgctaatgacagattaaataggcttaataaattcatctcgcagtttacagtctaaatatataatttgttttattaaattcatccatggagcgccgccgccgctgccgccttcgtcggaccgcgggagaccgccgtgtccccttccggccgatttggcggaggggagggcacggcagctgccgccttcgccgggccgtcgccaacctcgggagcccgccgccaccgccgggcagccgcgggagaccttcacctcccctcccgccggatctggcggaggggagggcgcagcaaccgccaccttcgccaggcatccgcccgcctcgatcgggagcttgccgccagcgatggaggtagcctcgtcactagagagaggggagggagagagacatgagagggagagagacgcgggagggagtgcacaaggacgacgcgacgtgggtcagtgggtgggagtagataaggacaacatacggcgctcggctcatcggctcggctcgttttgtataggtgtaggtgtctgttttttaataaaccggcatctatagtattggtaccggtttttattaatgagccgacacctatagtgccttaaagatgttggttcttatttttttccgcgtgcggaggcggaaaaggcctgtaggtgtcggttttaaaggaaccggcacgtatacggcccatccctttgagggttc

SEQ ID NO: 63650 - DNA, 6812 bp, Oryza sativa
atatggcgtttctaccctcattaacatatattctacttatacttgggacgggtagaaacgccatatcgtgtgcgtggctgggataaagacggacggaaaacgatcgagaattgacggaagtgttgaaaatgggaatggggtgaactttgggtgttattaaagtgaaccggtatctttcggttctataaatttaaaaacgtgaactttcaatgctatataaccaatttttccttttatttaatggttcagcgagaatgatgcaatatttgtgtaaaaaaattacatccgaagtatttctgagataaaacacaaataaatagtatacttttaaatttaattctcactttacgggcagaacgcatggagtacttcaagagaatcttaacacataccaaagtaaagggaggaaacgatcaatgttactgttttttaatcgaagtgcgtgtggagtcaaattgtccttttatgtacattttcgaaccaaattctaatacataaaaaggtatgtttctggaacaatagttacatgcaagcttacaacattatgcggttttcttatcaaccccacatgcccaaattcaggataatgctagctttggatgtgattgatggctcacttgcgttggcctgattcttcgtgcattgcattacataattgatacggcctgctgcacattaggcataatttgacaaaaccaatcagtggtagaggtatgtgcttctccctttccatcattttacctcaattgcaactcggcgtatccatggacaactgtcaatgagcttagggatacagagacccgttgtcatacggtagctccctaatagctcaacaaatgtgcactgcagtgtcaagacacgtgtgtctgttttccaatgtcacccattctcgaaatacagcctaacatctagcatgctgtctgtattttgatattttaacgagggttattatgagaacgctcggctatttagcatgtgaccgacgggatatatatttaagtaagtgagaattattagataccacttggaaatggttataagtggccgatggaccatattagtaaccgagaggtttaatactgtagttgggtcatcagcgaggcagtgtgccagaaaccatagttaatcacctcagctccggccgtgaactgtctgagctttatgaaggtgacaggacacagggctcaggcagtcagtacccttctactgcctgatccagttgatggtgggaagaacttgtaagatcaacatgtgttttgattcttattctgtgatgaataattggcatctgtgattattggttttgatattggagtttattgtcagagtggttttggatgattggatttacaggtgctgttattttatgtggtccggtctgaccgggcgatggttgccggtcagaccggtgctatgcgagcggtcagaccggccggcccgcggtctgaccggccgacgctgtgtcggtttcggtttcgggttgtttctttggatatccgtgattgtttcatggttatggcttctagatggacagtatacgtatgtaatactgttgtttgctaacaatgagtcaatttggtgatagcttggtctcggaatatggtttctttgtttgtttcatgtgtaggtgacttgatgcctcgggagagtatttgcagtgatggaccgggagtcggcttagtggtaagacgatgttcgtggtggtcagatatcatgcgggatactaaggctagaattgatgcacgtggttgatagagattccatatggcatacgatggaggtattgtgtgcgtatgggatgcggagtcgaatttggaaggagtctaaatctggtatgattggttatgtagagtttgttccttgtactagagggtttcctaaggtgtttaggactcttagtatgagtttggttcgtggctttaggctgcttatctcatgtataaatagagggggagcgtgaggcttcccggtatctcttttgtatcgcttttgtatagcttttgagagctagtttagttagggtttcgagtttagtcgagatttttgtaaggagtgctgttggtgcactttgtaaacacatagagaagcaataaagttgtcatctactttgagggttcttcgatttgtgtttcaccggtttcggcggtctaaatggcgacttaccggcggtcagaccggcgcatcagggcggtcagaccggcggcgtacctgcggtcagaccggcggcggcggcgtcgataggcagaggcgacttcgggacgttcaagccgagcgatctacaccggtcagaccggcagaataggcgcggtcagaccggccgatcaacttcggtcagaccgatttcatcgattttgagggtaacttttatttgcgctaaaagttttcggtttttgggtatatcaaccattcacccccccctctggttggcttagttcttgtgattcgatcctacaagtggtatcagagccttgttttcttctttggattttaaccgatctagagtttttgccatggctactaatagattttcaactaagcctcatgttttcgatggaacagatttttctcattggtgcagtaggatgcaatcttacattatggctgaggattatgatatttggagaaaattttctcatccttatgtgattcctgatcaaattaatattgatgctttaaaacttgaatttgaacacaattgcaaagctcgcaatattcttttgagtgggatttctcgttcagattatgatcgtgtttctcatcttgaaactgctcatgagatttggaacgctttgaaaaactttcatcaaggaacttcaaatattatagaacttcgtcgtgatcttttcaaaaaggagtacattaaatttgagatgaaacctggagaagctttagatgactatctctctaggtttaacaaaattttgagtgatcttagatttgctgatttttcttatgatgctaattattcacaatctgaggtttctcgtcactttttgaatggtcttgacatgtctatttgggagatgaaagttacatctattcaggagtctgttgatatgtcttctttgactttggattcactttacacaaaattgaaaacacatcagatgaatattctttctcgtaaaggtgattctaagtccagtgctttggtttcgtcttcaacttctttggatattggtgcttcttcatcaaagttttctattcttgctttggttaataccatgtccgatgagcaactcgaacagttcaaggaggagtacttggttttgttatgtaacaaagtttctcgagctatgaacaatgtcaggaacaagaaaagaggaggtcctaatcaatgctttgagtgtggtgcacttgatcatcttcgctcgcattgtcctaagtttgggagaggcaagaaggaagatgatggtagagtcaaagaggatgacgtgaacaagaagaagaacatgaaggagaaggagaagaagaagcattgcatgcagtggctaatctaagtaatcatagcagcttttcatgaatcggaaggtgaagatgagagcaaaggtaagcaagttattgatctagcttttattgctcgtaatgcaaattctgatgttgatgaatctgatagtgaagaaaagcttagttatgatgaattggaatatgctgcttacaaatttgctaagaaacttcagacatgttctattgtgcttgatgagaaggatcacactattgagattctaaatgctgaaattgatagattaaaatcttcgatttctgatgatgataattgttaatcttgtgaagttttattttctgaaattaatgctttgcgagatgccaattctgttaattgcaaaaaattggaattttagattgaaaaatctaaaacgttggaatcttcttttgcgattggatttgctttacatgctcgtgttgttgatgagttgattttgacaaagaacgttttgaaaaaaatacaaagttgctttttgtgcaagttctttggtcaatgcttcatgtgtgaataaagcaaaacaaaacaatggtgttttgatttctcaagattgttcaaagtgtgttttgaatgagatgaagttgaaagatgcttttgggcgtgttatacacatggaagagattgttaatcaagatgaggtgttttcttgctcaacttgtagaaaacaaaaaggtcttttggatgcttgcaaaaattgtgctgttcttacacaagaggtttcttatttgaaaagttctttggaaagattttctgatggtaaaaagaacctcaacatgattcttgatcaatctaaggttagcacacacaatcgtggtttaggttttgatccttatgctcataattctagacatcctcctactgttttgggtattactaggagaggtgaaattttgattgaatctgagcctaagaacactgtgtttaaatctgctggcatcatgtcttctttaagtgcatcttcttcgaaaacaaatgttgtgaatgcaaaaccttctattgttgcaaaactatcaatttcaaaacaatctacttcacaaacttgtcgtgaaaagtacacttgttctttttgcggaaaagatggacatttagttggtttttgtttgacttgcccataaacagaaaaaggaaagagaaattgcttttgcaaaacgacgttggcaaaaatcgggttttaattcgaggagcacggttagaccgacattgtccaatcggtcagaccggccagcggtcagaccgcaggtgaacgggcggtcagaccggttaccaggcccggtcagaccgcaggcacagcggtggtcagaccggtctcggggcagtttttcgcacaattcaaatcagacttttgtgaagcgtcaaggtaagttttcaggtaagtctgattctgattttgttagtgcttttgtacctactggttctactggtcgtgtgacttagtgttggattccaaaatttcttatttctaaccccaacacggaggtctcgacatcttcacgtttgtaggtattttggtggcatactccccatgtgcgttcaatgttgagatgacgattgcttttcaaggtaacatcaatttacttttggattgacataatattgttctactttcttgattattagcttttcatgtgctagtgtttgagattgtagtttttgttgatactaatgaatgtatgtcaattttgagagtatttgtgatatctttggcaattggatgtcaatttttcaaaatctttgattttttcttgttttttgttcgaggagaattggaggttattttgagggggagttagtgcttattcgtgaatttcttttggcatggtttgagggggagtttgtacctcatggttttatcaagcaataatttgacaatgaaaaaattgataaaagagagctttgtttatgcatatggtatttttttgtgcatgctagcaatactttgaaggtttatttgtctctagcatagcttgtatgcattctagtcttttcatgagatttagattttgcttttaagggagatgatgcatgacacttaaattatacttgaattaagtaaatatgcaatgttgatgctagtatatggtttgatttttaaatgctttatatatatgctttattgacttgttattcctcaaatagctttaattgcttattgtgaaaaagagaataaaaatataaaaaaaatgaataccaaatccttggaaacaatcttgacgacaaggacatattcgatgtgagcaaaataatgggtgccgaatccctggaaacagtcttgacgatagggacgtactcggaataaaaaaagagaaaaatataagcaaaaaggctcaagaaaagaaaaggttaaaaattctctttgttattttgtgctaaaggttatttgagaaagagtgataaaagcaataggtatatgtgtttagtgtttattctttaatctatgtgcttgttaagatgttgcattataaatcgtttgaaatcatgaattttgattgttgaatcaagcttaattgtaaaatctttaattcatggttatactttaatgcatgcttcttatattatagatggattcatcttctttttattgcaacacatgacatgatatgttatatgtatgttaagctcttatacattaatgaacataatttctatgcttgatgaaatcatttttaaaagggggagaaataatgtgaaaatttttggatcttttggagaagagataagttttggagagaagagttgtgttttgggagaagagaagagtttttgagaagagcatgttttttttattcaattgggaatttctttcttttaaaagggggagaagttttcttgtttttggttcaattgggaatttctttcttttaaaaagggggagaagttttcttttggatttttgagcacgatgtgtacatgtgtacgaagtttctttcttttaaaaagggggagaagttttcttttggagttttgagcacgatgtgtacatgtgtacgaagtgtgctttttaccgcatttgtttttaattttccaaactccaaaacattttaatggatttgccaatgtgttcatcaagggggagattgtaagatcaaagtgtgttttgattcttattctgtgatgaacaattggcatctatgattattggttttgatattggagtttattgtcaaagtggttttggatgattggatttacaggtgctattattttatgtggtccagtccgaccgggtggtggttgccggtcagaccggtgctatgcgagcggtcagaccggctggcccgcggtctgaccggtcgaagctgtgtcggtttcg

SEQ ID NO: 63651 - DNA, 10800 bp, Oryza sativa
cgatcgagaattgacggaagtgttaaaaatgggaacggggtgaactttaggtgctattaaagtgaatcggtatctttcggtgctataaatctaaaacgtgaactttcgatactatataaccaattttgccataaataaaaataacgtgggtgctacgatgcggccgatatcgtgcggtgacagaccgcacggttgcgcagttcggaacaacgagaccgaactgtctcgcacatgtaactagcgtgactgaacgtccatgtccaacggctccactttagttagcgattaattacctaattaatgattaactgataatatttagtgaacagacatcctgatttgcaattattaatcattaaaaaagataattaatcaaattgaagcgcccagcctgttgggtctccctcgctggtcatgcgagaccactcgcgtgatatctagcggtctcgcaccgtcgccatgcgagaccatccgcatagtcatgccccagacattttcacacaagagttatgtgagattgatgatatatttctatcaaataaattgcatctgaatattaatgagaaaaaacaactgtataatatattttcaaatttaattccgtgaagtgatcgtcgtgggcccaacatcgatgcaccaaccgatctctacacgtgctgcgcccattccgctgagtccatcactgctacctatagtgccaaacttatcttaattcagtgcatgccgcaacaatagtacatctttaggtttatcgctgatactaagtaagggtgtccgttctaacatggaaattcatagtatttttgaaggaattagaaaaacatctatatttagtccctcaaccatggctactgtattatttttaactataaaactatttacttttggcccctcgatcaactctcaaaaccatccacattgcatccaaagtggggtggtttttgaaaagtgggtaaaaatcagcgtattacagcatctctcgttgcttgtttacttaaattttctggaaatgaccattttgcctgaacatgataacgtggaggtggtcagctacaagtcctttcctagccatgaaaaatataacgtggtgatagcttgcatacaattatctttgatattaactacttccatagcattatacatatttatgatcaaaattacggagaataagttgcctatgattcactaatggtgctagttatttattgggtgttttcaatgtttggttgaactacactcttgtttaattactactctgtaataattggctgcagctctcttgagcaaagaccgggatgttatatttcattatctaaaaaaaagttgttttatcacaaagcacgaaaaaaaatgcggcatgtgtgtacatatttagacaaaaacaacacatcatattcacttaagagcgaaatagtttagtgatgtactattgggcaaataagtaacaaaagtgaatatagtggggcaatagagggagagacaaattctacgatggcaaacacgggaagctatcaacttctacgagtaaataaagggtttacttgataggttttttttattggacctatcatgtactttgtcatcaataattatctactttttttacctccaaattgactctattgcaaccatcaacccaatttggatacttcgccttccttcccctctcatatttgtatccatcagtgaataagggatgcttcctctatctacaaaataactataagtgctaattttatggacttttcagttatgtagcttgtatactacagagagtgtgctagaagctagactgtatttgagaatgggtgacattggaaaacaaacacatcgtgtcttgacactgcaatgcacatttcttgagctatccctaagctcattggcagttgtgcatggacacgccgagttgcaattgaggtaaaatgatggaaagggagaagcacatacctctaccactgtttggtcgatagaattattcctaatgttcagcaggccgtatcaattatgtaagaatcaggccaacgcaagtgagccatcaatcacatccaaagctagcatttgggcctgtggggatgagaagaaaaccgcatactgttgtaagcttgcatgtaacaattattccacaaagatatctttttatgtattagaatttggtttcaaaaatgtacatgaaagcacttccattaaaaaacagttgcattgatcgcttcctccctttcctaatttgcgatgtgttaagattcgcttgaggtactccatgccttctgtcgtgaggtgatcatcacgggcgcagcatcgatacgccagctgatctctacatcatgcaagcttcagctctggacataccgtgcccattccgctgagtccaccactgtgctacctatagtgccaactaccaagcttagcgttgattcagtgcatgaggcaacaatactacatctttagatttatagctgatatttacgcaagggtgtcctttctgtaagatcaacgtgtgttttgattcttattctgtgatgatcatttggcatatgtgattatcggttttgatatttggagattatcgtcgaagtggttttggagataatcagttttcaggagatgaacagagtttactggtttgtcgggaccggtcagaccgggcggtggttgccggttagaccggtgctatgtgagcggtcagaccagccggcgctgtgtcaatttcggtttcgggttgtttgtttggatattcgtgattgtttcatggttatggcttctagatggatagtatacgtatgtaatactgttgtttgctaacaatgagtcaagttggagatagcttggtctcagaatatggtttctttgtttgtttcatgtgtaggtgactcgatgcctcgggagagtatttgcggtgatggaccgggagtcggcttggtggtaagacgatgtccgtggtggtcagatatcatgcgggatactaagggtagagttgatgcacgtggttggtgaagattccatatggcatacgatggaggtattgtgtgcgtatgggggatgcggagtcgaatttggaaggagtccaaatttggtacgattggttatgtaaagtttctttcttgtactagagggttttctaaggtgtttaggactcttagtatgagtttggttcgtggctttaggctgcctacctcatgtataaatagaggggaagcgtgaggcttcccagtatcgcttttgagagcaattgagttaagttttaagttagggtttcgagtttagtcaaaatttttgtaaggagtgctattggtgcactttgtaaacacagagagaagtaataaagtcgtcatccactttaagagttcttcgatttgtgtttcaccaggtttcggcggtctaaccgacgactcatcggaccggcggcaaggcggcggtcagaccggcggaagcgaggcggtcagaccggcggcggcagcaggcacggtaggcgatctcggcggttcgaccggagttcgatctcggtcagaccggcgtgttccaggcggttagaccggtgcaactacttcggtcagaccgcgatccatcgatttcgagggtaacttttatttccgctaaaagtttttggttttagggtatctcaaccattcaccccccctctggttggcttagttcttgtgattcgatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaaagctcgcaacattcttttgagtggtatttctcattcagattatgatcgtgttgctcatcttcaaactgctcatgagatttggattgctttgagtaattttcatcaaggtacaaataacattaaagaacttcgtcgtgatcttttcaaaaaggaatacattaaatttgagatgaaacctgtagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacatctattcaggagtctgttaacatgtctactttgactttggattcgctttacactaaactgaaaactcatgagatgaatattccttcttgtaaaggtgattctaagtctagtgctttggtttcgtcttcaacttctttggatcttggtgcttcttcatcaaagtcttctgttcttgctttatttaatgccatgtccgatgatcaactcgaacagttcgaggaggaggacttggttttgctatctaacaaattttctcgagctatgaaaaatgttaggaacaggaaaacaggagaaccgaatcattgttttgagtatagagcacttgatcatattcgctcgcattgtcctaagcttgggagaggcaagaaggaagatgatgggagagtcaaagatgatgatgtgaacaagaagaagaacatgaaggagaaggagaagaagaagcactgcatgcagtggttaattcaagaactcataaaagtttttgatggatctgaagatgaagatgagggcaaaggtaagcaagttgttgatctaggttttatttctcgtaatgctagttcggatgttgatgaatctgatgatgataatgaagaaaagcttagttatgataaattagaacttgctacttaaaaatttgccaaaaaacttcaaacatgttctattgagcttgatgagaaggatcacactattgagattttaaatgatgaaattgctagattaaaatctttgattcctaatgatgatgaatgtaaatcttgtgaagttttgttttctgaaattaatgctttgcaagatgtcaattctgttaattgcaaaaaattggaatttgagattgaaagatctaaaatgttggaatcttcttttgctcttggatttgctttacaagctcgtgttgttgatgagttgattttgaccaagaatgtgttgaaaaaaatacaaagttgcattttgtgcaagttctttggtcaatgcttcatgtgcaaataaggcaaaaacaaaacaatggtgttttgatttctcaagattgttcaaagtgtgttttgaatgagatgaagttgaaagatgctttagggcgtgttaaacacatggaagaagttgttaaacaagatgaggtgttttcttgctcaacttgtagaaagcaaaaaggtcttttggatgcttgcaaaaattgtgctattcttaatcaagaggtttcttatttgaaaagttatttgcaaggattttctgatggtaaaaagaacctcaacatgattcttgatcaatctaaggttagcacacacaatcgtggtttaggttatgatccttatactcataattctagacatcctcctactgttttgggtgttgctaggagaggtgaaattttgattgaatctgagcctaagaacactgtgcttaaatctgctggcatcatgtcttctttgaatgcatcttcttcgaaatcaaatgttgtgaatccaaaaccttctgttgttgcaaaaccatcaatttcaaaaccatctacttcataaactggtcgtgaaaagtacacttgttctttttgtggaaaagatggacatttggttggtttttgttttagacttgcccataaacaaaaaaaggaaagagaaattgcttttgcaaaacaacgttggcaaaaatcgggttttaattcgaggaccatggttagaccgacactaactagtcggtcagaccggttgccaggcccggtcagaccgcaggcacagcagcggtcaaaccggccttagggtgattttgcgcgaaattcaaatcggacttttgtgaagcaaaacggtaaattttctggtaagtctgattctgattttgtaagtgcgtatgtacctattggttctagtggtcgtgtgactcagtgttggattccaaaatttcttatttctaaccccaacacggaggcctcgatatcttctcattcgtaggtattttggcagcatactcccgatgtgtgtttaacgttgagatgacgattgtatagtaaggtaacatcactttacttttggattgacataattttggtctactctcttgtttgttagcttttttatatgctactatttgaggttgtagttttggtttatactattggatatatgtcaattcttgagaattttggtgatatcattggcaattggatgtctttttcaaaatctttgatttcttcttgatttttgttcggggagaattggaggttattttgagggggagctagtgctttttatgactttcttttggcatgatttgagggggagtttgtacctcatggttttatcaagcaaaaatataacaatgaaaaaattgagaaaagagagttttgttctatacatatggtattttcttgtgcatgctagcaatactttgaaggtttatttgtctctagcatagcttgtatgtattctagcattttcatgagatttagattttgcttttaaggtagatgatgcatgacacttaaattctatacttgaattaagaaaatatgcaatgttgaagctagcatatggtttgatttataaatgctctctatatatgctttattgaattgttattcctcaaatagctttaattgctcattgtgaaaaaagaataaaaatatgaaaaaaatgaataccgaatccttggaaacagtcttgacgacaaggacgtattcgatgtgagcaaaataatgggtgccgaatccctgaaaacagtcttgacgacagggacgtacccagaatataaaaaagagaaaaatatgagcaaaaaggctcaaggaaagaaaaagtaaaattctcttggttgttttgtgcagaaggctaatttgagaaataatgataaatgcaataggtatatgtgtttagtgtttattcttcaacctatgtgcttgttaagatgttgcattataaattgtatgaaatcatgaattttgattgttgattcaagcttaattgtaaaatctttggttcatggttgtactttaatgcatgcttgttatattatagatgggttcatcttctttttattgcaacacataacatgataggctatatgtatgttaagctcttatacattaatgaacataattcctatgcttgatgaaatcattgtcaaaagtgggagaagagataagttttgggggaagagatgagttttaggagcagagaagagtttttgagaaaagcatgtttttggttcaattggaaatttctttcttttaaaaagggggagaagttttcttttggatttttgagcatgatgtgtacgtttgtacgaagtgtgttttttaccgcttttgtttttaattttccaaactccaaaacatttttaatgggtttgccaatgtgttcatcaagggggagattgtaagatcaacgtgtgttttgattcttattctgtgatgaacaattggcatatgtgattatcggttttgatatttggagattatcgtcgaagtggttttggagataatcagttttcaggagatgaaaagagtttactggtttgtcgggaccggtcagactgggcggttgttgccggttagaccggtgctatgtgagcggtcagaccggccggcccgtggtctgatcggccgacgctgtgtcggtttcggtttcggattgtttgtttggatattcgtgattgtttcatggttatggcttctagatggatactatacgtatgtaatactgttgtttgctaacaatgagtgaagttggagatagcttggtctcggaatatggtttctttctttgtttcatgtgtaggtgactcgatgcctcgggagagtatttgcggtgatggaccgggagtcggcttagtggtaagacgatgtccgtggtggtcagatatcatgcgggatactaaggctacagttgatgcacgcggttggtgaagattccatatggcatacgatggaggtattgtgtgcgtatggatgcggagtcgaatttggaaggagtgcaaatttggtacgattggttatgtaaagtttctttcttgtactagagggtttcctaaggtgtttaagactcttcgtatgagtttggttcatggctttaggctgcctacctcatgtataaatagagggggagcgtgaggcttcccggtatcgcttttgtatcacttttgagagcaattgagttaagttttaagttagggtttcgagtttagtcgaaatttttataaggagtgttgttggtgcactttgtaaacacagagagaagttataatgtcgtcatccactttaagagttcttcgatttgtgttttactgggtttcggcggtctaaccgacgactcattgacggtcggaccggcggcaaggcggcggttagaccggcggaagtgaggcggtcagaccggcggtggcagcaggcacggcaggcgatctcggcggttcgaccggagttcgatctcggtcagaccagcgtgttccaggcgttagaccggtgcaactacttcggtcagaccgcgatccatcgatttcgagggtaacttttatttccgctaaaagttttcggtttttgggtatatcaaccattcacccccctctggttggcttagttcttatgattcgatcctacagaactgaaagaagaatagaccaaattccctcggcgttaattggacagatggtgataggacatttggcagaactggaagaactggcatgtccgttaggatcccccatcatctgatgaattgaggcagcaacttacatttagtatagttagagcatcttcaacagcatatccaaatcagattctccaaatacacatataaccaactctccaactgatttggatagtcaaactaggtgctcactctaacagtctccctattttaccatctccaaaataacaaatggcccgcatatatatcagtctctcttccttttctttctttccatcttcctcttcacctgctagggaaatggacgagctgacgacgggagtctacggtagggatgattggcggcggcgataggggcagcatcggagggtggtgacagatgcgaggcatacagtggcgaatggtgacggcggtagtggctggcgggatagatggtgtcggcagcgcggatgttggcccagacctcagcgaggatagcagccgcaacgcctagtgagctgcacggcggcgaaggtcacgtcacccctcgaatccggtagtagcgtaggccgcacggggatggtggttgcgatgagtaaatatttgtagctagaaagctagttgagacttaaagaggcaagtattcaccaatataatgccagagaaagttgactaaaattggagagtaaacaagcgattaattaatatttatatttctcgatgcccatgtggccaatcttgtgtggaagaatggagagtcacgcattaaatccgagaaagtcattaagaggataggttgttagattgaaatatacctatcaaaaataatttttttagatttgaaaatatgactttcaaaaatagatggagtaaaacccaagagatcctgcaacctcttgcctaccagttaaaatatactgacgactagtactctactactaactagctagctacctcacaaaacactaattaagccactggctttgcccataaaagtataaattagttggacatggtgtcatgaaacatttgatgaatgccatataccgaagatcagagccatcccttcgtggtggactggatcctatttacataccccatgcatatattctccactgtatttcactcagcatgaatttctttattaggaaccgaaagttggagatcattctttgtcaattaaactacaaacaattggaatgcgcagttgggcattataaacaatacctaaaatttgtattcaaataaatccgtggggactgtaattcagtaattgtaagcactgcgtgaaactagggtgtttttgtccaatatataggctactttgcattgcagaaggttgtagcagattaaatatataggctactgaaattcaaatatatgttgttgcaccgcatagcagtttattttaggaaggaagcatggcaagtccaatatatataggagtgtgccgaattagccatcaattttggtgggactaataaatggatttgttagtcctatgtaattaagtttatggcaagttaaattatttattttacaaattaacaagtacgcatgcatgccatatacatatgtaagttaacagattttaattaattagacagtgagggtcctaatgcgtgttagtaagcctgtgacatgacctgccgagatgtttgagggattctacaaaccctgatatgaattcttttaatttgaacctcacaggtagcaaaaggctactaataatctccgtcccgggtcgagccattgccgtgcatcccattgtctccacatagctcagatggttcatggctgtccagcggtgaggacaggtgctcatttggtgctgtcataggcgatggcttgaccgcatgactaatgcatgatagcttgatcgtgtaataattattttgactattttccaatgccacccattcctaaatgcacgatctattgg

SEQ ID NO: 63652 - DNA, 5982 bp, Oryza sativa
tgatgccgccgcccgccctccgcacgccggcgagctccagcgccttcctccctccgtctgcgtgccggcttctgtcttcctccgcgcgcgcaccgccgccgggtcagcaacaacgacgacgacgacgccacggcgaagatcacagggagccgctccctccctccccgcgcgcgtcggcctcaatcttcttctgcgcgcgccgccaccggtcggcaacgacgacgacgacgctgtggcgaagagcacagggcgccgctctctcccccccagcgcgcgccggcctccgtcttcctccgcgggtgcgccgccgccgccgccgccggggaaagagatttttttttatattatccaaactttaggtcaaacaagcaaacaaacaagatataacagggccaaataagcaagggcaaaatggactatttaccccaaaattaacaccgtcacctcacacaaacggaatagggtcagaccagagcttcgtactcgaaaatgagggtcaaataagcaaagttcaaaaagtagggtcaaatcggcaattacaattcaaaacgaggtcaaataagcaattgcccctttagacatcgtctcattgcacggaatactactgcctactacacgtacgcaagcccaaatccagtgcgagggcaccgggacaacaaggattacaaatgcatgctctccctgttgtcccctttgacaaccaataacccatagaattttgatggatggctgccaatgaaaccacagacccaagctgctggccatgattgtctggtggtgactctacataccaaaggatgagttactacaagaaaagaaggaattctcaagagccaatccccgttgggactgatgctgttctcgttgggaatgttattttcaaggggatactcttgtaattggtgccttgggattaatggcctagctaatactatcatttgctaggaccccgttgagaatagcttctgcaagagctaaattcaagagctttccttggaaataatccgtcttggttgttgcatagaacactgacaatctcaagggttgctcgttgcaaataccttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttactctgacagaaaagcgtcaaaggatttttaatgatcaatataaacagtagacaatatatttgcatttaatctaagacaggtctgtagacaataacacataaataaaatagtctcagaaggtaaattgatcaaactgattaatctagcaactataataggtctgataacatgatcctggattcctgatctctaaatgcttgcaattcgacattagcacatcctagaaacgccagaggtcatcattctcacaagttcttccacaatgaccagcttgtggcgcctcttcagtagtgttcatcccattctgaaataaaattacagaataagctacaaagttactgaaaaactataagggtaggtctaagtttgaacttatgaatgatacatagcagtccatttctaaattgaactcactaactagtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggtaacaaaaatagctttaatttatacttacatgggaatgagtttctgccttatccttatccactgtctgctctagcctttctatccttgatgctagttattgatgagcattgttcacagcattagtgactgcctgctgaacaatgtcttgcacttgctgctgtgtatatagtggctgtgtctccatgctaccagatggtgcacttgctgaattaccaacatggtttctatctataattcctggaagaccataataccttccacgttttctacctttagtgagctgcacccaaacatgttgtttgtcgacttgattgttttctccttccttgacacgatcattatacaccacctaattaagatatgtagtggcaccattgcatggttttagatgatttcactttttttgattgccaaacttgaaactagaaactagaataagcagaacacataccgctaactgttcagctttcttgttggcatactgtcccttgccctttgcatgtcgatgtgtgcgttcaaagacatcaatatcatcaacatccgtccctgcattctcaattatctatccaaaagtacatatcatagtgagaagtcaaagtagtataaatcataataggaaaatcatttaactttggtaccatggcttgtttatgcatagcaacacttcgtgaaccacaagtatgatgaacaccacctccttccatccgatttttgctgttttgagctgacactttctttacattttcatcagaccacaagtcacacaacatatcccaccacttttgctcaatccaataaggagggaatgccttccaaagttgaggatcatcaacatcaaaatcatcatgagaaggggcatctccatcctgttgtaactcagtcgcacgcatattttcgatatgcttttccaaagaacgttttgcttcagatttctcatgtgacaaagcttggctaaaacgttcaacagctttgcgataaaataatctagcacaatccacttctctaccatcagcaaacttaaaacgcagctgtaaaaggataaggtaggacgtcaatccattaaaagaacctaaatattctatgtgaatgctaacactgtaactcaccaaaaattccttcagaatagttatccttgtatgagcaggaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacataccatttaccaagttaggtaatattagtgtaaaacaatgaaagtgacaaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatctgaaggttcatcttgtgttgaatcctcaaaatggtcttcaacttcaggatccggataatgtcgatggcgtcttgacatagtacttaactagtaaaaacaagggttattttgcaagcaaatgtagtcattaaagaatagataacatagtaaatttgtaataatgtgtcacgaccggaattaacccaacgggcgttccttacgtgcgtgtattatttcttgtcccaggaggcaaggtacaccaaaagttgatacatttcagagtttatcaagcggaagcataaatagttaatttattacatgggcggcgaaggcccagcacacacaaagacaaacgggaaacagcggaagactagggcgacgaccacaggcgcttgacggcaggctcctcttctgggtttgggaaaaaattgagcaagacagagtacaaccaccgtactcaacaagacacacccacaagtgcaggataaatgtaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcctcctcacgtgtaaccacgtgccacataccaccacggtatacggacagaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctctgcaacggaggcccgaagaccggtccttatatggccgaggtgctactatcaaaaccatgcaccccgagcccagcctaaaaccattttgaggattttgaatagagggggaggtgtgaatccaattccacaataatccatccattccaaagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggggaacaaggaaataataacaataacaataataaggtcataacaaaggaaaataggcatggcttgataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcggcgtctacacgaccaacggaaaagaaaaggcttttactctaataaactccatataacaagctggaacaaagcacaaaaatgggttcttgacttcttaagaaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtcagcgggagtggggcccacgcggcagcctcacggtccacggtggaccgggtgcacccgggctcacaccgaccagcgccgtgggtcccacgcgtcagccgcacccgagggcgcgggcggctgacggccgggccccacgcggcagccactcggtgcgcccgagggcggccaagccggcgcagccggcgggaggcggcgcccgcgcccctatggtcgccggcggcggccataggcacggcggagcggcggccgagagaggggaagggaagggggaaaagaagcggcggtccatggctcaccctaggtcgacggcgacgacgaaaaaggcagccggagcggaggaaggcggcgactcggctcgggtcgacggggtcgacagcgttcc

SEQ ID NO: 63653 - DNA, 715 bp, Oryza sativa
ccaacgccaccgcaacacctgtcccaccctccccgcctataaatccccggcgccggccgcgtcccccggacaacgccgcatcattgtgtccggctccggctcccgggacacgacacagcgcacgcccagagcgcgctactacttgctttcgagagggttgcgtgcggctttgcatgaggaggaggaggatgggggcactgcacgtcggcgagccgcgggtcagcttccagcagcagcagcagcagcaggtcggcaagaacgggcagcaagggcatggccatggcgccgtggtggaggagatacacgggctcatcaaggtttacagggacgggttcgtggagcgcatcccggcgatccccgacgtgccgtgcacgtggggcacgacggcgtcggtgccgggcgtcgtcatcgcgcgcgacgctgtggtcgaccgtgccacgagggtgtgggcgcggctgtacgcgcctgcggcggcgacggcggcgggaagggtgcccgtggtggtgtacttccacggcggcgggttctgcgtcggctccgcggcgtggagctgctaccacgagttcctcgccaagctggccgcgcgggcggggtgcgccgtgatgtcggtcgactaccgcctcgcgccggagaaccgcctccccgcggcgttcgacgacggggtcacgacggtgcggtggctgcggcagcaggcggcgatctccagcgcggccga

SEQ ID NO: 63654 - DNA, 592 bp, Oryza sativa
atttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacgactgtcgttgagaggtaccggttcaggcggaaacagcttcggaaggattttccggaaccgcgagc

SEQ ID NO: 63655 - DNA, 1438 bp, Oryza sativa
gccaataacataagcatggtgggtttcactggttgaatagtagacatagtgccacaccgctgttacctgcaaaataaagggaataaccatttgggcaactttactcactgtcggagtcattttttcccatgcatgtttgttctgtaacagtttaaaactcgaggaagaaatattctcgtccaaaatatttattccctcggtcaaaaatatttaacttggatgaaaatttgatcaaacctctaaaattttgagaataaattatatataaagtaagtttatagtattatgatactagttttcaagacaaatatctgtatataatttatttcgtctttaaaacacacatttgaaaaattattgaaatatatagaattttaaattttttatcaaatcttattgtaaatattcttcttttttgcagagggagtataatataatgctaaaaagcaggaaggctaagctttgttaaatccgcacacatagggtatgtgaaaggcaatagagggttgaaataccaatcaggagaggagagaacacgcaccttcgcccggccggagtgcagagcactgcaacctcttcggcttggctatgcgcggtggtgtgtgtgatctgggctctgggttggatatgcttatctgactcaggccccaggggtttaaaaactattttacagcagccttacctccacacatttgagctgtcacaccttatcttagcttgaccgccgtaacagcggagaccttgattcggagtcgttgagactaatccattgcaacttttcagcccactcaggcactcacgggttcacggcctcacccacctcagcggtcgctgtttgaggtcgacaaggttgttgcagcttgttcagcctcgaatacgatctctctatttcccctccggctctgtactttccatccgaaaccgggcatatatattctgcactgatgtgcgacttgtctccggcggcttcgatcctgacaagcttagcacatggacggtatacttttcaatattctcgttcaactacatcgttctttctttagtgagagccacgagtttggctttggttctttgtgacattggtgcttccagaatatttttatgtggacgtgattcgttctttggcagagcagcgggtcaagcaaatttgcacgtattcagtttggacaacgttgcaacgtactaatgccgtgtcgtccacggttatacatacatcaaaatggtgaaatatctagcagggaccaccaattcagtggaggggtcaaaaaaattgttttgaaaataaaagaaaccaaaagaattatgtagtatatggctagtatttgttggcggtaggtttacacacagatcctctcatctgtgacggcccattacatgcctgggcaacgtgggccgtcagaacgaagtcatctcaattgggcctaagggctgcaggaat

SEQ ID NO: 63656 - DNA, 12991 bp, Oryza sativa
attttagatagagcaggagtaccttttggtttgcattccctaaattatccgttctaaagcgtcgtctactgacagcaaggtttagttggttggtgttcacatagacaccaattgcatgcatgtatctacttgcacgagcaaagaagccaacaatgctgcaatttgtttgcagtgtggtgcagaaaggatcccctctttctgttccaaaatggccatatctgtcctcattagtgaccagtgtaagtgatgttataacattagaacgtgaattggcaaatcgaccaattgttccagacacctccaatagaaactctgagggaccgagctgaatctgtaaaagttaggaacatgattttttgggtgtcaagaactgcaggacagagcccataagagtgaaaaaaaaatactgtagttgtaagatgcatttactcactgtataaggactagggccaggatttccaccccaaggaccaatagtgatactttgaccattaggtccaatatatgagaatgcaagcgaatcgatgatttcaccgctacaaattgtcacactatacagacggtggggtggcacctcgatgtcataagcgctccctcctttcccaccccaagggccaaacttacgaagaactccaacctcctgatgagtgaacacaaccaattaagcaaatttagaaagaatgaataaataattacacatgtaaattaaagccccgtgattagtaaattattacattatcatattctcctctagcacctctttcttgttccatcgtctccctttcattgtgtctacttgcattgctggaatcctgagaaaatggcatcaactcctcataaatattggtaatcctgctcaaaatatatgtatcgtcacgtgtatcggttcattttaaaaattttcagcccatgcaatgcctgttttcaaacaacttaggcccattttgggttggtacctttctgttgatagtgtcaaacttgaggaaattttaacattaacatatttgatgtagtagaattggtactagatggaacccaaatattgatatatagatagtgtaggcaaaaattggcattgaaccaaacatctacatgttactattaaagttgccaaattaaaattttgatagggcaagaattggctttaagatccacaacagtccatataacatagatttcaattactaagcatcaatatatatagatgtggtaatgtagcaaaatggcattttgtgcacaacaagttagtgttctaggcgaaaagagatccattgtgcaagagctcttttagagtgctccatgttacctttgcggtggtaagataatattaataaatcctggtcattgatttttcatatttgcttcgtttattgacaaatacatttccaccacctaattaataaaccaagaataaaaggaaagctagtgccgataagtactctttatgcatgcaaggaacgaattatcgtttatatatatggtacaaaaacaaataaactaccattaaaatctcaaattttgatttattacaagcacttaatcgcgcatatatactttctagtatcaaattcaaattattcagttttgagcattcaggctgtacatacatatatataaagatcagtaagttgaactttgaaaaaaatgttggcgatattcatgtacagtaattcgaatttggaatgcattacataattactttataggcaacaatgttttttttgtggcagtttaattataatttgcttttttttcattttctataatctaatcatacctgatctccaggtgatgctggatcaatcggcagctcagaaggtaaaagcgatggtgacgttctctgaaacatagcatctaattcattcagtctgctgacaacttccgctatcgtaggccttttgtgtcgatcggcttccacacattgtaacgccatttctaaacatgtcttcacttgtcgttgaagactacctatttcctcagatgtatacgtcggcgttgtctgctgaaatcttctactccagttttcatggacctaaggaaattgaaacataatataagaaagataattaatggtatgggcgcacaaaactaattgaggaccttcatcatataggctagatagaaaatttcttacgagctcgatgaactcttgggaaggcatttcaagcagttttgaccgtgccttaggtccttccattatctctattattatcacacctagactgaatacgtcaaacatctccgtgatatgttttttctcaatgtattccgggggcatgtaacctctgcatgatcgatatcataattaagttagcatttttctcatttacataaagtgtgaatagctaacaagattcaacaattaattagaaaataagtatatgctccctcctttctataatatgagggattttagatggatttggcacatcctagtaaaataaatcttgtccagatttattttactaggatatgtcaaatccacacctaaaatactttatattatggaacggatagagtatgcgattaagttgtcatgtttgatcaacttacggagttcctataaccacttttgttgtatgatgggatagtgttttctcaaatagccttgacagcccgaaatctgcaattttcggcacattgttcttgtccaacaatatgttgccaggttttaagtcgagatggaaaatatgaccttgcggtccattgtgaagatagtttacaccctcgcatgtccccttaattatgttgtaacgtgtgcaccaatcaaatccactggattcgtctgtaccataaacaataatttattttcttgagacatcaatttggttaccctttttcttgttaactgcaaagtaatatagttaaaaacacaaaaacttagttttcaaaaaaaaacacaaaaactatcataccagaaagataattgtcaaggcttccacgctgcaaatattcgaagcagagaactctttcctccatataagccaaaaccaacttgccattgtgtgggacaagcttacgtcttgtttcacagcagtagccaactaatcgaacaatatttttgtgtcggacactcatgaggttagtaaattcattcataaatttcacatcatcaagtgatattatgtcgagcttcttcacagcaatctcttccccattttctagtactccctgataaaattaatatctcattttgatacgggtcgatcaattaaactgtagaaaatataaatgttaagcataccttgtaaactgttccaaacccaccatgaccaatttggtgcttcgttgaaaaattatctgtaattcttgttaacaaatcaatcgtaagatcattgggcatcgtatcagctgtgtgctgtaacttgtccgccatgctatatgtatctcaaattgggcctagcttaccttccgtgtccttctttacagttaaaaaggggcaggtctataacgtcaaggtaagtgaatacgtaaggagacatatcattatcagatcaaaattaattgttttaagatatgttacaaatagcctttggactaggtagagttactagataagatgagtgatgctccgatactctctaccagtagtattatactaccagtataaatgatttgaattgtccgttattaagggtaaattagtaaattactaatataatgataggggtaactttgtcatttatttttttttgtctagatcaatatgtgatcatccattccgctaacatcgcttatattccatcgaaaaagcgaaaaaatggagaaaaaaagtttactcactgctaaatagcgattatacctgtacacacctttttttttgacaattttgcccctcaagtttctactaccgctaactgggatggtagtataaatagatctaaacccttcgatcaaatgagatcagtggttcagattgttttttactatcagtagagagcattgtagtgaacatcagattgttttttactatcagtagagagcattgtagtgaacatcaagaagagaatgatatatttgatattttagaggttttatatggtgctctctactggtagtatgaatgatctgagccgtcaatttgtaaggacattaagtactccttccgtcccaaaatataacaacttttagcccttaaaatttgtcctaaaatataataatttctccaccaatattctcttcccaaccaatcacaactctctaccattcacttttcccatttacctccactactcaacaaattacaaccctccaccatttatttctacctactttcttaataaccgtgtccaactttaaaaatgcttatattctaagacggagggagtactttttttactaactccgtgcttaattttgagattcatttactcccgtctgcatttacaccctagcagcggcgcaccaccccctcccccccacccccgagcggcggggcggctaggagcagcgggccggtggatgacgatgtcggcgctaggcacgggccttctccctctccctctcctctccggtggatgacgatggcggcgccgccgagcttgccatatccgccctcggacggcagcgccgctgagcttgccagatccgttctcgctatcttcgtctctcccaggctgctaacgccgccccgtcgagctcgggtagtggactcgccggcgacgaccgccgcccccttgcatggggtgtgtgggggcatcgcatgggggcttgtcctctccggcgatgctctcctctatttggcggcgtcgggcggtggaagtgaggagggcagcgtcggcgtcacgtgtcgcagagtgtgggcccacctgcgcaaaactgacgaggaacttgtagccaaagatggctacgcgaacctgaggaggccgaacggtttgagtacgtggacacgaatattcggttcgtgggagtgaggctgaacgccatatcggcgcactgtaaacgcccttactactgggatgactacgcagcatgcggaacgcgcgccaaccaatcaggcaacggtctgcgcatctatcggtaggaacttcatcgatctcttcccgacggcagccctagccgagcgtgacgcagtctcgccaagtcatggatcacagcctccgcctcccttctatgcgtgccaccgtacccaccggccggcgagacacatcggaagacttagccgccctcaactccatgccgtcgtctgctcgccgttcgtgtccaggacactctgctcgatcggccaaactctcagcacaactaaaagtacaacgcatgtttacaaatttatatatccggccttctgcacactcacttctctatatatactattatacccaaaaacgtttctactatcattaaatcaatttgatcccttagattaaaaaaaagatgaaaggccgtaggttaattatactatcagtagatcgaaaacacggtacgtagaaagcctcttgatattatatatggacggaatcatcctctcaatttcgagttcccctatactttcctctgttctcaagtccatatcctgtgctcagagttctccatggtcgctgaagtcattctaccaacgcaagacaccaacatcagctggtatgtatagggcacgagttcaacaatacgacccaagctctgtaagcaggagcgcaagaggctcctaatcacatctttatcctccgatcgtcccaactcgatcccaattggatggttccacccacaaccacgccaccccctccttaatttgctgccaatcttgttaggccatgtttataagctagcttatgagcaaaaatatctaagcctaaacaaacgagcaatttttctatttggcttttttaaagcaaaaaaacccactcttatatactgttaagccaaaaatttagattggagagcttttttttttcttatttaaaatgagggtacgactctacaattaaacttaattcttcaaagccacttgcttacaaaacatataagccaaaaatttggcttaaaagcctaatcccaaataaagatgccctaagtaccaatcagttatcacgttaagttagctaattaatactccagcattttttttattataagacatttttaattttttactagtcaaaacattgtagcatttctaacataaaacaaacttagatttgataaaattattttgatgttgttgatgttgcgattttttctacaaacatagtattttttacgaaataaaataaaataaaaattaaaacgacttataatataaaacataaaacagaacaagtattatgttattagttatccgatccgactttatgctcccaggtaaacaaatgattagctagacaaaacaatccgtacctcctcaatccaacatctccaaacactagtaattgttaccagcagaagtggagggaccataaatatataccgaatgaaaattttcaccagtattaattgtagccacgacgattaattacattttgagaccatattaaaatagcaataagtcactcagatgataaaatagcgtgacccaggggcggatacaggagtagggcagctagggctacagccctactcctgatcctaaatatgcattgaaatttcattttaaaacttcaaaaattagaagataaagacaaaattatataaattcaactaattgagttctatgtttaaaaaaaattctgactccgccattggcgtgaccaaaacatcccaagatcatcaggaatataattgatcatcatctcatctggttcagtaactagagatcgaacaataaagcaaatgcacttacctggagaaattcaagtactcgcagctctcgccagctcagtatggcgcggggcttggtcatgggatggtgctttatacactgacatattcatacgaggccgatcgatgtggatcagcttgataacgaaattccaaacgttagtataacaaaaaggtcaggcgcggctgagctatattatgtaattaatctacttgattaatgagaaattaaactttggctatatcagatcacacgttattggtcgccgagcttccaaaaagcatccaatatctttattagtatcgaacaacgttaattattgatcagctgggtgtctatattatatactagtatataggagagagatgatggttgactacaagtcatctatacaactcgctcggatgatacttttatattgatttatagccagtagcagatccagaaatttagttcgttggtatcacaacgtgtctatcggtgtcatagcatgttaattatatttagaatatagtgttataatatatggataggtggtttaagtatagcttttgccaaaagtcatcggtgtcacctgacaccgatggtattactgtagatccgtccctgtttatagctagtcattagctctactattaaacttgctctgatggtataagtctactctggtcgtacaagtcagagcttatttttggctgtatatatatatatatatatagacacacacaaatatagaggtcagatttttatttattattaaaaaaagtcagagcttatgtaaagtagtggagatgatatatattttggcatggaggaatcgtcatcttcaaaatgaaattacaaatggccaactgtatggaaccaattgaccatattaatatgaactcaaccattgtactagctagctattaatgaatgatcacagcagctgattgattacttattacgatgttcaacccaaaatagaaacatcataggtaaggcatgcactcaaatcattaaggctttttaatctccaaaagagagagattgaaggattaagtgaacaaggcctaatgtgaagcatgctggacctggaacggttcaatggaataacaaacaaaattaaccctcaggcgatgtcttctttttacagaggtcatatatttacgagaacttttgttgattactcatgtggaaaaatcattgacattacatatttgcaaacctctctataatatacacaatttgttcaaaaatattataattctagataatttttttgccagagattaatcttgaggagaggaaaaaaactttgatgtccttgttaaatgaggaatggttgggaataatgtgaaaaaaaataaatgggaggtaatggttgatgggacaaattaataatactctaaataaataatggtataagtatttatattttcatacaaattttaaatattagacatgattatattttggaaagaaggcgatagacaggatgctcgacgacttactgccagctgggtcaactcatgagagtcgcctgctgcgttctgaagcctacaaatcataatcttgtttgcagggcagcaacttgcttaccttgtatgcggccctgagtatggagtatactccctccgtttctccgtttctaaattttgataccgttgactttttagcacatatttaactatttatcttattaaaaaaaatcaagtaattattaattcttttcctatcatttgattcattgttaattaaatatactttcatgtttgcatatagttttacatattttataaaatattttgaataagacgaacggttaaacatgtattaaaaagtcaacagtgtcaaacattttgaaacggagggagtacttgttagtacatcgaagatttggtcgacagattccttcaacgaactaatgaatcagcaatcatcacttgagctggaagaccgaagcttttaatataacactagtccaaaaattccagttgcattttcacccctttgtttcctcatacggagtagaagtatataccaagaaccctgcatgtatgatgtatctgtttttgtcatatgagcaagacaatgcacgactgtgtaggtgctgtttggtttgctcctacaacttatctaagattgccacattcactactatacaagacatcaaatgtgccagtcaggaaaccctcgttgttgccggttttttcaaccggcaactgaaggcggcattaattagtgcgccgacagcaatatcgttttaaaaaccagcactaatgtggaatcgacgagccaaaaaaaaaggaaactggctcgagccaatacttcgagtcgatgagctcccacatgaaaaaacaaaaaatgatgaacagatcccacgtcaactcacatcaatagatgaataagaacaacacatgatgaataaatctcacatcaactcatgtcgacacatcaacatatttcacatcaattcttatagcaacaaatgaactcctacatgaacaagaacgcatctcacatgaacaacaacaagaatcaatatcaacgcatctcacagaacgcatctcaaagaacacatctcacaagaacgcaactcacatcgacgccgccgccgccggatccactacaggagactccgccgatgccgccctacctgccaccgccgccgccgtcggatccgccgtgggagagggcgccgccgccgccccacccactaccaccgccgctccacacaaccgtcgatgtcgccccgcccgctaccgccgccgacgccattggatccgccacgggaaaggccacccacatggagttagagaaactaggaaaaaaactgttgaactgagggatcaaacccaagacctccttgttcccacggaaggtctcaaccaccgggctatgtaacgatgttctaggattgtaacacacatttatttgaacctctttaaaccagcagtttgaccggtcgaaccaataaaccagtgaaccgagtgcctggtccggtcttaataactatggtgccaagcatgggggaaagctagctggcacgtgcgcgccagcggcacgcacttccgcgtaactaactccgttagttaacgctaatgacagtagattgaaaaaattttcagttagatttgaaaacttttgacttaagatttaaattttaaagtcaaattttgaaaactttcaactcaaattcgaaaactttcaactcgagattcgaaaactttcaagtccagatttgaaaattttgaaaactttcatcttgaaatttgaaaattttcaactcgagatttgaaaactttcaactcgagatttgaaaactttaaagtccagatttgaaaattttgaaaactttcaacttgagatttgaaaatttttaactcaagatttgaaaactttcaactcaagattcgaaaactttcaagtccagatttgaaaactttcaacttgagatttgaaaattttaactcaagatttaaaaaccttgaactcgagatttaaaaactttcaagtccaaatttagaaatttttaagttcagatttaaaaattactagtaaactaatcactagtaaaaaaaaataggaaactaatcactagtaaaactaattacgattttttctcctactcatacggcatcaaactgcgaagaaagcaaaacaagaaaaaaagaaaaacgacggtaggttagcgaaaaaaaatcgcgtgcgcgcgatgcgtgggccgtgtaggccgggagtgcacgctgccggcgcccgcgcacgaattaggattcttgccaagcatgtgggctgaatgaatcatataccgcatatgggatttacttctattgggcttccacctgtgaccgttgagggaataagttcatctgaggtccctttacttgtcaacaaatccgattttcgtccttgaaccctaaaccagatacaacgggtccctcaactatcaaaaccagtgcagataaggtcccacagcagtttagatggcggttttggctgatgtggctattttgactcggtcttcctcttacgtggcactaacgtggcgcttacgtggcaattcgatccggaaaaataataaaacccgtgggacccacatgtcagtttcacacacaaaattaattaaaaaggtgggacccacgtgggccccacatgtcatcctcagtcccctcctcttcttcctcctctcccccctatttcccctctcctcatctcactggcggccactgggaaagaaacggcgcgtgggcgccggccggagggaggagaggagtggcgcatgtgcgggaggcggcgggagagaaaggagccgcgtgcaggcgccggccggagggagggttggagcggcgcgtccgtgtagtcggcggccggcgagaaagggttgcggtagccgacttctccctctacttcctctcccgccgccgctgaagacgacgacgacgatgacagcgacgggtttgacggcgtcctcttcttcctcctctctccccatctccctgaagatgcacttaaatcccctagtgggttttggtgattaatgacaaggtggttaaagggaactaatgtgtttatcaagttttatacacaggagtttagtcccaaagtatgttgtgatggctaagaatacatggagaccccctaatttgaaagatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggatagagaggcctacccgtatgttctggccggaacttccgggcaccgaggtatagcgagaattttcctaagcgctgcccggaagttcctggcacttttacccggaacctcctggcaaccctccagttcaaatctgtgagtaacggctagatgacatcacctagccgttatatatagccaactcgaccccagctcattctttggccattccacttcagttctttcatgttctagggttttctagcctctcctaagctccctttgcttcctccactcaaatctagagcctatcttgagagattgagagaatagatgagagtgtaggtgtgttgtggagatggcttgaagattaggtttgattgagcactttggataccttgtgggctgtcacttgggcttattactctttgagatcttctcctagacggttaggtgtcgctcatgagcttccaaagatcttgtggatgtcccgggaaggtttgtaaaggttttcctcacctccgcaaggaaacgaggtaagtgagtaaagttcttgtgctgagctttcagaggttgtcctaggtagagcaacttgcacttgtggtcttttctagaaggaattgtgagttagatcttggtggtcactcaattctagaaaatgacctagaagtattgagttgaaggctgtggacttcctctgggatctttgcataagtgaggcaaggggttaatcgagacccggctctttggagcacctcaatggagagtaggattcgtgtgatccgaacttcgggaaaaaatctcctttgtctctattgtgcatgttctgtgattgtgcctactagtatcttgtgaactgtattctgtgaatctctgtgcttgttattgcttagctagaaactcattttactcggtgattttgatattctctattgcccggaagttcctggctcaagaactccggaagttccgggctactcatcactgcctagaagttccggtgttcatcaccaggaagtttcgggccctggtaaatttgaccgctgcgtttgtttttgaagaagttttcaggaacgcctattcaccccccctctaggccacatctctgcctgttcaattggtatcagagcctagtgctcctaattcaagcttcaccgcttggagagatccaagatgtcggacgtagggggagatgacgcgagtaatggaaatgaagatggagcgacaagcaagggaacacctgcatctaagggagtcactataccttttgattacagtaaaattaccattccctcacataactttgtctctgtgccttccgggcgtgctcctccatttgatgggacacattatgccgcttggaagcacaagatgaagttacatttaatctctttgcatcctagcatttggaaggttgtgtgtacaggtgttggtgctccaaatga

SEQ ID NO: 63657 - DNA, 690 bp, Oryza sativa
cccataaacatctagggttggagggattcctaggctcccaggcactcaggctcagccgcccaccagccagcgccgatagccgaccgcacccggcgccgtcccctgcgattccgcgccgccggcgccgtcccctgcgattccgcgccgccggcgccaccaccggcgtcccctcccggcctccccaccccgcaagcccgcgtctctgcgccggggcggcgccgccacctccgtccgcaccgacaaccgtcccctcccctcctccgcgccggcgccgtgcggcctcccctccagcctcccctcctccgtgccggcgccgcgcggcctcccctccgacctccccgccgtccgtggctccgcgccgagtcgccgacgacgacgccgcgccgtgctgctgacctgccgcgccggcgccgcgcggcctccccgccgtccgcggctccgcgccgtgctgccgacctgccgactgccatccgcccgtcccttccccttccgtggctcagcccactagccaggtaacaaatagatgcctaaactaaatgactagatttgtgaatttgtgattagaagatttgtgaatttgtgattagagattagttagtctgtgaataactgagaatgcaatttataaattgttactaattagtgaatgtgtgctaaatggtaattgctattgtttgtaggatctatgtt

SEQ ID NO: 63658 - DNA, 559 bp, Oryza sativa
gtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagccttgcactcgcgtcgcacatatcgacccatccatccggcacgcatgcaggcgcagcaggccatggacgagcccgccaacgcgcagctgtacggccacgctcacgcgcactcgcaccaccaccggagcaagcgcccgtcgcccggtggcggcggcggcggcgcggcg

SEQ ID NO: 63659 - DNA, 14917 bp, Oryza sativa
ctagatagagaagcactccaacctagcaatcatatcaacggcctcatcgtttcgcttattcggtaaataagtcaaacaacatatttacaaatgaaaaataatttgtgaataaaatttttatatacatgttcttaacgatctaaaagactaaaaaataaactttgatgaaaaaccccaaaatcaactttaaatttaagattaaatatttaaatttcggctgataagcatgagcgtaagcgaaaagataaggctgcaaagctgttcaataaggtagtgtttggttgctgggataggatgggatgggatgggatgaacccatttttaggggtgtttggttcaaggttgagtgggatgggttggtccctagaaaggaatattcctttcagatccgggaccaattgatccggccaaaccggccggaccaactcatcccccttggaacgagtgaccggcgtgaacgagcgaaccccttggcaggttggcggcctggttggggggttggtcttcaaaagacgccaccgggttagccaacgccgccgccgccgggttcaacaccgccgccgccgccgccgtaaaccgcttcggccacggcggtggcggacggctcgggcgaccgcggcggcggtgggctcgggcgacgtcgacggcggtgggctcggcgacagcggcggcggggggctcggtggcagcggatccggtggtggggaaggcggcggcggcggatccggcgatagggaaggcgacggcggcggatccggcgatggggaaggcggcggcgacggatctggagccggggaactcggcggcgggccgaccgtgcgtcgtcgcgcttctccgcccgcccgaccgcgatgatggccgtgctcgccctcctctccaccggcctctccctctccctctcccgcgcggacctcgttgccgtcgtcatcgccaagccgcggctgctctgcgcgaaggctgacaccatcgccgccagcgctcggttgggtcatcccgtctgtcgtagtcgcgctcctccgcccgctcgtctgtgatgccgacaccgtcatctcctcggtgcgtgtgacccaggccccgaccagcccaagctcatcgacgccatcaaggaggccggcgacgaccacgtccggaggtgagggcagaggcggcgtcggccatgtttgttgtaaacggcgttatcggtggttgcaaacagcgctcatcccatccctccctcgtcccttcaaccaaacaaaaaactgggatcgtcctattctacaaaccaaacacccgaatggaatcatcccaatcctaaaatcagggatggtttcatcccatcccacctagtcccagaaccaaacacacgctaagatttcaagcgtttcaaacttgtagtgtgaaactaacttttgataatcaaataattggctcctatgcgcctttttgtttttatggtatggtaccttctactaccatgtgtagtagtgtagtaaattttaaatctaactatatattttcataagtatataaaatattttatttgaagctttagtaaaatatatttaccaattcatctattttaatatggtatatgatacacgaatttattgtaatgttatatatattatttctaattttacccctatataatttctactacactactaccgggtgtagtacaataaaatcaaatccattgaatctgaagcgattaaaggctcataatcatttgagggtaccttaaaattccgtctttaaggccctcattagatcccacctcaaaattttacactctgccacatcgaatgtttgaacacctgcatgaagtattaaatataggctaaaaataactaattgcacagattgcgactaatttgcgagacgactcttttaagcctaattgctccatgatttgacaatgtgatgctacagtaaacatttgctaatgacggatataatatctgatgtgacacgcccaaactttacaatatctaaacaccccctcaattcccttctgtttaatgattaaacaatatgactactttcaggatattcacccgcaacaataggctggattatcaactgttcttccggacgagaggtgcctttagacgactgggctggaacgggctgatggtaatcgtgtgcttctccatttctgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcacatattgtcgcgaccgggaaaattgccttttcccgaacgctaatgtattaatccccgtcccaggaaaagccggggtacaccatacaaacatgatataaaagacacatcttcattatatcgataatatttacattattacaaaggcgcttcaggcctgacaaacaaaaataaacagcagcggactagcgggcctacggctccatcttcacaggcgctcaactggggtataagccaggactccacctaagacttcttttccaaagcttctcttactgaaggggggagaaagatagagcaagaatgagtacaaccacagtactcagcaagccacaccggagatgcacaattaatgcaagggagtacaaggggataataacatagaggttaagttttgcagtaaacagcatttaaaagtcacttagttgcccaaagccattttataaagacgatcctagagctacacagtattattaatcaaggccgtgaaccctcacgaacctgccttaacccaaggcctacgatgattcagaccgaactggcaacccgaccctgggtcccagctcgtcccaagccaaaccaggccgaccattccatattttagttgttgagcaaattttaagaattataacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacggccggaacccccgggacaggcaggcaagactgagcccctagcagcagggcaccaaccctctgccaatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatatccaattccaccataaaccaacaattccatagtgtccaaatgatatgagaatttcccaaagtctatagttataaaaccacctaatgttgcctaattaatcagcgaagcatctacctaaattcatactagtggaaccacgaatagagtgtccactagatggggttttgtttaatctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgctttggaaacctccggaacgacgaaagctacgcgaagcacacaagcaaagctacaagcctataaagaagcaataacaatacataaaaagaaagcacagggttctttaggttataacaaacattaggagacttgaacgggtcgattcggagctcgtatgaccaggatatgatcatccgaagtttaatgctgttatatggagatttgcggattattataattaagctttgcaattataaaacaggtgcaagcgctagcctggaaaagacaggaaggctgcgccgttgacatgcggaccccacatatcaacctaaaggaccgcggtagaccgagtacacagaggcggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcggcgaggcgtgggaacaccaacgacgaacgggcgcggcggagacagacgggcacaacggagacgaacggcgaggggacggcttcggcggcgatccttggacgaaggcgagacgcggccggcacgaggcttgacgacgcggagccgaggacgaacacgaggacggggctgcagcgatcttgacgaagcgaggacgacgaacgagaacggcttgacggagggacgaacgccacgacgaccgggaacgacgagaggacaacgacgacgacgacgaccgggaccggcgaggaggcgacgaggacagccggcagcggctgcacggggacgaggatgacgtggaacacgccgctacgatgacgatgacggaggcggcgccgcgaggcgacgagccgggcgaccgacgggacgtcgacgacgagaacgatcggagacgacgatgatggaccgcggaggggtttggatggaggggaaacgatgccgaggacggccttgccgctgcgatgccggaggtggtggaggtgtggccgaccggtgcacgggcgaggagggacgggcggccgaacaactccggcgaggcggctggagaggttcgcggcgatgtgcggcggcttccgggcgaaaccgaggggtggacgaggtggagggctacgtcaccgtgccgagggaggggacggcagcgccggctgacgcatgggcatggcgaaaagggcagccgggggagatgccgccgaggaggaaggagaagccggcgcgggcgacggtgttccggcgaagttcgggcgaggaggaggtgatgccggggatgagagcggcgtcgtggagccgaggaaggtggtggcgacgtcgaccggcgctcaggcagggagatagaggcggctggaggcggccggcgcggaggaaatggaagggcgacggcggaaacgtagctccgggggtcacctcgcgagacggagggcaggccggggtggaggaggtggcggcgacgctggaagaggcgacggcgcggccggccggtgcgcgggcgaggcggcacaggcggctggaggccggccggcaacgtgggagagagagggcgacggtggggaggtggctagagaccacgggagaccgcgggagggggctaaagcgatagaacggagcgagggggttgcattttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaagagagaggagggaaaggggattattcccctcaatcaatttgggaatcccatgcttgaatcgcgcggatttgagggaggaatggcgctagggttcacgggagagggagagaggacggctgggcgggaggaggacgatgactcgcctgacgcgtgggccccacgcggtcaggcggcggctcgggcaggggggggggctcggctgggccgggacacggcccaggtgggagaggagggggaggcggcttgggccgagcaggccgggaggggagaggggggggaaaggcagcccgggagagagagggaggagggagtgggccgggaggggaggaggcccaagaggaggagggagagaaggagagggagagaaagagagggaggaaaggaaaacttcggccgcgggccgaggggagagagggaggactttgggccagacttggcccaaagggaggaggattatttttagattttctttttattaaactttgataattgttgttgttgtttaataattatttccggtgttctgaaaattcaagtaaaatttgagggctccttttagaccaaggagaatttaacaaaaattctccgggccacatttgaatttttcttgcacgtattttagggtttgccaatttcttttcgaattttaattaattctattattccttttagaaaatgatttttatttcgggatgaatttatcaggacgtgacacatatgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccaggttttttccttttcaacttattgttgtttattagattgatctctaaatgtcagattaatctctcttggtattttctgctgtttgcatgtaacgccgcggcactactcttgccgactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgttgccgtcgactggtgtttccgcttacgcggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatattttgccttttcctctgcctcactacaccaattggtcttccattgagtagtgagtcgggggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgcttggggaaatcaaaattaacaagagaagaaatacgtatttataaactgcttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccaccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttggtcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctggcctattatgctgccgttgttaggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaatacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccaactcgtgttatgccgccgccgactagtgcttttatcttcacaactgcgcgtcttcactaccggtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttggacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgttgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttatcttgtctctatgccaactgcgtcagctaccatcaatagacaattgtgactacgacataaggacaagctatatgctcaggggcttactagttcaaacacaagtattatgtctccaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggccaaggcctaatatgtctgcagcccatattttcaggtgtggcctgtcatgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggggtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttagttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcacatatgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacaatttctatggtgtctacggttgtttgggaagtacgccggccacgtatagtgattgaaattatggtagtattgtttgctgctggccagtttctatgtgctgaagttctaggaatgcgcctacgcatcaacagtcggctacgccgtcagatatcgctgtggagcctagtggttgcactctttattacttgctttctgtgtttacagagagcacaggagctcatagctggccatgtggatattgtacggtttgctccttgtggttgtgctcctagtgactattagcaggctgcagttcccaattataatcagccgagtacagggtgatttgggtcgcaaatacatattttggcgcccatttatcctactagcagctcggaaagttccaagaaaaaggtatgagcaaaccagtggcaaatccaaaaaagacaaaggaactggtacaattttcaatgatgccagcagtgatggctctgatgatgaattgggcatcggaagtgaaaaggctgccattgaaacttcttcagatgatgcatcctcatcagctgactcaggtgggaacctcattgaaatagtatcactgaacatgctacttaccagtattctctccgattgcatttgcactttgttttgcatatgtttaaccgtggaataaaaaactatgccctctttgtttatctcttatacttcttctggaaaataccctgttctatgcaaaatgcaaaagcgatgaattaaaagaaagttaacgaagacttgattattgagagaactgatcatacaacagctagtgttgcaatttattttcgtacgttcacttggaattcctgtgttgatatttctttggctagtattatgttctatgtatcttcagaatatcatttaatatttgtaatgctggtttagtgctatggtgattacgatatggaatgtcaggagcaatgtactctttgtttagagcagacttttcatgatatatgccttgggattctgattcagtgtgattaattatgaaatattttctaacagtgcatctgatatgctacctagcttgcttatgaaagtgatctaattgatgtgacaggtatttcattctgagcccatgatagtggcgagcctgatgacgatggcaatgcatcactgtaagttctctaatttacaaagagaatggtctggtgtaggaattacgtttccttcgattttgtttatgtactccctccgtcccaaaaaaagtgaatctaggactagatgtgatatattatagtacaacgaatctggacaaatgtatggattcatagtactaggatgtgtcacatccagtactatgttggttttttatgtgacagagggagtaatgtagatgagcaggtacagatattgtatggtactgaatgttgatgatcgtcaacaaattgaaactttaggatttgctgctccaatgaggtgcacactggtttaggatctttcgctattgtctcagtgacatgtgggcctacattgagtggcaaatcgttctttggtgatgcaaatttcaaaacgtttttcacattatcaatagcgatttccaaaattttatagaatcacctgatatatctgtcatgagaatcacttagaagaacaaggctaccttctggtcttttgctctagttgaagaccgctgacacgttttctttttatttcttaccatttgttcagatcacagaaatctcgcaaaggggggcttggctccatcctcagaggctcttgtagttacaagaaggcaaagcagaaacaagccgtgcaattggatgacaccgaggttcctgatagccagccaatggacattttctgagactgaacttgatacttgaaagaagaaacacggacagctttggttttccattattttcatccacctgatagcatgccctggagtttgagcattgcatattagtatcccaaccagccttgataccatgtagtgggaagaaaaatgcacttggctgattctcatgttaccacatggcttttctgctccttgaactaaacaagcgctgcgatctcagctggaatgtaatcactatctggtggattgtcctcaatcagagattccactgatttttttatgaggcggtgtgcaactcttccaaaaaggataaatgtagcattggagctggcatcaccggcgatgagcactactttatatctacatgggtaatatacatgtgtatattaatgtgtgcagcacaattagtaagcatggaaaaatctggaatgaggtgtggtatgaaccttggatctggtattcctatgttagaacagcttgagcatttgtagctagaaccgtatggcttagaagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgttcttgtgaggattgagggcaagtatttcttgaatagttttttcctctgcagtgtcctggttgtaacctgttgctgggttatcaa

SEQ ID NO: 63660 - DNA, 10496 bp, Oryza sativa
tgcatatacatgatggagtgcaattctcactatgccaattgtttcaagagaaaatcccttatatacccctgaaaattttcctaatcccttctatacccctgaattttgcttacttccttgtataccccaaaatttgattttgatcccttgcatacccctcccgtcagttgactgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaatacgtatttattttttttaaaaaaggtcataaaaatgaggagcattcatataaagataggtataccaatgttcacaacattttttttatgaatgctcctgataaaaaatccattgtcctattaaaatttcaaataaaaattttaatttttacatttattttattttcaaaatttatgtcaaaattttctgcactaattatttagtctcattagttttataaaatgcacatgatgtgcactcaaacaaaattttcaattatttttgaagcttatatttaaatctaaaacatcaagggcaaaaaggacatttgcaaccaaacgaacagtgaaatgatggaaaatgtaacggtaggggcatggaagggatcaaattgaaatttcaggggtatagaagggatcgggtaaattttaggggtatgaaagagattgagtgagttttcaggggtacacagggaatttactcttgtttcaatgaattccgaatgatggatgcagtgtcgatgatcgaagagacaccctcaagggctgagaagtacaagtttttcttcggtgacgcaggtttcatggaatgtaacacacctctctctgacctagtggggagggcaaaagaactgttgagtcgccagtggtcgcatggcatcaacagtgccacctgaaaaaaactgaaagatgatttcgtatttacagtcaaacgaccatgcatactttttagtatatggtaaataagtgattgtgcatatgacctttctagaaagaacatagatttgcctttgagatgaacaaaggctattgtatatgtacctaggttcaccagtcgatgcttgtggatttcaatggactgccgctgcttcgcttccgccatttcatttactttatttgacattttgtaatatgcatgaccatgcttggtctatttggggtcccaattgggtaacccttgtattttttttttagttcaaccggcgcgctttattacatactaggatcagtgaaatcacgatccacaatagtttgaacaatgtcagggacagggtcagtccacacacttgcttgacccggttcccagcacacacccatttgagatagcttatgcgcagccacattacatgatcacggagcataattaaacacaacactagagaaatttaaatggacgaggtccttgatctcccttacgatagaactgcatggagacagagcataatcatgagagtggaaggctctctctaggatggatgaatcagtttccacctggacggagttaataccatgcgaaaaggcagcttgcaggccagctaaacaagcttcagcttcagctgcaacagcatcgtgcacatgttccaggcatcctgcacccgcaagaacagcacatccaagatgatcacgaaccaggaatccataaccaccggacttgtttgcagctcagaaggctccatcaaagttgagcttcaatcttccatctacagggggaacccatttattccgttgcacattcacatggggacgtttatctttacgcattgaggcataatcatagaccagcaatttcaccttatggaccacttctttcactctgattaactcctcacccgacttcaccttattgcgtgcataccaccaaacccacaaaagaaagaagacctccattcttcgatcatcctccagcttcaaaatggtctgtaccacatctctagcagaaacaagctgaatcaagcttaaacggatatcttcaaggcataaaattctccaacagagtttcatgggcttgcatttcaggaaacagtgtccaccattctcatcaaaccgtttgcagactgggcatagagttttagcgtctggtactctccttttaatgttgattttcagggggaggctgttatgggcaagccgccagataaacagtttgactttaggaatgcattgcaaactccagattttatcccactcgaaattccgctggtgcaccgctccagaagaggaatcgcccacttgcttcttcgccgatctctccctttgatcttccaggacatgatacgcagatttaaccgagtacattcctctcgtatcaaaatgccaggcaacaaaatcatctgtgtctgatctcaccggaatcgccagaatgttcctggcatcagactcccaaaaaatctcctccactagtggtttatcccagcaacccgtaactgggtcaataagatcagctaccttgttcagcacagtgcctcttcgtggagttatcagtcttcgggtaactccggcagggatccaaggatcctcccatatatctatgccgctcacattgccaaccctccaaatcatcctagccttcagggcagaaagccctcggataatacttcgtcaagagtatgagataccaggaccttccttgacattcaacaaattaccgtcaggataatacttagccgttagaactctcgcgcacaaagagtctggctgatccaagagtctccagcattggcggcctaacatagcaaggttaaacaaatgcaaatccctgtaacctagcccacctttctccttccggctgcaaagtaactcccaagaaagccagtggattttatattcctgttcttgctgagcccaaaaatacctgcagatcatcttgctgatctcatcacaaagagtgcgggtcagatcaaaacaagacatagcaaaggttgggatagcttgagctacagccttaattagaatatcctttccagccttagacaacagtttttctttagtcacagaaaatgatgtcagcttgtgatattcgactgtgccaactgtgtaccacctattgatccagggagtggtactgtattatacatggggtttccggtatataaaaccgggggccgacaaaagttccgattataaacaagttttagatacatgaaaactataaatacgactagtttatttgaaaaaaaaaatcaaaatatgaaataaatctaacatttttggaaggagtacatgatatagaaataaatggcccactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaagccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctaactttctgtttaataaataagaggttaattagcacgttttgaatagcaatgtagatattgaaatgagcttattcgccattagcaacaaccttagggtcgaaatctttcacctctcttagaagtgttgacatgttgtggcacacgtggaaaccacattggtctccgatctgttgtgcgcatgcaaacttggtgtcatgataaaattcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccaccttagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaaactttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaatcacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatacttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactgttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgtcgtccaagctcgctctttctcggcttctgtgaccttgccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggtatataaatgaacaagtgtaggggcaaaaaaatgaacaagtgtagataatctgttcttattgagcaattcatcactggccatttaataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatagcccatatctcaaatatgcatatatttcatcaaaaaaaatgagacagtactactaacttcatgtaaacagcaattcatccattcaattcaatcaagtgtagataataaaacagcccacaatcatttatgtggcagcagcagcaagggtatataaatcatgtatataaacaacaattcatgcaattcacctattcatagacaaaaagggtatataaatccacaagtttagataatctgcaaagttccttaatcatcaaagaatgacagaaaacaaaatgcatggagaattttggtgtctaggtcggttccgtccatggactacactgaccaatccaccaaaattccccatgcattttgtattctgtgatggtttgataacctcggaacaacattaaatctgcggccaatcaatcaattcttccatttgaactaaatttcaaaccctaaacctaataaagttccttaattatcaaagaatgacagaaaacaaaatgcatgaaaaattttggtgactaggtcggttccgtccatggactacactaaccaatccaccaaaactccccatgcattttgtattttccatttgaactaaatttcaaaccctgtatatgctttatttataggaaaagggaacataacccctaactagctagctagataaactatttctagctagctaccctaccaagctagaaacactgttgccaatctatcaatccatcctttttcagctaaatgtaaacattatccccaaaattcaatagttctagcaaaagggaacaaaacaacatataaagcagtacacactccatgaatggttacatgtcaaaatggcacttaaatccacattcaagttttaaataacagttgcaacaatctgaacggaatgacaaaattcatcgttcatccaaagttcatcattcatccaaagttcatcattcattcatccattcaattgcatcatttattcatccatccactgcaccattccattcatgggcatcagagagagaggggtacctggagaggagacgacgagcagaggaggcggcacacggcgacgacgagtcccggcaggcgcacggtgcacggcttctcagcacggcggcgcggcggcggcttcttggcacggcggcgctgaggaggagaagagggggttaatcggcgaccaatagtaaacgaggggaggcggggggagtgggctcaccgtggaggtcccggtcgagaggaggaggcggcggagaggagatcccggtggcggcgacgacggtcctggcgtggcgactgagaggaggtcccggcggccgtcgagagagtgagtgaggcggcagcggtggagaggtcgaggcggcggtggggagggcggcgtagagggcggagatggcggtagagagggcggcggagatggcggcggagaggtcgatggagatggacggcggcggtcgagagagtgagtgaggcggcggcggtggagagggcggcagagaggtcgaggcggcggtggggagggcggcgtagagggcggcggcagagatggtggcggagaggtccaggtcgaggcggtggagaggagggcgtaaagggtggcg

SEQ ID NO: 63661 - DNA, 4961 bp, Oryza sativa
atacagtcgtcggtcagattgcgggcggctagtctgaccgcttgctacaatccggtctgaccagctttagctagccaaatcagctcatcacctcaaaatactgtttattctcatccggtctgaccgatacacacaccccagtctaaccggtgccaaaaccattttgctaataatctccaaatatcaaaaaaccaatattctcaaatagcaattgttaatcacaaaataacaatcaaacacactatgattttacaaaaaacatagtgtaattggctataaaagggaggcaaaggcaaacctatctgcaaatgctcatcaaaggcgggttatgcctgtattatgcatgaaaaaacttataatttgttctaaccctgatcataaaggaaggctagtagttacactatcagtttttcttttgcaagaagaggtgcattgtcatgagtcaacgcgtggagtaactaaacagaagttctgaggataatttggttggtgggcagggaactacaaacattgtttattactccctctatcctattttaagcgcgatcataagtttccgcatcaaatcttgatcgttcgtcttatttgaaaattttataaaaaaaatttaagaacataagtcatgcataaagtaatattcatgttttatcatctaataataataaatgtactaaacataaaaaaaggtcaaataagaaagacgatcaaagttggacacggaaactcatgaccgcacttaaaatgggatggagtgagcacttcctccatacatccacaaatataaatatttctatagtactacttccccattccaatcactcctcgtttaatttcttcatcaacccttatcccaaccaatcaaggattcaaccagatgtatggaagtaattttccgtcaacctaatttttttaaaaaactctaaaagtaaattatattagtggaaggagatcttaacgaatgatggagttatgagctttcaggcgaatcaaggaaacttctccgtgaagaatacaagcacgcatcaaatctaaagaaaacaaaaaaaaagctttaaaatgtcaaaaaagaaacatgtccacatggcttgtttcttcatacaactcatgctctagatacgtaccacactgttggtgtcggcatcacctacgtcattaagcactgacgcagtcacaacaccaatacttacatagaacaataccaccattctactccccactgtcctaacttgaggtgccgctagccaaattccaaccttcatctcatcactccttgcgtgattgcgtcggcctcccacacaaccgacggttattgtccctcatgtatgtcaggccaaaatgaatgctcaagtgtaatgaattaacctgtcaaatgcttggaaaacatttattagtatattttttaaattgtgaataaatatttaaaaactcttatgtttttaaaaactggtcaaataaaagaaaaggctataaatttgttgcggtttcaaaggaaacggattatactcattgttgagagatatacaagtgttccaagcctcattcggtcgttcctgcactggcctccctatgcatttgctcggctcgcaatgcacggtgtcaccactatcccatacatctcctggcacccgaagatgtttctcttcccgtcgatgtcccatccgtcattagaagttgtggccattttggtggtggtaatggaccacatgaaggcggacgctcgtcgactagggcttgctggttcgtggatatcaggtcggctaccaagacagtcctcttcgtctaggtgatcaagctagatacctctactgagtaatctatgatcaagatgtattgcttgtccaatgtgcttctttcctaatgtcacctattcttaaatggacgactgactctaacatgtttctgttgcttccgtaagtgtacatgttatcaaccagcgaaaatgcaaaagagaggatattttgtaaggtaacagtctaacggacagatataggaggaagaaaaacttttgcttggaaggcacaatgcatggtaggtaatttcctctgaaataggtgtgaataaaatgattgacagatcatgggtagaaaagaagaaaggttatccgggaaggatataaataggagaggccaagaagctgaagggagacatatatagggagataggtggctgaaaaatgtacttttcttccacaaaggcctggtttagttcccaaattttttttcctaaaaacgtcacatcaaatctttgcacatgcatagagcattaaaaatagataaaaacaaaaactaattgcacagtttgtatggaaatcgcgagccgaatcttttgagcctaattagtccatgagtagccataagtgctacagtacccatatgtgctaattacagcttaattaggctcaaaagattcgtctcgcggtttccaagtgagttatgaaattagtttttttcattcgtgtccgaaaaccccttccgatatctggtcaaacatctgatgtgacatccaaaaattctcttttcgcgaactaaacagggttgttagtaattatacttcgcagtgtgcagaaaggaaactaaaggagatagcatttgtgttttttactcatgccttaatcgaatgttttctttacaagtgatattacatgtcagtctttcaattttttttcttatttaaaataagcacaacaagcacatgcatagcataacttatatacacgactgtagaaagcatttttactcccggttttgcaacctagagtatgactccgggactaaaaatgggtatcattagtcccgggtaaaataatcgggtctaaaaatccatcttaatttagtcccggttgatgttaccaaccggaactaaagatggcagcgccagcccggttggtcaccattttttttcattgtttcttttcaaatcaagttgctccttcgcaaatcaagttgctccctacatattcccaaatcaaaatcaaagtatcatcagaaatcaatgaatcatatattcacatcacaaattatcaaaagaaaaaacataccaaattcttaaaaaaatcatcacagattatacatcacaaatctaatgaatctcaacttctaaaaattctcagatccaatgtatcgcaaattcttaaaaaaaaaagaacaacaaaatgctgccgctgtcgcctcctgcctccctgccggaagaggggagggcgccgccggccgccggctcccgccgccctcccttccacccgccatctgccgccctcggtgcctgggttcggtgccgtccccgccgcctgggcttggctgtcgctcggccgcttggagaggaggaggcggggagggggaggagaggggaagggggaggaaggagagacgaaaggggaggtggaggctgtaagagatgaggctgagctgagagatgaggctgttaatttaatggggggaggagagaggaagggggaggggataagatcgaccgactgaccgagatgaggcgcatggctcggggtgaattttggccccggttggtataaacaactgggactactttagtcccagttgtttataccaatcgagactaaagataattgggcctggctcgacccgacaactttttgaaccaggactaaaaatgatctttagtcccggttaacaccaaccgggactaaacatcaaaaagtttttaaccaggactaaaaatagtctttagtcccggttcctaatggaaggttcctaatagaaccgggactattgtggattatgggcgaccgaccaaagatggtttctccagtagtgataatatgtagtcaaaacatgcagcatactatagtttcttttatttttgtttaatttgtataagctcgcatgtatatatatgaatttcgagttgttcaaaagagctaactgcacgtctgcacccaatgtggtagtaacattccataagattttccttgctatgtgaaagactggagctgttcatacccatcaaaaccatacaatgcagaagctgtacactatattgctcataattaaagaagtgcaagtgcaatgacaggatcccatcttccatgaaaatatcttaaatttgtcctaatgcatgagtaagaagaggcataacagtaggcaatcaatctctccatgtaatactctctctcactctacagatcttgcaactgcacaccaaatccacacgttccacacatactcatgattgggatgcagcaaacatcggatcattttcatggcccattgtgtcgaccactgtcttttagacatgggacaattgcttatttgaccctgttttgaactgtaattgccgatttggccatactttttgaactttgcttatttgaccctctttttcgagtacgaagcttccgtctgaccctcttttgatgactccgttagggttcgatttttttttaaaaagaaaatgtttcaagagttcctaatgacgaaaataccctccaaaccctattttgactctctctctctcaatcgtgcgtgactctcacggtctcacctctctctcactctctcactcgtgcgtgcagcggcggcggctagctaagggggcggcggtggcggcgagctgagggggcggcggcggcggcgtcaagcactgccccgccggcgcccactcgttgtggtggagggcggcagcggcggcgctttgagggggtccgagtcggcgccgatctgagggggcggcggcaacgatctgtgggggcggcggcggcgagctgaggaggcggcggcagcggcgtgatgtacagccccgccggcgcccgctgtggaggtggagggcggcggcggcggtctgatggggcgcggggcggcgccgatctgtgggggcggcgacgccgagctgtgggggcggtggcgccgagctgtcgtggcggcgacggtgagctcgatgacgaggaagaggagcaacggtggtggagctcaggccgtggtggtgtgcaagcg

SEQ ID NO: 63662 - DNA, 29666 bp, Oryza sativa
tcctgcagcccatttttgtgtctttgggagtaaatgcttcattttgagtaagaagcctcattcatctaagttctcacctaaggtggatgagggattcttacttggctatgagtcaaatacatatgcctaccgtgtcttcaacaaaacctccggtattgttgaagttacaagggatgtgacatttgatgaatctaatgactcccaaggagagcaagttgttgtacatattgtagatgatgcggatcctagcaaagcaattggtactaaggctattggagacatacgaccagtcgagatgcaggatgaccaagaagatagggatcaacctccgtcatcgacatccaatagccctacaacaagacaagtgtcagttgacccagaagttccgggaccaaatgaccggaacctccggaccactccaggccaggaagttccgggtccatctgccaggatgttccgggcaaaggacagtcaaggagtgcctacggcacaagtggatgggattgatgccaagggcactgtaaagcatcctaatcaggctcaagtctcctcggtgcaccatccaaagatacatcacactgtccaaagatatcatcccgtcgacaacatacttggtgacataagaaagggggtaaccactcgttctcatgtcgctaacttttgtcaacactattcgtttgtctcttctttgaaaccaaccagggttgaagatgcacttggtgattcggattgagtgatggctatgcaagaggagttgaataacttcactcgcaaccaagtatggatattggtggagagacccgaccaaaatgtcatcggcatcaagtggatcttccgcaataagcaagatgaacatggaatggtagtaaggaacaaagcccggttagttgtgcaagggttcacccaagtcgagggtctcgatttcggtgaaaccttcgcacccgttgcctgccttgagtcaattcgtatccttttagcctatgtcgctcaccatgatttcaggttatataaaatggatgttaagagcgcctttctcaatggacccatctcggagttagtcttcgtggagcaaccacccggattcgaggatcccaaatttccacaccatgtgtacaagctccacaaagcgctctacggactcaaacaagccccgagagcttggtatgaatgtctccgagattttcttttgaaaaatggttttgaaattggaaaggcggacactactctcttcactaaaaagtttaaaaaggatttattcatttgccaaatttatgtcgatgatataatatttggttctactaatgcctctttttgtaaagaatttagtggtattatgactaagaggttcgagatgtctatgatgggcgagataacgttcttcctcaggctacaagtcaagcaagcacaagatagtaccttcatctctcaaaccaagtacgtgaaggacattctcaagaagtttgggatggaggatgccaaacccatcaagactcccatgcctaccaatggtcaccttgatcttgatgaaaatggtaaatgtgtggatcaaaacgtataccgctccatgataggatccttgctttacttatgtgcatctcatcccgatatcatgcttagtgtttgcatgcgtgctcgctttcaagcggagcctaaagagtgtcatttggttgtcgtcaagaggattctaagatatttagttcacactcctaacctaggcttgtggtatccaaaggggtgtgggtttgagctcttgggctattccgattcagattacgccgggtgtaaggttgatagaaaaagcaccaccgggacttgtcaatttcttggacggtcctttgtgtcttggtcatccaaaaagcaaaattccatagccctatccaccgccgaagccgagtacattgccgtcggttcgtgttgcgcccaactcctttagatgaagcaaacacttaaggatgatggctactccttctccaaaatcccactcctatgtgacaatgagagcgcaatcaagatagccaacaatcccgtgcaacattctcgaaccaaacacatagacattcgtcatcattttttgagagatcatgaaaccagaggagacattaccctcacccatgtgcgtaccgagagccaattagccgatatctttactaagcctctagatgagaagagattttgtgagcttaggagtaagctaaatgtattggattctcggaacatcaagtgatgggtggttggctgaccaatagccaaacatgagttactaaaatgtaaattaaaaaaaaatatattttgagcccttgtgtccttgagatcacttccttcatatgaagttggccttgacaccaggaacaaggctcaaacattccctctatcctcaaaaacccatttgtcaaaaagtttgcgaaaatttttgtgtgtctttttattgcgaaatttggtttttatcttctccttatgatgtatattgaccattgttttgtattgattgattgattggctggtcatatacatcataagcctctgcatgtccatagttttccattcctcagtttgattccttccctttaccttgtttttgggcctgactgcccattttctgtcaggccagaagttctgggcctccctgtccggaacctccgggtgttggggagtatatatactcagggggagttagaaccctagtctctctcctcattcttctccctccccgactccaatccctgccgccgcctacagtaaccctaggggcgatttccattttccaccaatcaaattcgctttttctccgtgaaatcgtccacattggtggctgggagcttccctctgcgattgattcgcagtttcatctctcaaggtagcactttttgattccatctctcggttcattgtgtttttagcccgatctctaaatctgtgaacctagggagaaaaccacttggatagtcttgtttctgctaccttgtagatcaccgatctataggatttgttcacatgcactagctatttttgagatcactgttcttctttttgctggccgaaagttccggtgttcttgcacccggaacctccgggcgctatccagccagcctgccattcttgattctctcaatttttgcctaactactgcactccaatttgttgattcctgttgcagtaaacattatgtctcgtgagaaaagacagaaagcctctcaggatgtgtccggtgatgagagtcctcctattcggttccctcgaggtcgtttgggtaaagagaaagtggttgagggaggcagtggcagtggtcctcgtacttctcccaggttcacaaggcagtccagcaaccgtcctctttagattcgggatgttgacggtggtcaaggcagtgatgcttctagtgcaagaggtcgtgggagaggtagtggtcgcagttctggggctggaagggcatctcacaatttccctgtaggatctcgtgagaatcccattcggctctacaagtctcttggatttgacaccactcccatgcaccacattggtagagccaagtccaactatcttcatcagcttgccaagtgtagaagagaccatttgattgatccagagacacagcctgaggagtcacaggatcctcgcttcaggaccttcactcagttggattggtataactcagtgattatggctagagaaaatccagtggttgagatgaagtggattgattgggcctacatgaggaagaagagcctagttctatgcgacagcattctttggtactactaggaagggtactccatgtgtgaagtggttgactgagggtgttaggcacaagatttccatggcacagcttgctgagatgttgggtttggaggatgaggatctcaataggcccaatattcatagtgaagcacccctccccatgatcaaggtgttgtactccatctttcgttggtccttgcttccaaaggttggagatgccactgctttgccaaccaagcatgctcatcttctcagccacatgcgctacaatcagcctcccttcagtgtgatgaagtttatttggtatgagattgctaacaccatccttgagcctaagcagggttgcatctatgctccttacattatgaagatgatcgagactgttatcgaggtgttctacatcaaagatgggcgccacaatccttttcgccctcgtgctccatcttcctcttctccagtggtgcctagatccattccttctacctcagctggtccttcttctagtgccccacagagttcctctagttcttctcccatcaagaaggctcttcacgcaattttttgcatgtatgctaagactgccaagaaagtgaagaagatagaaaggcgtcagaaggaagatagaagagaggctgggaaagaagtgtcagatgattctacagatgaggtctatgttgatccatttgaggcctatgaggcggcccgcaacattgctggtgaaggtccatccacctacttccatgaagaatcttcccattcagatgatgatgatgatgatgatgatgatgatgatgagggtatcaccgaggcagctgctaaggatgctcccacttatgttgataagggcgactccgctgcacagtccgatacgtctcatctctccggtgataccgagattgttccctctgatggagatggagatgagtgatcctcttcttctcttcatggtttctcgctttttggtgccttgatgccaaaggaggagaaattgtgacgtgaagggggtcatttgaatctttttttgctgccctgactgctgtctggtcatttggccggaagttccggctcttgtgacccggaggttccggccaggcagatttcccctctatcactactttctatatggacatgtaatcgtattctattatggttggatgtaatgactgttagatgctttattattttttatgtcagtcagttatctcatatggttgttgcattttgttgtgatgtagtgttcttttatctttttgagtgattgccatgtcatctagtcattttatttgcatcactcatcattcaagcatttacatctgcatctcttatttgataagtgttgtgtgaagtctctcttgtgctttccttcatgttatgcatattgatttcatatcatttctttatatgcatatctttagggggagcttcacacttctcaaatcattccaaatttaaaattctattatctttttgtgtgctttaaccatattgtcatcaatcaccaaaaagggggagattgaagatgcacttaaatcccctagtgggttttggtgattaatgacaagttggttaaaggggactaacgtgtttatcaagttttatacacaggagtttagtcccaaagtatgttgtgatggctaagaatacatggagaccccctaatttgaatgatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggacagagaggcctacccggaggttctggccggaacttccgggcaccgaggtatagcgagaattttcctaagtgctgcccggaagttcctgacatttttacccggaacctcctggtaaccctctagttcaaatctgtgagtaacggctagatgacgtcacctagccgttatatatagccaagtcgaccccagctcattctttggccattccacttcagttctttcatgttctagggttttctagcctctcctaagctccctttgcttcctccactcaaatctagagcctatcttgagagattgagagaatagatgagagtgtaggagtgttttggagatggcttgaagattaggtttgattgagcactttggataccttgtgggctgtcacttgagcttattactcttggagatcttctcctagacggttaggtgtcacccgtgagcttccaaagatcttgtggatgtcccgggaaggtttgtgaaggttttcctcacctccgcaaggaaacaaggtaagtgagtaaagttcttgtgctgagctttcagaggttgtcctaggtagagcaacttgcacttgtggtcttttctagaaggaattgtgagttggatcttggtggtcactcaattgtagaaaataacctagaagtgttgagttgaaggctgtggacttcctctgggatctttgcataagtgaggcaaggggttaatcgagacctggctctttggagcacctcaatggagagtaggattcgtgtgatccgaacttcgggaaaaaatctcctttgtctctcttgttcatgttctgtgattgtgcctactagtatcttgtgaaatgtatcctgtgaatctctatgcttgttgtagcttagctagaaactcattttactcggtgattttgatattctctgttgcccggaagttcctggctcaagaactccggaagttctgggctactcatcactgcctggaagttccggtgttcatcaacaggaagttccgggccctggtaaatttgaccgctgcgattgtttttgaaggagttttcagcaacgcctattcacctcccccccctctaggccatatctctgcccgttcactcccatctcctttctctaggagcccacgggtcacgggaggttcggtggctagcggcggcagccccaggccacggccagcggaggtgctcctgctccggcggctacccctgccactgcctccacaactcgcggatcctcctccacgtgcctcgtcgcgctcgagctccgcgcaccatggccacgcgccagcagctgtagcgctgtctcctcctctactaccgccgccaccggtttccccttggcgaaggcgggcctcacgggcggagaagcgtggccaccgccacgccacgggccccctccctccgtggcgttcaggtcgttgtcgtggccgctcccctcgcgccgcaactgcgcggggacctcgtcccttccgccgccgacaccaatggatgcggccgcgcatggcgggtggcccatgaggaggcgatggtgcatggaggtgatgatctcccacgccggtgccgtcggtgagttcaacattatcctcggtgcccctctcccttccctccaccactaccaccgcaacccatcgcggacagcgccaccgccaacgacgacctgaacgccgcggagaggggcccatggcgttggcagtggcctcgctcctccgcccatgaggcccagcggattgccgccattccgcgcgccgctgctccagccaccgtcgcgccactccgcccgctgccacgtcggcttcgcgtgctgctgctccgttccgcacgccgccaccccagtccacattgtagggatgaagggaggggagtgacgatgacacgttgggcccgctatttttttctgtgaagctgacatgtgggtcccatggttttgttatttttccggatcgaattgtcacgtaagcgtcacgtcagtgccacgtcagatgaaaaccgggtcaaaatagccacgtaggcgccacgtcagccaaaaccgccatctaaaccgctgagggaccttatctgcatcggttttgataattgagggacccgttatatctggttttgaggttcaaggacgaaaatcggattcgttgacgagtcaaagagactagaacgggattgcgggctgcgtgacgagcatcttgggctaaatttgttgataggcttctgatgggtccaatatgcgccgtacaaatattgggctgaaccttcaagtgcggtttagaaaaggccgaaaacgagatggtcatgaatgcgccgggtctgtatctctctctctttctcgaggttgaaaactggagtagtatttttctgtttccagttttctgcttcttcgcttaaattctgtcaagtcctctctgtcaattcaactgtgaattgttctttctgaaaaagaaaaatcgaaatacatcaaaaggaagcgccgtgaggcgcgggcaactactgtgtgtcagtgtcaagcatcctgttagggcaagtactggaagcccctacatattgcccctaaatttgccatacataattagatgatgaggtgtatgagattgagccacccctcatgcaaggggcaacctttacacaatctccaagaaaaaagtgtaagatgatgtgagtgtgagctaatattggagtttgtatattgggagcgtatcttatgcacacatgccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgtttttttttgttacggctaaaatataatgaatttgacgttaagattttaaccctaggtgtaatacaattgaaagtatgtgtatgatttttttctagaatttttggtgacattttttagttgatgtgcacgtgtgtacacgtgagggcctgtgtgcataggatatgttgccttgtatattagatgtgatatattatactccctccatactcataaaggaagtcgtttaggacagcgacacggtctccaaaacacaacttttgacttcttttttctataaaaatacttattgaaaaatgatacatatatacttttatgaaagtatttttttcaagaaaaatctattcatataatttttatattttcgaactcaacaacttgagagttattcatttatattcccaagatttaacttaaacattgtcataaacaacttcctttgtgagtatggaggaagtatgtgttacctcttaattaatgagaagatgacatattctaaattaaatgtgacatctacctccactataaaacaacttgcccttacgtgccttccctctcattctctcaaatctcaaacccgacaccagcaagttgagacagtgacaaaaggtagtactagattttcgttcaagactgaaaacctctagccggttggttaatcctcgtatcacaggatgggtgaaaattaaggcggattagttttacacctcaatcgtgtttaaatctccccttcaatcacccatggcggacggattaaccaagtactatctctgttgcaatatatatgcaagtcgtttagctctctgttacaacgacttagtacatttccgtaacagagggagcatgtcaaatgtgtcgttcagtaagagatgcaaggacaggtaataatttgatgcccacgtcgtattcaacattctatcgtctccgtttccacgtgtacaaccaaacaattttaacttaccctgaaattgttaaagtttgtgtcgaatatatatacgtagtcgtttacagtttagggcttaaaattgtactggtgttaggactaaaataagagtcggactctgtcataggctttctcataaatagagaggcatgcctgttgtatctgcatggcacctacaatatagcgtatacacgcagggagatgataacgatgtggccatggactcgtagcgactaggagatatattagatcggggaggagcgcccgtaatcagtgccccgagatgtagacatcggctgaagctcgttaacaaatatcatgcctcggtgtcgtcttcatgtttggatcttctatgatgtttctttcacgttcggttttcgaatttatatcgggccggttttataacagaaatagtgctagattagtagactatatagccattaatttctctacccctttctgagctatatattttcgagagataagatggtcctctgcagtactgtatatgcagtagtactacttgctgacatgtgggccccacaaatcctcataaccaaatgtaaataagcagtattagtatatgcaatacggcagagaatctcaattgcctaatggttactgtagacgtgcatactgcatgtgcagtagtactactcgctatcacgtggaccccacagaccctcggaaaaatgtgaaccttgcagcggctgcaattgtgcagctgcatgcccataaagatacctcccatttaggggcggatgtaaccattaggtaggatgggtcgaccgacccagttacgacccatgtcgtccacaccccacatttaggtatagcaaggcgtgaacacccaacagattagtccatctcttcacaaggcacgcacgtcacaaacaacgattgaggcagttatgcgattgaactataatacgatatttgttgtgttagattgctgttatcgagtgaatatctcccttctctgttccatctatcttttaaagttgtgtccgccagtcccattgtatggctgccgagtccacagtcaatttggccacatacatagtgtgcatgctcgcccatttgtacaacatgatttctttgcaagcaaattaagtctttcttgccatcccgagggccttaccgaaattttgtcatatttctttcaataaattgtttagcatgcaatccatgctttttaagaatgcacagtacaacgacacaaaatcaacatacaaagacaattctcggagaaaaccaaagcgacaagagaaagaaagaatatactttatgtcattgagttgacattgtccttttttataatatgcccatgagtttattagttcttctataatatgcaattgggttgtatcttattttcaaaaatacccaaaatacccttatatacatataaggttaactattcatttatcctatcagaagtttcaaaaaaaaatatgaatgtttttagtctctttcatgattcttacatttctgttttttttataaatataatttatctgttatatgttatgtagaatatttttttatgttttaaagtaaatcatctttcttatgctacatattttttttgtactattgtatttttataagctattttactctcatatatcacaggaaaatgactttctaaaaaaatattaaaaaacttgaaacttacataaaaacttttatgttgtctaaggaggttaccataaaaaaaatctgtatattttttaaacttctaatgcgattaatcaattattgatcttgcatgtttttaatgatattttgggtgtttctgaaaaaaaaatagcatgttatagatcaattgataagctcaccagtatattatataaatgtgtaatgttaatgataaattattaaactgatataaactcaatggcatagatcgaatgaattccctcaacggaaaaagagcgtagaacaatgagctacaagtatgtgcgaatatagaccccaacggcctcaacacagggccctgcacggccgaagaagccaacaatgctggcagcatcctccaccggaacaacgaatggagttcctcctccttttccataaggtccataggtgcgattgagattcgtcgtgaacttaagcgatgttatgacattttgtagcatgccaaatgaaccgactgttccagacagcccctttatatgctcaaaagctccaagccgaatctgcgtcaatgaatagagatttttttaaaaagaaaaagtagctaagaaggtattgagaggtattatattttcaaattatgtattatgtagctccaggtaactctagcccacagtccacactagaaaagaattactagaagctaaaggtagtacaccacaaattaaccctaaaattataccttttcaaaaaaaaactaaaattactcaaataaatactccctcgattttaaattaattgttattttaacttttcttaagtaaaagctaaaaactatctttgactattatttttttaaaaaaaaaatccgtatagtttaacagtttgggaatttcataatgtgaaagcttttctcatagtttgtcaaaatcgatgatcaaagatacaagtttaatttgacttagaacaaaactagattgaagtaatttgaaatggagagagtattaggctacttcagtttttacaaaaagacaaaacgatgacatcacacctgtccaataatagaatgtgttgaataaaaagcatgcatgaataatcttctttcaaaagtaaaagaaaaaccttattttaggattccttcactcaccgtgaaagcagcgccaccatcaccgccccatggaccaactgtatgttgcttcccattatggtcgttgtatgagaaggcaagcgagttgatgatatctgcactgcaaattgtcaagctttctaaacggtgaggtaccacctccatgtcgcgatccatgtctccgctgcctccccacggcccgaacttggtaagtgccttaccaacacaaatcaatcaagtaaaaattggtcagcctgtaaactttgaggatgatcttttttttttagaaaaaaaacttttaatgatgacaattatgataaattaactagggtgaaaaagaaatagtacatcatcatccccttttcctctttcctcttgaattgtctcatgctcggagtttacttgcaacgcatccctaaaatgtctgctcaaatcaagagttggtcgattgggactaacatagacaccgatcgaatgaagaaaaccccctgcacgaccgaagaagccaacaatgcttccattgctctgcgaagtgtggaaagcggttccccctccctgtccaaaaggtccgtagctaccactatttgtgaccaaggtaagtgattttacgacatcggccactgcacacacatatgggccagttgttcctgaaatttctgtcagaaattctgatggcccaaattgaacctacaagaggtaaaacaaattgttatgcttgcagtattgtggagatagttaacatcatatccagcatattttaaaaaaaaataataataacttttgggatagatatgttttcttagtattaggatgtgtcacatatagtcctaaattcgtttttttttggacggagtgagtactcactggtggagaaaccatctttggtcggtcgaccaaattccacgatattcccggttgcaataaaaaccgggatggttgaaaaggttagagctactttttaatctttagtcctggttggtgttatcaaccgggactaaagattatttttagtcccggttcaaaaaaggtaggtgatgtcagacccccccccccctaatatctttagtcccggttgaaagggttatagctattttttgatgtttagtcctggttggtgttaccaaccgggactaaagatcatatttactcctggttcaaaaaaacggtaagtgatgtcagacccctctaatatctttagtacgaactgggatctttagtaacaccgggaaaaaagatcggcatacgcggagagatcgaggcgtgtgcgtgaatcggatcgagatacatatctccttctccctcccggttctatctcctcctctcctcacaccctatctcttcctctcctcccccttctcctctcctccgatccccttctcctccccatcttacgcgcgaaggatcctttccttctcctccccctcccccctcctctccgatctgcaggcggcggcgccggcctgcacggcggcggccgggcggccggcggaaggcagaaggcggcggcctgctcagcggcggccgggtggtaggcggaagatggcggcttgcacggcggcggccgggcggtaggcggaagatggcggcctgcacggcggcggccggcaaggtgcagatttgttttgtttttttttctttgagaatttgtgatccggatctgagatgtatttgatttgtgtgtgatgtgaatatgtgatgtatttgtgacgaattttgtagaagttgtgatgtcattttttttaagattttgtgatgtatttggagatgatcaatttgagaattttgaggtgataattgatttgggattttagggatggagatggggatggagtgaaatcaatatattaaaaacaataaagaaaagaaaagaataaatgagcaactgggatcagctggactctatctttagtccctaaaaaggctctatcttcaaccgggactaaaaatgaatttttactcctggttatttcacctgggaatctttagtcccagattcgtagtcccgattagaaaaccgggactaaagggggttaagaaccgggagtaaaaactacttctcccctactgactccatatatcttggaaaaaacattcccatatgagtgttgttcactcatcaaaattttaatcctgatgctcatggttacgcacatacatatgtgtttccaataggatattattcatgtcacatttgagtttgttagtctatgtatttcttgagtgctagttaatgggtgtgtacttgttggtacgtgcgtaatagtgcgtgtgaatgtgcgattgtgggtctcaatgtaattgaaagagaaatcccaattgtgaatgtcaacaaattactcataaatacttataagataagattagttaggagctcaccgtacgagcacttccaccagggccaccccacgggcctgcttggtgcttcgtcttccctttaaggtcaacgtaagaaaatgcaagtgcatcaactatatcagcaaaccagactgtgacacttagcagacgatgggacgccaccttgatgttgtgagctttccctgcatttcctccccagggcccaatctttgcaagcacagcctggccagcatagatcaaccaagaaaaagaattagaaacatagtagagacaatgtgcaattaataaacaattaaatcttgtacaagaattagcacctcctggtcatttcctccccctcttttttcttctttctttggtttcagcttataccttgcctccagtgtcgtcgccgcactatattttgaggtgcttgcgctctatacataggcgtatcgaatcgagagatgtcttagattcacagtgcatctcactggtttgtgcatatgttgtatattgacttatattgggaggggatatataaaaaaagactacatgtacgatggtttgtacttgtaggggttctagtaaaagtattaataatagcggaaacaatctaagttattttctacgactacaaggggcggatctacagtagtatgagcggtgtcaggcgacaccgacgactttcatcaaaacctatagcgaattagcatactatgacaccgataggcatgttatgacaccaacgaatcgattttctggatccgccactgatgtcgactactaggatggtggtctaaatagatatatacatgttggataagaaaatatgatatcgatatgtctagatttattctactactagtataaactattataaaaagtatagaaaaagtagataacaagtattgccagtgttctactaccaatattatcgtcaaacaaaacaatctaagccattgtcttataagttccaccactagtaaaaaacaattatggattctaatccttcgaagaatatcctctcatataccttttagtgaagtggtatatgcatgttgtacacaacacattttttacattttttagaatttcttataactacgtggatgatatttgaaatgaggggacatcaccttattaagggattaaaatagtttcccgttgagatagcagtatggtgacccgtgcagattgcacggctagcatcattatattttattctcatacaatagcatatatattttctcaatgtattattcaaatatattaaaatgacaacataattttaaattttgtactacctttacgaaactattaatgtataatattcatattgtattttatatacgtgttattttatttattaattatttttaatattcatattgtattttatatacgtgttatttattaattaattatttttaatatcaaattttagttatttgtaaattatattcctatatagactctagactcgtcttttaatattttttttaatttcgaatttttgttatctgtaaattatatttctatatagactctaggcacttcttccaatattatttatttttaattctgaatttttattatttctaattgtattcctatgtcgactctaaactcatctttcaatattctttaatttttaatttcgaatttcagttacttctaaattgtattcttatattgactttagactcttcttcccatatttttttaatttcaaattttagttatttttaaattgtatttttatacgaaatctaaactctacttttaattttattatgtttattccgaattttagttagttttaaattcttatatggactctatactctacttctaatattccttatttttaattccgaatttctattatttcttaattatatttctatatggactctatacactacttctaatatttcttatttttaattccgaatttctattatttcttaattgtatttctatatggactctatactctacttctaatatttcttatttttatttccgaatttctattgtttctcaattgtatttctatatagtctctagtctcctcttgtaatattccttattttttaattccgattttcaactatttctaaattgtatttctatatggactctgtttttctttttctccgattaatatgagaatttctaggccgtgagagcgaacgtggagtctcatttttctattcctttaataggttaatagatgtttcaatggatgaaaacaaaaatgaaatgtctatattaattctaataccaatatagactattgtaaacattatctaaatataaggcatctcacactagatttttcttagacaaatttaaagttagaaaatgcaagtttaggcatttacatttttcacaacacaccttaagcaagtaaagttacgaatcttggcgaaaatagatctggcctgcaatgactctgatcatacctggtctccagatgacaatggatcaattggtggcttataaagtaaaagtgacggtgatattttgcgaaccatatcatctagtatattcaatctgctgacaacctcggctatcgtaggccttttcagtcgctgggcctccacacactgcaacgccatttctatacatgtcttcatttgaagtcgaagactctctacttcctctgatgtatacatcggggttgcctgctcaaatcttcttctccaattttcatggacctgagaaattcaaacataaagttatagtgtgtagaaaattatggataaagctagatagaaaattgcttacgagttcgatgaattgttggggagacatgtcagcccgttttgacgtttccttagttcctgtcattatctcaatgattatcacacccagactgaacacgtcaaatttctctgtgatatggcatatctgaatgtattccggtggcatgtatccgctgcaaaatcgataacatcagcacatgttcgtatacacacttacataaagtgtgaataggtatcaagatgtacaatttaattacaaaaatgtaagtgtatatgaggattaattgtcgtctatggtctatcaacttacactgttcctatatacttttttgttgtatgacgggttagtgtatcagaaaagagtcttgacagcccaaaatctgcaatttttggcatattgtttttgtccaacaatatattgccaggttttaagtcgagatgataaatatgatctcgtcgtccattatgaaggtagagtttacaccctcgcagatccccttaatgattttgtaacgtgtgcaccaatcaaatccactagattcatctgtaccatatatagagacgaatagtcattatctaaaaaaaagagacgataagtcaggtcatttccaacccaatgactagagtggtgtccatagcattaaataaaatgccatttaagatgaaagatgatatggcaagtgaataaatgaggaaagagaaggaaaccaggtcttgcatgagatatggtttctacacaacatccaagacatcatgtgagataagtagcattaaatttaagtatggaaaaatggtatttgcattgaaagagtggtgtctactacagtttcttaattatgtggagtttatggaaactatatctagtgtcttgggttgggactagcctgcattcacttgagacatcaatttgggttaccatttttttttattgtttactgcaaagttattgggttaccattttttttattgtttactgcaaagtgcaaagttatgtgtacgtccaaccaaaaactatcataccagaaagatatttgtcaaggcttccacgctgtaaatattcgaagcagagagctctttcctccacatgaacaacaacatacttgccattgtgcagtacaaccttacgtcttgtgtcatagcagtagccaactaattgaacaatatttttgtgttgggcactcataaggttaacaaattcattcataaacttctcatcatcgagtgactctatgtcatggagcttcttcacagcaatctctttcccattctctagtactccctgttaacactaatgtcttgttaatatgatgttatcaacggaaatatagaaaatatagggtggatagcccatctagtctctcaaattttaccaaaggcttcatttggtcctagcttgaggtttcatttcgtccatacatctacctttaaatcatccttgagaccttaatgtgcaacatatagctatttctagtccacattctatttagaaaatgtccctttacccataatttgcatatactagaactaataaataacattgtaaatatactccccattatttcaacacatgagtgttgagctctaattaattagtggccaacagctggccatagtatacttttgcaagtacatgattattattttttacataaattactacgcaatacctattaggagtacgcaaatcacaatgaaaaaaacatcatataattataagatgtatgtttgataggaagttgggttttttactggaatatgttgggtctttagggggtctcatcagacgatttcactgcctgaatagtactccctccgtttcataatgtaagttattttaacattttccatatttatattgatgttaatgaatctagacatatatatctatctagattcattaacaagaatatgaatgtgagaaatgttagaatgacttacattgtgaaacggaggaagtaaggcatatttttctcattttttccatatatatgtgaatgagtggtagaaaggtcatttatcaagacagatggtgattatgtttacccatgtggcttcctatgtgggctcaagtatgagtttgaactaaaataaaaacatgaaagactaaaatagattaattgaaacatcaaagaactagaagtttggctattcacccaaaatatagatattaatcatactttgtatactattccatacccaccatggccaatttgattcttcttagaaaaatcatctgtgatacgttttatcaaatcgaacgtaagatccttgggcattgcatctgtgtgttgtaactcgtccgccatgctctcatgtatctcctattggacctagcttctgtgtccttgtttacagtaaaaaaagagaacagttctattacattaaggtaagtgaatacgtaacaagacatatcattatcagataaaaatgagctcttttaagaggtgtggcaggctctaacaaaaaaatatccaacggtctaattttcaacgtacgcagttgaggtttgggccttgcagctattgaaattataagcacataatgatttaatttattccataaataaatcatggcattgcatatgtaaactaaaataaatgcatcattggatctacacatgtaaactaaacagtaaaacatgaacagatcgaatatgcgcaatatgttgaacatgtaccgaggttgccgaaagatcggttgctcagcaggaattactcgcgagccgtcgcgaaagatcagttgctcagcaggaattactcgcgagccgtcgcggacgaacagggagcagtcgcgcgaagcgcttctcaaaaaccttattgtcgccttctcaatagtctacgagctagatttatttcggttgctcagcaggaattactcgcgagccgtcgtggaagcgccgctagatttatttcggttgctcagcaggaattactcgtgagccatcgtggaagcgcttcccaaaaatcttttcgcgtaggttgcgcgcgcgtgttccccctcttctctccacctcacatacttcaagtggctaggaggacattctcccttttaatgaggtccccctctcctagaataagcaaggtggtactaaactctccattcataccattccatgaggtgggcttttgtgattttccaaaaaattaatctttaagtgggctaagacccatctattaattccaacggcggcaacaagcactctaatcgtgtagtagtgtggttgagacatcgtgaaccacaatagtaaaacatttccgttatcttaaaaaaaatcgtgaatcgcgagtaacctagtgatacatggagtctcaggttctcactgttgaccaaatgatatccaaaattccatccccaaaatcctgttttgagaatccataaacttgaatatattgattcctccaagagatggcttaaagttgtgttcgagaggaggggttgggagcctctctctccgatacgcaacatgaagcacatattagcgtatgattaattaatattagcttaaaaataaaaaatagattaatatgatttttaaaagtaactttttttatagaaaaaatgtaaaaaagacacaccatttagcagtttatatgtagcatgcacgtggaaaataaaaaagataaagttggaaaagtatattaaagaacacaacctaaacgaagtttttaaaattttaaaagtgggccacctgttaatccactcacattaatatctgttgttcctcccctcaccacccaccccccccccctcccgcgcagggtgatgagcgcgtgagaggcccaaggggatcctgactttcggattcatgtttggggcggccattgctggatctgatattttcagcaaagctcccaaaaaattagatagggatttgttttgggcctctctttgtccatgctctaaaatgtacccatattaatcccataaaaagtagggccattccgttctatttctccttgttcaagattcaaatactatcttgctacttccgcagaatggaagggaccataccaatgaaaaacctggagaatgccaggcgagtccggctcaggtgcagggaaccctgcacatagtaatatacaggccaaatcaaattgcgacacctgtccagggtggccctacttaattacgcatgcaacggaggtttaacgaggactaaacgggtgaatggttctgttacctgattttgtgggatcgtggttaaacctccgtttacattgttacttggttgattgggtggacctaccttgtatacaggtgtcgcgatttgatttggcctgtatattactatgtgcagggttccctgcacctgagccggactcatgccaggcgccgggcgcccgatgccgcgtgcatgcatagggcgctcctgacgtgagggggggcccacgcctgtgttgcccacgtgcgcctatgctgcccacgcccttacgctgcttctccacgtgtctttactatatactccgttgcaacaaatcattcatatattttggaaacactctattaaggaaatttggtttattttttgttccaccaaaaatgtttcacctagtgcactcacaatgtttcactatgtatagatctaatgttacagtgaactgaaataatctattgcaacaaaaaaaacccacatattttggaaaccccctattaagggaatttggtttattttttgttccaccaaaaaatatttcacctagtgtactaacaatgtttcactatgtacagatctaatgttgcagtgaactgaaacattctttcgctatttgctgaaatattatttttatataaggtgagacaacgtctgatttaaacgattgaagcattttcgatctacttagtgaaacaattccgatatatctagtggaacatcgtgcaataattaaaaataattcaataataagttaaaaaaaattcgtcggaatatatccatgtgtggtcttgttttgaatatttaattgcaacgaatttaatggtgcaatcggatcatgatttggataagtaatttaggagaaaatcagtttaaagtagttttgcatgtaaatcggacgctgacgtcatgctgacatcagcgcccgattttgctcctagccgatcgggcgcccgatccgtaggttcgtccgaaaaaccttgtcaaaatttttagcagtagtaaagccatcaattactgccatttcgggaccattgcataaaaatatactacaaagcatatcaatggggtgataaaataatgaacatgaacgttcgcagcagaccatcaggaatataacttatcatcttcatctggttcttaaaacagaattactagagaagaaaagcaaatgcaaaagttgtaaacctggagaagcttctatgctcgcagctccggccgtatagaaggcttggtccctgcgatggtgctctttatgtcgtagttatatagtactgagaaatacatgcacccaatttatttattattcataacactaattattgatatgctggtgtctaacacctaactcttcggatgtacgtacagctagctgatggtccaagtcgtggcgtgtctaggcagtggagacggcctatgggcatagtttagtgaagacaggataggttggcacagaagaatcatctttaaaatgaaattccaactggccaactgtatggaacaaattgaccattttaatatcaagtcaactgttgtggctataaattaatgaagaatggatgatcctctcacatcagctgcctgattacgacttgtcaggatgttaaacgcaaaacactgtagtgtcaccataaaaggaaatacataaactcaatcattaatggggagcatggaaacctggaatggttttcaacgaaattacaaacaaaattacccttgaagatgttgaactttttccgtggggtcatatatttattacaacttgtgctgattactcatgcgctgcgattaataaagcattggtttgacacattcagagacctctatgtagactagatgcatgcattgggtggctagcaattggcccgacgacgactactgccaactgggtcaactcatgagctatgccgtcttgagctatcctaaccttctgtgtcacccggaggtccctacttgttatagcacgactatgggtgcctgcataatagcctcgtatagatggtccgtaatatatgataatgtgatgaaactttaaatttaaacttttacagagttagaattataagtatgaacggacctatgattccaaagaaaatctgagattgacccctttgcttcttgatgcaaatgtgtcacatcaaatctgagatgaatcatgctagaacattttgtatacaagactgtccgtgagattcatcaagcaagaacattttgtatacaaaattttcaatgcgatatcttatagtattatgacgctctctctcgtggcccgatcttctggtgaggggataactctcgctttgatcgagtgtgacgtttgcgacgtggctaccaaccagaacaagtccaggacgtcgtgcaatcgctacaccacaaacgatgtcgtaccaactgtgacgcgcggttgatgatccctacaatgcaaacgagagaacactacaagaataagataagatgcaatctaaatattgcgaataggtgattaagcataaagaaatagttgcgattgaagtggtagatctaatcgacccggcaaatcaacacatcaactattgggggctctaaatcaatagtcgtcgactaatcgagcgagggactagagacaaggtgaatggcacttggcaaaattcaattaaacaaaacccaattgtttttgaggatgtacaaagctatttatagaggaaaataaagctagggttaagtgctaattcgtggaggtggagggagacacttccgagatgggtctagtctattacaaggcctaaggcctaaattcagtttcagcagcagcactgtcttgttttgacgattcccgtcgactcagaatgaatttggatatgagactggatgcgtttgaaaggtagcgagataagctttccacgaagtctaagatcacccaaatcggagttggcatgaaggcgctaggtctgtttgaagtcagtgctgtctccggaggccgaactgaacttggacttggaattatcattggaacatgtgaagttatgtgcgtatccgatgaagtgatgtcttcatcatagtatatttttttgtgaaagaaacatttaattatggagggaaattaagattcaccattgcagatgttttttttttattttgcttcagcattcttgtatccactcctttgaaattagaaatttgcattgatgagggtaatcattttttgtgtccttgtcatagctatttcatccctcctttctgaaatatttgaagtttaagaacagacacgttgaaacttttaaaaaacttaaccttctaatatgcagaaatatttaagtttatcatgtgaaaataaattaaatttagaagatttcagaaactttagaggctaatggcaggtcatgttagtttattaaaattaaaatcagagatgggcaatacatcataaacttcaagcttaaatactttatggtcagtatattgtagccacagtttcagtgaaaaatgcaaaagtaccatatgtactaattaccagatgcagaaatttacattttgttgtcaatttgacatctgcatgcatatgctaaatcactatgcaaagtcagagaaatttgatatctagtatttaaatccaatgagttgaataaccttgcaggagtacctttttgtaggttctcattgctctgctggctgcaaagcaaacagagggaaagccaggattcaaattaagttccaaacaaattaaacagaagtgagctgaaacttagttaggtcgttacctttgtgattaaaacattacatttgcataaacaatgaaccttaagatttaggttgcattcatttgcctctttttgagattggtccctcgattggaagacactattaagcagtagcgcttgacgttactaacttccaaagtccaaactgatttgggacaatgggacttccaaactattgcgaggaaagagtcagttgtcattcatgaagtactgatttatgtggggaaaaccccacatacatcactctcgagtctcgactcgatcccttccaaacttttgcagtaacactgattttgaaagaggaatatttttttttcaatgccaatgctggaagcagttgaaaaactgcagtattttttctgattttcttatttcatcgtcattgcactgctaatgataacgatgatagattgtgtactaatcaattaggagacttatcaagtccctattcagattagtgtcagtggtaaatttattgatcacaaaaagtattcaagatttcaagcacttatagcaatatataccaatgacgacagtgctgtcaatggagaggaagtattaatgtttatttccaacatgtaatttaggttttcccaaagcagtaggccaaacttgtacttaggctctcatattggtatgtccaggtgtgcaacatatatggtgtctcttctcctcagttacctaatgcaattaagtgttgctaacataccaattgccataaaaaccaacctagataccctaataaggaccatcagtcttcgagtcattgccatttttcaatataatcatcaatttatcattttgatgcaagcataaactgcatataagatggataccttgtttatccgaacaaaatctaatcacttaacagctccacctgcggagtacatatctatcttgcttctcccttcatctgcggatgatttttttttatcaagaggagacaagctccctacatttccatatgtcagaaacgaggcaacatagttcattgatctaccagatcggagatcataaaacgtttaaggcaaatgcgatgctagttacgttcataaataatcaaccatgtgttccgcattaaagcaaggcgacacgcattaggcatttactccctccgtcccaaaataaacaactctcgtacgggatgtgacgtattctagtacaataaatttacacataagggtgtccagatttatcgtgaatttgtcgtatcctatatgagattggtttgttggtttatttgggagagggagtacctaagaagccaacagcaaacagagattgggggtgcatagcaaacaataatcctgttttagctccagtaatgtacaaaaaccttgtgctattgatttccacaagtaattccatttatgtgtgatggagctatgcattagcttgtttgtgcactatgcggtttcagtcctgtcagcttgcccgaggatctgcacgtaggcgtccaattctcatcatttttttcgtcaattcgtccctctgtccaacgcctatcgggttcgtaatttcgcaggacgctgatgcattctgctgttccttgtacacagggaaattttgctttctgcatttcagaggcgttttgatttgttaagagaggcgagacgtacagcgagcttctcgggtgtgagaggacctaatttaattcggttttacaagttgatattgtggttcagatatgcgattcaaactccacgtcaagatgaggacctaaagtgaacttattttccatacgattctgacgagtccaatacttagaacgggccgtccttgtgctctgccaaattggactgaatctcccgataccgttaaaaagaagccgaatactcgattgccatttttttagcgacgcagccagtggccacggctactctcagttactgattgctttgctaggagccttagtgcctcacaactaattataccctgccaaaataccacaaatatttttcgcagaacaaaattataacaaatgtatcatcaccatcatgtcattttgtgacagatccaatgcattatttcttttcaccatgttcatcatcagcatacaacaatcatagattgaagcatcatccacatgtatgtgttcatcttaacaaaagagacgtttatttcgtcatcattaagagatatatagttcatcatcccgttggtatacaaagatgcttaacaagcattggaaaaaaaaagtactctcaaactaatattaaagctgggttggtgaccactccaagatctcaaaatataaccaaagctggtgcatggttatcaaatccaaactctgaaaatactttgggggtcacaccaagacccaagcgagggccaaaaaaaaagaaactacagaagaaagggaaaaataaaggtgatttccacggctcccatgataaatgtcgcaagttcagtagcagtattgttacaatgttactgattgttttgctcacatgctggggcctttagaacatttcagacagttagccctgccaaaacataaaagctatatcagcacattgtctaaagatcaacattgtaatgatatattatagttcagaaataaattatggcttcctggaaaagagaagatgtaaagcatggcctgtaaaaactgtgggttgcccatatgcaaagagttttactatacattcatagttactaaattggacatattatagctatataagacaaccagatattagtatggtctgcaactctgcatactgtttttcttttcatcaacattatgaactgagctcttggataaatttctagttttgatatatgaatcaaatgcatgtaacaggcagaagcatcttacctccataacaacatcatcgtccttagatgtttcacctgtcaaaataaagaaccttatttttgtcaccaaggaacagacaagaaacaaattgcggtaagtgttatcaagaaaatatatatgtggtcacgagattaggttgtgaacctaacacttacaacagagtttgtgttcatgaatatattaacagaattacatcaacatcttagaaatacaatttcttgataactttacagataagaaagaaacatgatcttctacatcatcttcgtagccagttcaaattaatggtacattttgagttactcagtcaaacttggatcaatgcaaagctgtactagtgacccttattagaaaaaaaagattggttggaagaatgacaaagcaaagcaacgcaaagcatgatcacttgatcagtactcaagtaggcccttttgcacatacagctactgaagttttacaagatcacgtcaacatgaaaccaatgtcatgtcattttggactgcctctaccattcgttgctcacattctgtaaatccttcatcaaatattatgtggtaattcagagggtattttgttctgcctatgagcagcttcacttgatgaatattaagttatgaccagtgaccacaacatatggtaaaagcagaatttctgctacttgctctaaacctttcaaaatggtaccatatatatagaagatataacacagaatattctctttatcaaaaagcagaaatgcaacagaagttgattgttgaaaatattttttattgtagttcatttacctccagttagttctgatgtccacaatgccaggttctccttcaggagctgcatcataagcatgctgtccttgtaaccctccacaccagcagagttaatctcagcagtagcctcatcaagtgcttgttttgccacttggctagctctgaaaaaggaaataaaatgactaactcattgattatggtatatctttgaagctttgaaagactggtggatgatgtgaaatctggcatggcccaagatgcaactacacacaaattagctgtcatatccaaagtattggttaaataaaggcagatccaggaaacatttgcctatcctgttaagcatttcgcttgtggggttcattgatgcaaattggtaatgtttcatgatgccatcttatattggtactaagcttttctcgatcatcaaatttaatataatgaataatgccggcatgcttatgattcaaacaagtttggcgcattaggaatatcagtaaaatgggagaaaggggccattaatgatgcataacctctcaggagagttcattatctcaagaagactgaaaagttgagcgcaaggccaagcctgaattgatgggcaggagaaagctcactggaggcaacaaccatggcgtgctggagcaacatatgttagttttccaaaggtggaaaccaaggattaataccagaagttcatttgagcatgtgtactatatttaaaagatttcacacctgataggccataagggactgatcagtagcagccttcttttcagttccagtgctaaattcagccaagtaacggtagtagtcacccttcctgtaatttttttaagagtgatgtataaagcagattaaagaaaaaagatatacacatgagtatcgtgcgaacatgcac

SEQ ID NO: 63663 - DNA, 630 bp, Oryza sativa
atttttgcaccttccaaatacaacttgctgtgtagacaagttgaaaactcaaattcttatccaggatattgctactattgtacagttaagttatgccagtttgtggagaaattagtgtttcataccataactttgaatgcagttggcaccatggcatctacagagtaccatctcagtttactgaatctctgattatttttgctctacttggattggaggaagaggaattgtgaagccagtatactgtccaaaggagagctcatatagtcttcttaatatttgttgtctcagaggatgtgtcggcttcctgccaagtgccgaccaccaaaaaatcaattctccttcaaattcttcccgtgacatctctgtttcttgttgtattgttcctttgttgaaaatttgaagacatcaagctgatctctgaactggtgacatcatctgccactttgcattggctgttctgcaggtatgaccatatgaatattttgttttgacaaacaagtgcaatttatggtgctttttgttaggaaaatgccaacattctttatagaaagttaacatgcaggttgtggttagttctctgatgcctgaatataattgcaattcgattacaaccaagcctgcatattt

SEQ ID NO: 63664 - DNA, 2186 bp, Oryza sativa
ccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaatattgcttgttttgttgtgacttttaccattaaaggtgctctaaacatgtcttatgttttatactaaatttttaataaacgaactatggaaacatgcataaaagtaaataatgtcatatatttaaaaatggatgtaatattattttgctgatttcaccaatgtgaaaaaaaaaaactgtccctaagaatcggtcaagttatgtaatttgtgtaacctcccccctccctacaaaagaaactgatggatgttggcagtacttcttttcagctgaaaatttttccaaaaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctcacacgtggggaagcatcgatctgggacggtgtcatcaggcgagagtcatatcctgttcggtctgtgcagaaacgagttgaatttggtgcttagtatctgtcttaatcatggagctatgcatcttttgtcagctcaacttgggtgcttatttttagtcccatcatgaaagtgtattactactagtttcttgttatggacagcttgtcctacttttaaatccatctcggctcaaacagagaatattggctttggacataaccttgatttgggccttgcaaagggaatgcatttcgattggaccaatataactcagtgaagcaattgactaggacggtacaggcccaaagacgaggtggaaacagtacaaaaggcatcaaaatgcctgtgtccacttgcttggagactggagagtgctttaacctgagaattcttttttgtgtgtggagaaaaacctgatattatgtaaatggatattacctagggtaagcctctcatttgcatattcattcagattcaaagccaacaaactagaaagatagaatagaatgatagaactccagctcctcgttgggttcacgactctacccacccgctagagaactctagttcaagtcctggtttcgataattatgaccgtgtgcatctgtgattagtgtagatgctggaatgtatagaaaaaaatcttattaaattcaactagcattgtggcctgcgcagattgcgcggctaacatcattatattttctctcatataatagcatatatgttttctcattatattatttaaatatattaaaatgacaacataattttaaattttgcaataactttacgaaactactaatatgtaatgttcctattgtattttatatacgtgttagttatgaattatttttaatatcaaattttagttatttgtaaattatatatattcctatatagactctagactcatcttttaatatatctttttaattctgaatttttattatttctaattgaatttctatgtggactctaaactcatctttcaatattctttaatttttaatttcaaattttaattacttctaaattgtatttctatactgactttaactcttcttccgatgtttttcttaattttgaatttcagttatttgtaaattgtatttttatacgaactcaaaacactacttttaattttattatgtttattccgaatttttgttagatttaaattcctatatggactctatactctacttctaatattccttattttttaattccaaatttctattttttttct

SEQ ID NO: 63665 - DNA, 1786 bp, Oryza sativa
  unsure (1)..(1786): unsure at all n locations
atgatcgaagatgatcgatagaggcgcaacacggcatgagaagtgagatcgaagacgtaccaccgttcagggcttgggagttgggaccctgccgcccctgcagcggcgaatgtcgcagccgcagcggcgcagccgttccaccgcctcgtcgatcaaacgctgccgctgtactagctccccgcgcgacaggttgaatagaaaggggagcctcgtcgtcggcgccggcggatcagcgtcctcctctctcgaatgttgggatcccatgtcgtcgtgatccagccaagatctaaagttttacaagaaattctcaaaaaaaatagggaagttttacaagggaggctaaagtanattcggcccatttaagtgttcaggcccatttaagacttttaagtgctcacgtgtgctgcgcgtcgtgacccaatggaacgggctgacttgcaactccctctcctccgcttcctcccgacggcgtcccgtcctggatggcccgaggcggccgttcgccattgacaggacgaggagctacgtgcatggcgtgagtacgtcgatcgttgttttccgaggagattggatcgtcggagcaagtactccttgaatcagcccaatccataggagagatttttttttataccgttgatgtgttcgtgttggacttggaggaaagaaaacgctcgatctcaaggcgcgtagcaacggcgcacgtgcagagcatatcaaactcaaacatgcatgccgttgtcgacagccgacatggcacgggcatgctctgtgcacagccgcatggcgagaagattgcagtcctatttgatgcatccttgagccttcccttcccggatttcagttccagtgagcaagataagccagcttgtcatttgtcaagacggcaacagggagaagaggacgcatatcgtactggacttctggggacgacgaaagttaaacgcctcaacgtctcgtcatttgtcctgtatggctggcttggctgtataacagtatgtcagcataagcggtcaagccacggcacgacaatttgagaaacaaagcatgtggatgtaatgcaatgctacttgggccatgtggccggagtgcctgacacaatcacacacgagaaaagactcatacttgattttgtaaggtaagtttctagtgaaaaaaaaaggggctgctatataacggaatcccgttttcgaacgggatgatcccgagtaggtatcaagtgtgatacctatcaggtatcagacgattctacacacgtttcaggtgatatctgcaagtatcatgtgatacttatcaggtatcatgcgatttctaccacgtatcgcgtgatactagtatcatgtgaaacctgtcaggtattagacgatttcaaccacgtatcgcgtgatactcacgaggtatcatgcgatacctatcatgtatcagacgatttctaccacgtatcgcgtgatactcgcgaggtatcagacgatttctaccatgtatcacgtgatacttacgaggtatcagatgatacctaccaggtatcaggtgattcctattagatatatctgggcatcccgttgggggaggagcatcccgacacgcgcggtcgccccctgcagccgtcccttgtatacgacgatggcggcggcaggggatgagcgcggcgacggcggtgggggacgagtgtggcggcggcgggggatagcgacggcggtggtggaggatgggcgcggcggcgacggcgacaggggacggacaccgcggtggcggcgggggatagcgacgacggcagtgggggatgggc

SEQ ID NO: 63666 - DNA, 10840 bp, Oryza sativa
tgtataaactttagatgcataaaaatactatatatagaaaatatttgaattcaaattcaaatttgaatcagatataattcaaattcaaatttgaaacgggtatgtaaacttttgacttataaactttgggtctataaactttaggtgtataaactttagatgtatagaaatactatatataaaaaaaatttgaattcaaattcaaatttgaatcggatatataaacttttgacttataaacttttggtctctaaactttagatgtgtaaacttaaggtgtataaactttaggtgtataaatttactaaaatagaaaagtaatgtggtgccaaaaaagaaaaccaggtagagggaggcggagacccgatccgatcgcccctggcagcccctagcgatcaatcgcccaataggagtttcgagttgaacacacacctggccctatctgggccggttctcctgcactactaagggcccgtttagttccttaaattttttttcccaaaaacatcacatcgaatcttttgacacatgcatgaagcattaaatatagataaaaagaaaaactaattgcacagttatggaggaaatcgtgagacgaatcttttatgcctaattagtccgtgattagccataagtgctacagtacccacatgtgctaatgacggcttaattactctcaagagattcgtctcgcggtttccaggcgagttctgaaattagttttttcattcgtgtccgaaaaccccttccgacatccggtcaaacattcgatgtgacaccaacaaattttcttttctccaactaaacacaccctaacatacaggcctactgccatgtgaactttcccaagtccaataggcatgttcatttcgtgggcctgatttcaggttatgtccggaaaagcccggcactgcaccaatcaattttgacatggtgacaaaagctttgcatcaatcttgagataacaagagatgcatgcggtggcaaagagctaaagagtatgtacggttttaactctgaggtgtcgtgttcaatcctcaatatatttacaagaaaaaaaatgtttggagtgtaatcccactcttcaaatctcgttttttttcacaagcggaagaatcattgtcccagtgaaccatcgtctccacggtatatgaaggcgtattgttgcctgcaataaatctggatgcaggctgtcttgatgcacactgttcgttggcaccgacacttatgttctagctacaaccacgggaaaacttcaaaagcgattttcagcacggcacgggccacgtacgggcacatggtgcatcccagctttttgttgatcaatgatcatgccaaggtagcgtaccgcgtagcgatacatccaaatgagatttttcaggcgagaacccccccgcatcacaagcaaccacggcatacggtccctaacgcacatggtgagatgcacgaattaacgcgtcgacacgacacgcacaacggacgacgacgagcagtaccagcaatccaacatgcatggggcggcgctcgtactccgcgacgagcccacggacacgggcgatatgaagccaaagtgccaaaacaccaccggccggggcgcacggtcccatcgtatacgtagctgcggcgtcgcagtcatggagagtggatacgtcaatactggttgaactatacgaagaagtacaggagatccttctaaaaaatggtttatgttacaggcccagcctgtacaccttattagcaggtaatcacgcaggaggttctgtcattctttttacgttttctttttttttttttacgaaaaacgtatatgctgatataaacgcgcgccgcgcctactcactccggtattcttaaatgcataattctcgatagttgtatcttgtttatttttatttatttatttttgcaatgagggtgctcgcatatagaaatgcattactttgggaaaagatgtgaaatagcttgttgggatttccaactttagtatattctggtgttcgacaatcgacagtagtgtaacaatcatggccatgtatatattaacaataactagaaagaaagcccgcgcagatgcgcgggcatcttattgaatgttttataaaaataatgctaaaagaagttacatctcactatttctacttaaatgttataaaataataagaatatatctcagattaaaaatacactttgattgagtgacataaattctcatattgtcaccactacttactatgctttaaaacctaatacatcattaatacactaaattatccactacttacgttttatgtctcatttttttctaaatacatttataaatattgtaaaaataccaccacttctatccattaatggaatagcaccattaaagttaaacacgaatactactctaatgggtgaagttgattgtagccaccaagacttcctttctctattgccttgaaacatgggtcccgcatcgatgtagccatgctcctgaagaccagtttggagcataattttaatatacttcctccttccaaaagtctaagttatatttctttttcactaaaaccaaggtgtagttaactcattcatcatgtaacaaaaccaatgaacatgcaaccaataagtactaaaatgactttttgggttctgataaaaaatttaatatagtacatagtgactacaaataggacttagacttttggaaaaatcaaagaatgaaataggacttagatatttggaaggagggagtataattcattatcacacgctcatggagtattgcgttggtaagtagaaagttgagtactattagcgatggtggcctccactgggactgtcttaacttagccatatattccatgctatacttagtacaccatagtaaactttgttgttcatgtttggtgtcctttaggaaagaacaaagacaagatggaggtgaccaaagtagtttttaaaaatgttttgagcatatttgtggtgcagtgtagatacgatttgtttatgttgttgatcattactactcattttttttatgatatagatagaatactctcttttgaacatgactgaggttaatggttcgacgatattttttaaaaaatatagctaatgagacataccaccacgataatatccagagcatcatgttattatttatattttgacaaatatgtatagtaaaatagttctaataatataaaactactttgagaatcttaatctcaaacaaattataatttaatcagacctacttgaaaaacacaactaaattgtgttgtttttatttttacatatgcagatttaaattaatgttgtatatttgtgaagtgatatttccctccctaaaatatgatgtgatttttttgaaaaattatcatacatatgtcagcctcatgtgccatggtgtatttaggtccataatataacttttataatttaattaaagaaatacaacatgattacaaattggatatataatttcaaaataatttagaagatggtttaaagaatatttattgggtattctatgtttttattatagatcttagtttaacttatatatatttatattatatttgtgaagtaatatatttcatatttatattgtggaaaataaccgtccgtttttatatatctatgtttcttttctatctatgctcatatggtttttttccgttccgtgaacaggagaaatttaaattgcacgcactactcataatagatctaatctaatggtgtagaataacgggtccaccaatatcggagaacggttgtagtgtttgtttctaaacaggaggaagttattattttgcaataatagatctaatctaatggtgtagaataacgggtccaccaatttaagtgaaaatcaacgatgagattagatagtgccacatggcggcttaggagtgtttatagaaataccacatggcggcttaagagcgtttataggaagtttaatggacttttagtatataatagatagataaagatagatagatagaagatagatagatagatagatagatagataatagatagatagatattccaacaatgcttgaatggtgggataacacgacagacatgaaaggagttcccaaagcaccctaacactgctaatgacatgagagatatggaatgaaagaaaccgtaaaacttttcaacgtaaagagctctcgccaatcagcttgctagcaaaaagaaaagaggaggccaaaacttggaatttgacggacgtaagaagtcttggtgtctgggtaactctttagttcactcggaccaaacgtcctgagcttgtacagtgttattggttgtaaaactttcattgtattttatcctttgtctattcaataaaattgacggcttgccgattcgttaaaaaaaaaatcggtggacagttcaacacaccctggccacgtttgggtcagctctatcatcccattggccctagcaaatggcactcattttgcaactagaatatttggatgtcctctggggcacaggtaaagcggaatatattaggccctatgtattactaaaatgtgaaccttccctagtcaatagacatgatccttcgtgggcctggcttcatgttatcgaatttcacaaaactatacatatatttgattaaactattacaaaacaataaattcgaaatggtgtaccatggagtaaaagatgttagcattaatttatcacagaattataaatttaaatcgaagtatcacaaaactacataatgaagttatcacaaaactaagtgatgtatttagagaataaattctgagcactaataatgctcttccggagttacaaaacatgcaatttcaggataaaatcggtgcttctgtagttttgggatactatgcgataaatttggagttccgtgataaatttagtactaaactatagttttatgatatattattcatagttttacaatagtttatttaaaatatgtatagttttgtgaaatttgtattcaacctattttgacatagtgaaagctctaccatccagaattgaagtacacttcaagtggaaaaaccattctcgatgcagcctgtcttatgcacacgtcgttggcaccgacacttgcatttctagctaaacggcatgccatggtgaaaaacagaaaagcgatcaacacctcacgggcacatggtgcatcccaacttcattggtcacgcaagggcgtaccgcatagcgtacatccaaatgagattcgcaggcggaatccccccgcaaacacggcaacgaacagaaaatgcacatgctgacatgcattatacgcactggcacgtacaacggacaccgagcaccaacaaacccaacatgcacgacagcacgagtggtacaccgcgacgagccctacgaacgaacacgggcgaaatagccaagcgcaccaccgtggtggcgtgacgcaaggtcccatcgctagctgcggcatctcagtcgtgcggagtggcatatcatgtcacgtagctggagaacgaccgagccggcgcctctctacccgtctccggcaccatcatgtccttatcgatcgccagcaacgacgcacaccgcgtatgtcatggccgattcaggtgacttcacgtggtgcgcgcggtcgctggggaagtcctgcggctgtgcggggctggacgatgctgagctcgtcccttctgatggttcagctgttgctgcagcgaagcagagcagcgcgacgaggagatgggtggtccgcaatttgacgtggctcgctatttctaagatgttgtaccgctcacaacgcgcgtacagtcacacctataaacacacacatacactctatccttataagtatctccggaagactggatcggtatttcttaagattgttaaagtcacccatacccttataaacatcttcggaatactgagccggtatttcttaaaattgatgaaatcactacgagtatctcgctttcacacaccctacctctgtgcacacctctggaagactgggtcggcatttcttgagattgacgacgtcaccacaaccggtatttcttgagattgatgaagtcaccacgggtgtctcactgccacacaccctacccctatgtgcacctctggaagattctaccactgataaaattattagccgcaactgtgagcacccgtgtcaaatctaggatgtgaacttgggtgggctgattccagaagaagtaacctaaccagtcgagttacactcacttcacttctaagatgttatttgatgataaaatagtattgaaatgggggtgttgcttattatctataatacttgtgtgttcgcatggctcgatctgtatgtaatgtcggtatgtcaacgctatgaagttttacatttaatttgtattcacaatggagaagatttaaaaaagacacgaatattagggaatgacctaatatcaaataattagaaagggtaaggttttgaatccaggtcgtctagcccaccatctttgtggagctagccggaaaacctctgggtgtttctcacaatggagaggatttttaattgcatgttattatcttaaagataatggacataaatttgtctctatatttacaggtgaatatacacagtccaatattacataagtgaatcacgtaatgtagatcgtcgctagaagattaagcttcaagcattttatcctcacctaaaacttcagggagatgcggagctagaccaccgttccgccgccacatccactcgctaccactgcagccatcacaaaagctacttcgtttcgccttgggcgaacgaaagggatggaagtagttcgcctagctaccgtgcgaacaacctacgcaccctacaatgcgaacaaatctgttgccgcaacgttgccatctcctcacctagcataccatagcctctgctgagcttataatttaacgaagataaaagatctacacaataaagattttccattttcactactaagattatgctaaatagaggaccaaatatactagctacagaagaaaatataatctagagtttgtacttgcgtgaaaaacagagtaactctgtttcatgcgtgaggtccttgtaaaaaacagagtaactctgtttcagtcatttaaaaagaaaagcgtgacgttctcgtcgaaaacagaggaactgggtgacagtctttaaaaatagcgtacagacgtaccgtacgtgatatgttcagccccatgttcccaatgccaccgacattttggtgctttacatgatgttattttgaaagatacgctttatatgatgtaaactttatcaaacatgtagggcagggcacacaccaaactttggtaatcaccaatgattttcacatagtacaggtacacaagagtacaagaggtgagatctagacgtgacagccatagctagccacacgtgcagagaaaacaaaccacaatgacgactcacgagaacacgaaacgaacacaagaatacaaagagcaaataccaccgagacgctagcttctagctgtcccctactgcatgcatgcaagcctcacttgtgaagtgtagcgtacgtcacgtagctggagtagtcctttgccaccctgtccgccggcgccgccgcggcgttggcagctgcggcggggcaggccgcgtgggtggcgctcgccgccgggcaagtcttcggctggctgtggaacgacgcgcactccgctggccgccgctggttggcgaagcccggaatgcagttgttcttgacgttgaggacgccgtccttgatcagcgacaagcacgccggcccgaccgacgtgaagtagttgctcgacagcgtgaggttggcgaggcggccggccgggccggcggcgagcttgcagagcgcgtcggggatctctccgtagaggcggttgccgcccaggttgagctgctcgacgctggtgaggcatgagaaggaggagggtatcgggccggtgagctggttcatgccggcgtcgatcacggccgcattgatgagcatgccgagctcgcgcggaaggcagccggagagctggttgttcaggagaagcacctcatggagagtgtcctgcaagtgcgagattgatggcgggattggcccggtgagcttgttgttggcgagggcgaggtagctcaacttagagaagccaagggtggcgggaagaggaccagctagattgttgtaattcagaagaagcgcctttgaactcgtggctccaggaaatcctcctcccttcttgtcaggagttccaatgaaaaatttgaatcttatgctgccctgtaaacagtggagaacatcgaggtctacgcctcctcctccagatgtataaacagaaggatgggctgggagatcgttgttgacattgatcttgtacatgtaagtgaggcctgccagacgaggaatgtcgccaccaaaatagttggaggcagcatggaaaaatgcgagatcggggagttggtcgatgaagccctgcagtttcggggcacgcatttcatatccattcaaaatgactgccgtgactgtgagcatcttatcttgtccaggtgtggaacagtggaacccgagatatgacgtatcgccgcagatgtcatggccactccaggtggatgtgatgttcttggggtcggacgtgacggtgctcttgaaacgctggattacaaggtaggcgtggtacagccggtcgtttgggaaatcccgtggctgcaggctgtgcgatgccgaatattggctcgtcttgtagggtatttcttcggagagagcattatcagctaccagcacagaaatgtaagtgagtagtaggaagaggaactgagcaaagggccttttatgttggctggccatgtcgatctatttcaactcagatggtgttctgctagaggagatgatcaggccgtttcgaatatgaaatgaggcctaattctcatcacatatatatagagagagagagatacagggagggccatatttcaatggaagccatagtatgacttatcatgtgcggtgtctccttgccaacaacaataaccttcgcgatcagtctccagcgaatttgttaaaacttaaaacttaaaagggtatgttttgtccccaagtatcaggtgcacccagtcctgatacgattttgctatatatttgttgacaaattttttccccaaaaatttgatagatgtaattacagtacaatcgtagtgtaattacactgtaacttgtatgtaattacacagtaactatagtgtaaattatatgtaacttttaaaaatctctccataacatattatttcggtaaaatggaggtcgtgggaacaaattctttcatatatgtgtgtgctatgatttgttttcttcctcaccaaaacaaatcgtgtaatagatttaacgattcaaaattatgtgacacttacatataagttacattgtagttacatgcaagttacagtataattatatacaagttacagtgtaattacactacgattgtactataattacatctgttaaatttttggggaaaaatttgtcgacaaatatacaggtagtcccgtcctgataatgcacacatgtcaaacaatcagttcccttcaatcttcacccaaaggctagccttgaagtgtagaaattctgcatggggtagcctttggatggagaaggacgagggtcagttttttttcctagtaatatacccacgcattggaacaggatcataccgccgaaaatgggctaggcctcaaaaatggatctgatttttatcattatattttcctttttttcatatttcctttttagcgatttttccccataagtatagggtatctcatatttaggacaccgactacagcctccgaacttataatgctccaattttcgccccgtcaaaaaaatctatttttaataatgttggggaataaccccacggtatattgttggagaagacctcccataacttgggtgttgtataaactaatgtagtaatggactagaacgcccttagggcaatgcccctctgatgtaaccaattaaggatagtactgtaattttctattatatatgaataaaaggagccctccaagagcaggggggatctccccattccattcaatgaacaaccatcctcactctcttcctctcatcttatcccccatggatctaagcttaggctccctccaagaaaaggggtgcctttgccacgcttgttagactttgttccaacattcaacaattaaaaccctatattaaaaaaattggatctttgagtgtatctaggtttgtttgtgtgccggatattccaatttctttcattcattgcgaacttagaatagtggccaaatcttttatcctaaattaaatttcctatgatttgaaatttgaagttcaagttttcccctcctaaatctttcaaaaaaaattgcttttaaacttcaagcatcccttctaagccactcataaaatttacattcaaactcccgatgaaagtcctcgttacatcctatattttatttctccacaaatttatctaaggaaaaagtacacccgaggtccctcatcttatcatcgagttacaaaattgtccctgaaccgaaaaaccagatacaaacgcaccctccaacttccaaaactagtggaaacgaggtccctcggcggttttgccctgtttttggcggatgtggcgcttacatggctcctttgactaggtctttgttccacgtggcactgacgtgacagtttgatccaaaaataataatgaagtaataaaaatggtggggcccactagtccttcctttttctctcttcttcctctctttcttgcgttaggcagggaggaagggcagaggagggggcgccatcgacggcggcgggggggggggggggggagg

SEQ ID NO: 63667 - DNA, 34576 bp, Oryza sativa
  unsure (1)..(34576): unsure at all n locations
tgcatcaccaaagaacgatttgccactcaatgtaggcccacatgtcactgagacaatagcgaaagatcctaaaccagtgtgcacctcattggagcagcaaatcctaaagtttcaatttgttgacgatcatcaacattcagtaccatacaatatctgtacctgctcatctacattactccctctgtcacataaaaaaccaacatagtactggatgtgacacatcctagtactatgaatccatacatttgtccagattcgttgtactataatatatcacatctagtcctagattcactttttttgggacggagggagtacataaacaaaatcgaaggaaacgtaattcctacaccagaccattctctttgtaaattagagaacttacagtgatgcattgccatcgtcatcaggctcgccactatcatgggctgcagatgaaatacctgtcacatcaattagatcactttcataagcaagctaggtagcatatcagatgcactgttagaaaatatttcataattaatcacactgaatcagaatcccaaggcatatatcatgaaaagtctgctctaaacaaagagtacattgctcctgacattccatatcgtaatcaccatagcactaaaccagcattacaaatattaaatgatattctgaagatacatagaacataatactagccaaagaaatatcaacacaggaattccaagtgaacgtacgaaaataaattgcaacactagctgttgtatgatcagttctctcaataatcaagtcttcgttaactttcttttaattcatcgcttttgcattttgcatagaacagggtattttccagaagaagtataagagataaacaaagagggcatagttttttattccacggttaaacatatgcaaaacaaagtgcaaatgcaatcggagagaatactggtaagtagcatgttcagtgatactatttcaatgaggttcccacctgagtcagctgatgaggatgcatcatctgaagaagtttcaatggcagccttttcacttccgatgcccaattcatcatcagagccatcactgctggcatcattgaaaattgtaccagttcctttgtcttttttggatttgccactggtttgctcatacctttttcttggaactttccgagctgctagtaggataaatgggcgccaaaatatgtatttgcgacccaaatcaccctgtactcggctgattataattgggaactgcagcctgctaatagtcactaggagcacaaccacaaggagcaaaccgtacaatatccacatggccagctatgagctcctgtgctctctgtaaacacagaaagcaagtaataaagagtgcaaccactaggctccacagcgatatctgacggcgtagccgactgttgatgcgtaggcgcattcctagaacttcagcacatagaaactggccagcagcaaacaatactaccataatttcaatcactatacgtggccggcgtacttcccaaacaaccgtagacaccatagaaattgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaagggataaataatccaaccaaccgagtggcttcgataattatagttaactaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcataccccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacatgacaggccacacctgaaaatatgggctgcagacatattaggccttggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtncgcggcagtcaggtcagccagcaatgaatatgaaggcgctcagcgataaaagtgtgtagttgacaacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtccaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaaccggtagtgaagacgcgcagttgtgaagataaaagcactagtcggcggcggcataacacgagttggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtattgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcctaacaacggcagcataataggccagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgaccaacaacggcggcataataagtcagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccaagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgcgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtataggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcaagagtagtgccgcggcgttacatgcaaacagcagaaaataccaagagagattaatctgacatttagagatcaatctaataaacaacaataagttgaaaaggaaaaaacctggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgtcacgtcctgataaattcatcccgaaataaaaatcattttctaaaaggaataatagaattaattaaaattcgaaaagaaattggcaaaccctaaaatacgtgcaagaaaaattcaaatgtggcccggagaatttttgttaaattctccttggtctaaaaggagccctcaaattttacttgaattttcagaacaccggaaataattattaaacaacaacaacaattatcaaagtttaataaaaagaaaatctaaaaataatcctcctccctttgggccaagtctggcccaaagtcctccctctctcccctcggcccgcggccgaagttttcctttcctccctctctttctctccctctccttctctccctcctcctcttgggcctcctcccctcccggcccactccctcctccctctctctcccgggctgcctttcccccccctctcccctcccggcctgctcggaccaagccgcctacccctcctctcccacctgggccgagtcccggcccagccgagcccccccccctgcccgagccgccgcctgaccgcgtggggcccacgcgtcaggcgagtcatcgtcctcctcccgcccagccgtcctctctccctctcccgtgaaccctagcgccattcctccctcaaatccgcgcgattcaagcatgggattcccaaattgattgaggggaattaatcccctttccctcctctctctttcccccttaatttccccttgaatggtgcccccaatcgccgggaacggccgcgccaagtccggccgccttcctttgccgccggccaccattcccgtcgccgttccgccctctcccgtgctcggctcgcttccctccgctataaaatgcaaccccctcgctccgttctatcgctttagccccctcccgcggtctcccgtggtctctagccacctccccaccgtcgccctctctctcccacgttgccggccggcctccagccgcctgtgccgcctcgcccgcgcaccggccggccgcgccgtcgcctcttccagcgtcgccgccacctcctccaccccggcctgccctccgtctcgcgaggtgacccccggagctacgtttccgccgtcgcccttccatttcctccgcgccggccgcctccagccgcctctatctccctgcctgagcgccggtcgacgtcgccaccaccttcctcggctccacgacgccgctctcatccccggcatcacctcctcctcgcccgaacttcgccggaacaccgtcgcccgcgccggcttctccttcctcctcggcggcatctcccccggctgcccttttcgccatgcccatgcgtcagccggcgctgccgtcccctccctcggcacggtgacgtagccctccacctcgtccacccctcggtttcgcccggaagccgccgcacatcgccgcgaacctctccagccgcctcgccggagttgttcggccgcccgtccctcctcgcccgtgcaccggtcggccacacctccaccacctccggcatcgcagcggcaaggccgtcctcggcatcgtttcccctccatccaaacccctccgcggtccatcatcgtcgtctccgatcgttctcgtcgtcgacgtcccgtcggtcgcccggctcgtcgcctcgcggcgccgcctccgtcatcgtcatcgtagcggcgtgttccacgtcatcctcgtccccgtgcagccgctgccggctgtcctcgtcgcctcctcgccggtcccggtcgtcgtcgtcgtcgttgtcctctcgtcgttcccggtcgtcgtggcgttcgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttggtgttcccacgcctcgccgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgcctctgtgtactcggtctaccgcggtcctttaggttgatatgtggggtccgcatgtcaacggcgcagccttcctgtcttttccaggctagcgcttgcacctgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggtttccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgttattgatattaataccttgttcaccctagattaaacaaaaccccatctagtggacactctattcgtggttccactagtatgaatttaggtagatgcttcgctgattaattaggcaacattaggtggttttataactatagactttgggaaattctcatatcatttggacactatggaattgttggtttatggtggaattggatatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcattggcagagggttggtgccctgctgctaggggctcagtcttgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatatggaatggtcggcctggtttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctctatctttctccccccttcagtaagagaagctttggaaaagaagtcttaggtggagtcctggcttataccccagttgagcgcctgtgaagatggagccgtaggcccgctagtccgctgctgtttatttttgtttgtcaggcctgaagcgcctttgtaataatgtaaatattatcgatataatgaagatgtgtcttttatatcatgtttgtatggtgtaccccggcttttcctgggacggggattaatacattagcgttcgggaaaaggcaattttcccggtcgcgacaatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagaaatggagaagcacacgattaccatcagcccgttccagcccagtcgtctaaaggcacctctcgtccggaagaacagttgataatccagcctattgttgcgggtgaatatcctgaaagtagtcatattgtttaatcattaaacagaagggaattgagggggtgtttagatattgtaaagtttgggcgtgtcacatcagatattatatccgtcattagcaaatgtttactgtagcatcacattgtcaaatcatggagcaattaggcttaaaagagtcgtctcgcaaattagtcgcaatctgtgcaattagttatttttagcctatatttaatacttcatgcaggtgttcaaacattcgatgtggcagagtgtaaaattttgaggtgggatctaatgagggccttaaagacggaattttaaggtaccctcaaatgattatgagcctttaatcgcttcagattcaatggatttgattttattgtactacacccggtagtagtgtagtagaaattatataggggtaaaattagaaataatatatataacattacaataaattcgtgtatcatataccatattaaaatagatgaattggtaaatatattttactaaagcttcaaataaaatattttatatacttatgaaaatatatagttagatttaaaatttactacactactacacatggtagtagaaggtaccataccataaaaacaaaaaggcgcataggagccaattatttgattatcaaaagttagtttcacactacaagtttgaaacgcttgaaatcttagcgtgtgtttggttctgggactaggtgggatgggatgaaaccatccctgattttaggattgggatgattccattcgggtgtttggtttgtagaataggacgatcccagttttttgtttggttgaagggacgagggagggatgggatgagcgctgtttgcaaccaccgataacgccgtttacaacaaacatggccgacgccgcctctgccctcacctccggacgtggtcgtcgccggcctccttgatggcgtcgatgagcttgggctggtcggggcctgggtcacacgcaccgaggagatgacggtgtcggcatcacagacgagcgggcggaggagcgcgacgacgacagacgggatgacccaaccgagcgctggcggcgatggtgtcagccttcgcgcagagcagccgcggcttggcgatgacgacggcaacgaggtccgcgcgggagagggagagggagaggccggtggagaggagggcgagcacggccatcatcgcggtcgggcgggcggagaagcgcgacgacgcacggtcggcccgccgccgagttccccggctccagatccgtcgccgccgccttccccatcgccggatccgccgccgtcgccttccctatcgccggatccgccgccgccgccttccccaccaccggatccgctgccaccgagccccccgccgccgctgtcgccgagcccaccgccgtcgacgtcgcccgagcccaccgccgccgcggtcgcccgagccgtccgccaccgccgtggcccgagccgtctaccgccgccgccgccgccgtcgtcgagcccgccgccgccgccgtcgcctagcccgctgccgtctctcgaggacgagcgcgcgagcagggcggcgagcgtgcgatggtgttcgctcgttcacgccgttcactcgtcccaggtgggatgagttggtccgccagttttggccggatcagttggtcccggatctgagaggaatattcctctctagggaccaacccatcccactcaaccttgaaccaaacacccctaaaaatgggttcatcccatcccatcccatcctatcccagcaaccaaacactaccttattgaacagctttgcagccttatcttttcgcttacgctcatgcttatcagccgaaatttaaatatttaatcttaaatttaaagttgattttggggtttttcatcaaagtttattttttagtcttttagatcgttaagaacatgtatataaaaattttattcacaaattatttttcatttgtaaatatgttgtttgacttatttaccgaataagcgaaacgatgaggccgttgatatgattgctaggttggagtgcttctctatctagtgcaagcttgcaaagtcaggtggcatccaaacaggaaaaaaaacgctaattgcagaagattatcaatgtattatagaaatggaattccatctatccaaattcttgtcagccaaacattgcaagaccaggagactttgcatgtatacatacctcgtggcttctaggaaaaatatcgcagtcgcataacgaaaatcgctcttgagaacggacggatagccacccagcaggacgacggtggcccaggtgaaggccaccgtgccgaaggcgttgcccacgctttcgatcaccgcgagcaagcggacgaagtagttcagccacttctccggtgccgcggcgaccgccttatgatcagcttgtcccgactccgatacctgtatccggtgctcctggacagcgctgccgtcgcccgtcggcggccatcatactgattaacttaggtaattagcgatcctgcaggaaccacaagctatagcctcagcacatttgtagagcaacccaaacaaagccgatactcctatatatgtaccaaaagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttggagaaaatcaacatccgccgctagaggcacccggaccccccttatatatgggaaggagtccgtgttacaaaagataatctatatccctaacggaataggcagatacagataaaatacagtcgtgaccgactagatctcaaggtatttcctttacgtacaagttaagaaacaaacccgagatacacacaagatattctatctatattcggtatcctatattcaacccaaatatcatcgccgtgtagatatgggatatccataatctccacagtagcccccgagacctttgcagtcaaccattatagccttctcaaagatagtaatccgagtgcttcaaattattcatgccaaggcctgccgagtagcgaagacgaagactgtaaagggcgaaacaataaagaatacggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcatcctagccgactgctttttagccataataaaaggaatccgagtggtttacactctaaaaggttcacgaatgaacacacttgacagtcatccgaataaaaactctaaagattacccaccaagtattataaaaattatggtaataaataagtctaatagcctaggctatgactatttaccataataaaaacaggcatataacataccagggaaatgactatggtaaaaacaagccactccaagttaacccagacagcttttgtagcctaaaaaagcttacaaaaagcagcatgacgcctttctgtcgggcaccttttaatttgcattgcaataattccaaagaattatatgaccgcataaaaaggattttatcagcattgggcaacactattgtgcgcataaattgccaaagcaaaaaatgcccaagtccctaaggaacacaatgggccacgctgttaaaagtattgggctgaggtactgttcaggcctaggcccatttgcacctccgatacccttaacaagaaatcccgagatccaagcgacgcttcgtcttccccgccggaactctcgccattttccccactccctgctacagtaaagaactgcgccggcaaactagggttcaccattccactcaaatccaccttcaaaaagtgatcaaaatcctccccgtgatccaccgcctcaattcctcacctctcccaagccatccctcgaatcaaatcagcgcattcggggaaaatcgatggcggaagagaaagaaagctttgaaggccagtgggcgccgtccgacgtaacagaagagaacctgaaggagatggtggcgcacggcgttctccctgccaaggagatcatcgggtggcggccagcgtgcggtgagatttttccgacccccgatacacacgagattgtggtcttctctcatttcttctatggcggcttcgctcttccgacctcgaaatttttccgcgggatattaagtttctatggaatcagtttgcatcacctaaacccaaattccatagtccatatcgccaatttcgtccatgtttgtgaagccttcttgggaattaaaccccatttcgctctgttccgccgaatcttttttctcaagccccaaccgaacaagaataagccatgtgtagtcggaggggcaggatttcagttgaggggaactctgagccagaagtatttctctatgcccttcaagacctcaaacaaagggtggcatgcgaactggttttatgttcagaatcctgagcctgctcttcccgagtactcttgtcttcctccggtgtaccaagatacttggaactctcttcctatcggagataaagctgctcaagccttggaattgatggaccgcatgctaaaactcaaagaacaaggcttgcaaggagagcagattactcggcatttcatcaaatgccgactggcaccaattaaagaaagatcccgtacagcgttcgagttcgacggcaagcatgatcccaatcgtgaagaaccagactctctggactttaaaatcatgaaggagagaatgtataaaattttctcaaatgctattgtcgtcagctactcgcatcagctgccagttgtgccatataatgcattcaatccgcctccgcaggtatgcatctgaaatcttcaatctatgactaaaacattatcttgtcttcatgttgaattaattaaccgtggaagcatctcatttaggaatatgcgttgatgaaatctgatcccccaatcactcagcgccggtcgcctcgtcagcacaccgttcagggaggtggagggccaaaaatcagaccagatccgcaacctcaaacctccaatccaactggacagacaggttctcgcaagagaaaactggtgctcgacaacgatgaaggcgacgacgataaatctggggacaagggctcgcctaataaactcccaaagcgtaccatgcccaagaaaaaactggctggccgtcaaatgccaaagattagaacattttctaggtataaacctctcggtaccatttcccttcgacatgcttctctcatagaaattatactgaatatcgaaagaacactttgcaggaaaccatccgacatagatcccactgggaaagattctgatccgactgtgacagaaccaaatttatccaaggatcctgagccaactgccgaaagccagccgactgccgaaagccagccaaccggcgcccatgctttgggtgataaggccaatccgagtgaccggccgccaactggagaccagtcggcaacagctgaaactgcaacaacacaagagcccccgactggaaaccagtcgaatgtaggtcccgatgaagaaatccctgaagttgaagcgcagacgacaacttcccaaggaccagaggctggtaaagactcaatgattgggtctctaaataaagaacaaggatcaccctcatgttcagccaggaacatcctcaggtaacacatcttctcaagtgatgccgatttaaataacttcagcttactcgtctaatgtcttggaaatacatcaggaacactaggcgatgacgaagaagcaattcctcgcataaaggcggctgatgactcccgtcctcctatcttgctcaaatggtgggacgagaactcgcaagttgccggcatcgtcataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaggctggttcctcatttgggaactcttgaagcagttagggaccagctgcatgaggccaaggagtacgccaaaaagacagagaaggagttaagggaccgaattgcccagctccaggattcaaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccctgaaaagagacaaagtagaactagctgcgcaaagggactcggccttgaaagaggttgaaggtactatcagctaacaatctggtctcctctcttttaaatgcagcagattcttatcataaatgtgttttgtagaccgtaaagtcaaatctcaagctcagtttgacgtcctggttggtaagattaagaggcttgaaggagcaagagatgaagtcgccaatgtcgctacaccacttgtccaagctatgttccttaataacaatggtccaagttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcttctttcccccccttcccttcttgggccggctcggcccaactctccctccctctctctcctctcccccgcggcccatcggcctcccccgcgcgcgcgccgctgacaggcgggcccgcccgccgccctcgctgacgggtggggcccacctgtcatcgccttcctcccgccgctcccgccgcccgcccgtgccctagcgccgccgccgccgcggattccgccgcatcccgccgtccccgcgcgcattaaagaggggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgtcatttccatcggcttcgccgcgttcccgtcgaccccgtccgcatctccgtttcgcccgccgaccgccggagcaccgtcgtcatcgtcatcccgaaccgcgccgccgccttcttccgcttcggccgccgttcccgtcgtcgccgtcgaccggggtgagccgaagaccgtccccctcgcttcccccttccctcctctctctcgggtgccgctccgccgcgccgttggtcgccggcggcgaccatcggggcgcgggtgcgccgctcccgtcggccgtgccggcgaggccgccttcggcgcgccctcgcggctgccaagtgggcccggccgtcagccgcccgcgcccgcgggtgcggctgacgcgtgggacccacagcgccggccgccgccagccgcgtgctcccggtccaccgtggaccgaggggctgacgcgtgggccccactcccgtggacccggtccgcgcgccctctccctcggctgacgcaataaacccgatttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtgtggagtttattagagtaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaacattaggtggttttataactttagactttgggaattctcatatcatttggacactatggaattgttggattatggtggaattggacatacacctctctttctctttcaaaacccccaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggcctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacacaagtgcacttgacgcaaccgaaatttttgacaagctgagagttgcaccggatgtatacttcaagaatatcaagaaagctggaagtatgggagctagcatggcattggcgatgaccaaatccttgtacccgagaattgaaattgacaccattgatggctttgcagacgggacaagcgaagaggctgctcttgatcttatcagtaatgctcaaagtgcggctgacaagattgcaagtgatgttgtagatcaattccgcaacaacgaccttcagccgagcaacaataactctgatgatgaaagaactgattctgactgagtataaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaaccaaacaaggcaatgataaaccgagcaagcaaattgaattgataaaaaatcacactccattattatgatgatagcccccgactgacaacggcaagaagaaaacttgatgttgacagtcaagatagggaagtacaatgataaacttaagcgtaaaaacgacgaagatgctcaatgttccaagagttgtcgacgagagtaccgtcttcgcgcttgagtcgataagaacctggtcgggtaacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaatcggtgtaagtcatccactcggtcctcttcgtagcgttcttcacggaaatttcgaaagcgcaaagactcgaattcaacttcactcggcaacattgcctctgccccatagacaaggaaaaaaggtgactggcctgtggcccgactgggtgtagttcgcaaagaccaaagtactgatggcagctgttgcacccatttgccggcatagggttttagccggtcaaaaacacgtgctttaatcccttggagtatcatgccattggctcgctccacctgtccattgctcatggggtgtgccactgaagcatagcaaatcttaattccgaagtcttcacaaaagtctttaaaaactccaccagtgaattgtgtgccattatcagtgatgattcgattgggcactccaaatctatgcacaatgttgatgaagaaatctcgagcgttatcagctgtgattgtgacaaccggtttagcttcaatccacttggagaatttgtcaatggccacaaagagatgcgtgtaaccgccgactgcctttttaaacgggccaaccatgtcgagcccccaaaccgcaaacggccaagacagcgggatagtctgcaactcttgagctggtagatgaatttgtctggcgaaaaattggcaaccttcgcatgtgcgcacaattttgtcggcgtcggacactgcagtaggccagaaaaaaccctgccggtaagctttgccaacaatggtgcgtgcagcagcatggtttccgcatatcccagaatgtatgtctttcagcaattgtctcccttcctctaaagatacgcagcgttgcagaattcccgaagggcttttcttgtataactcagcttcatgcataacataaagtttgctccgccttgaaatccgctcggcttcatctttgtcttggggaagttcttgagaagtcaaaaatcgtataaggggctctcgccagtcggtttcaaccatagcaacgtcacgagtgcccgcaacttgagtagtatctttctgaggtactgtcggcgtataaaggtgttcgacgaaaacatcagagggtgccgtctcgcgcttggatccaaagttggcaagtctatcggcggcttcattattgtgtcgaagaacatgactgagctcgagtccatcgaacttatcttccaatttgcgtacctcttgtcgatatgccatcatattgtcgtcaaggcaggaccactctttcataacctggttgacaaccagctgtgaatcacctcgaactattagacgctttatccctagggaaattgcaatccgtagtccatgaaggagtgcttcatactcggcgacgttgtgggatgccgaaaaatgtatccaaagcacatagcttaatctttctccagttggggaaatcaaaaccactcctgctccagtgcccgaaagtcgttttgatccgtcaaaatgcatggtccagtgctccatcttctccgcgggggtatcctcctggcactcggtccattcggcgacaaaatcggctaacgcctgggacttgatcgaaattcgggccttgaatgatatgtccaaagacatcaactccaaagcccactttgcaatccgtccgtttgcttcgcggttgtgcaatatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttctggacatggccttcttcctcgcgctcaacaaccaagactgtgctcacaacctgggaggtggctgatacatacagcaacaacggctcttgcgggtgtggtgaggctaagactggtggctcagtgaggagtttcttgaaatcttcgaaggccttctgtgcttcgggtccccactggaagtcgtctgttttcttcagcagcttaaagaagggcatcccccgctcgccaagtcttgaaacaaatcggctgagcgccgccatgcacccagtcagcttctgaacatctttctgggtacttggcggtttctccgggttggcttggatgcccctatgagacaccataaaaccaagcagcttccctgacggtactccgaaggtgcacttttcagggtttaatttcatcctgaaagcgcggatgctcgcgaaggtttcttccagatccgaaatcaaatcatccttttgcttggtcttgacaactacatcatccacataggcttcaacgttgcggccgatctgtgttgagaagcatctctggatcatacgttgataagttgctcctgcattttttagtccgaacggcatggtgacgtagcagtatgccccgaagggcgtgatgaatgaagtcttcaagcagtcggattccttcagtcggatctgatgataccccgagtagcaatccaaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgctgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagaaggatctaggggaattttcttagtcttggcttcgctttctccactttttgaagtcttggtagcgggcacttctccttcgctcgccgtggctgcagccagtcggatttcctctcgggcagacgtcatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaatttggctaacgccgggcgtccgagtatggcatggtatgctgtctcgaaatcggcgacttcaaagctgatattctctgtgcgaaagttttcccgagtgccaaaagtgatcgggagagtgatctggccgagtggagttgcggataatcctggaattactccgtgaaaaggcgcattgcttggttttagctcagagcgaggaatctgcatatcatccaaggtcttggcgaagaggatattgagtgcgctgccaccgtcgatgagggttctgcgaagcttgacattacggaccactgggtctagtaccagggggtaccgccccgggtggaccactcggtcaggatgatccgagcggtcaaacttgattgcaatctctgaccatcgaagaaattggggcgtgtcgggatgaacagcattgatctcccgttcggtcaacttttgcttccgtttagactcataagccagggggccgccgaagatatggttgagctccttgcggtggtcttgaaatccagtcggggcgtcgccgtcgtccttcttcctcgacgtgctttgttcttcgtcggagttctttcgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactagcagttgcaacaagttccgcaggcttacgcttgcggtccttatgattgttacttccacctcctcccggagccggcgtatccttttttggtttccaactcgggcccgactgctttgatgcggtgacagcgtcttcagctttggcgtactcgttggctttttcaaacatgagcttgactgtcctgggaggcttgcgcccgaacttgccgaccaattcttcgtggcgaatccctttggtgaaagcggcgatgatgacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcggcccaagatccaattgtaccacggggcaatccatggagccaagaccgggcggaatccgctaaagccactggtaaatagttcgccatggccttgctgtctcctcctgctgcgcggattgcgagaccgtagacggtaagccactattctgggttagtggtaccatcgtacttctctattccagtcggcttgaagccggctggccaatccactcgacgcaggtcgtcggtgaaggctgctactccatcaaggtcgtcgtcgtggcggtccggcgagtgaagatagcctcgtgctgctcggcgctgtatgattgtgtcgcgaagatcgacggggcggcgactaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctaccagtcggcgtgtggacgctttcggagttaactgggaccgaagccgcaatcatggtcttcgtctggttcaagatgttgacgacgtgatcagattgattgagctcgttttccctgaggagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacggtcctgctgctcacgccgtagccgttcttgttcttgtgcttgatgctcctcctccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagaactaaactcgtcgtactccacgatgtcggtggggcgcgagtcgacggtgggagagctgtagtcgccatctagctgatccgtcgaaatcgtgccgagtggttggaggatgacgccaacttccctgaagctaggcgaaatcggtgtcgaagccgacttccgcctaggcctacgggaaggagacgctgtcgtgatggagacggccgtcaaatcgtcggggagcttcatcaggatcggtgggtaagccccatcatcttgatctggtgacattggagaagatgcgatctcagccgagtggtttgaagccgactcggttgagatggtattgaagtaactctcagccgcgtttgggaatccaaacgggactgagatccggctctctcccgactggtccgactccgagtcaaggagagagatcttgccgaagttgttggtgacgaagtcgaggctgccgaaccgaaacgtctgcccgggtggtaagacgaggtcgtcgatgccggtgacgggacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttggagaaaatcaacatccgccgctagaggcacccggaccccccttatatatgggaaggagtccgtgttacaaaagataatctatatccctaacggaataggcagatacagataaaatacagtcgtgaccgactagatctcaaggtatttcctttacgtacaagttaagaaacaaacccgagatacacacaagatattctatctatattcggtatcctatattcaacccaaatatcatcgccgtgtagatatgggatatccataatctccacaaaaagcatgacgcctagagaagacgtttgtaggcccagttgagaatagcacaatcaatcggtgtatggaaacagaagatggacgcggtaaaccacatccacagctcacaaatgtcaagtggtcgttgtctactgcactgtagcagtgccgcagcaagattggtctgtcggtttccacagctcaggaagccgacgtacgagaaggatgtatggtagactcgctcacagttaaaagcgcgggagtagttaacaagctcgctagctcaatgccggccggcctgctccaccacaggcgcaaccggagccacaactttaggtcctgagcgtacacaacccaaaagactagtctgatgggtgaggaccgcccccaccttttaagtcatgctcccctaccatcaattaccgatgtgggactaaacccaacaatctcccccgtcatacatcgggcctaacaatctccctcgtcacatcaacccatgtgaccccgaagacttgttacttgggcctcgggcctaacaatctcccccgtcacatcaacccatgtgaccccgaagacttgttatctggcctaccaaccatatgacccatggaaattattccggttccaaaccttgggctctgataccacttgttataaaagttagtcgatatagcggaatgacgactaactgtcacaccccaatccggcaccgccgcacaacggcacctgataggagcgtgtcgtaggaaaaacagcgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagacagcccgagaatgcaaccgacgacacggacgaggcgaacaccaacaacagcagcagcagcagcagaaccaacggtctaacacccgacaccacaggcgacggctgggaaccaggacgaaaccctaatcttcacttccctttatcttctcttcaggacggaggaactatatatatttatatagagcaagggtgagtactttcgtactcagcaagtcacgggaacctaggtgtttaatgcaagcttggaagagaggcaaggttgttttgcaaatcttttatttgaagacattttgaaatcactaagtgatttatttctttctatgtttgggcgaaaagagacttgcgtctcgattcgactttatgagatgcttttcaacagctcatttagtaacgtaccgacctcccgggtcagatcattacttctcggctcccagagcttttttcattttctcggactcccagagtccagctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactccagacactggccggtgtcagaggttcgcgacaaagcctttctcaagccgacccagggatacctcatgccacatagaaggatcaaatcctcacataaacataggccattttaggcgtgcacaaatcaaactccaaccacctcgatcggtaatctggcaagcttcgcgttcttgccttaccaggagaccggtttggctccaaccgaccccgccccggcgttcccaactattggcatgcgaggtttccctgaaccgactagctacttatccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtaatacgacctacggaaattagtgcgactactgggtaggtccgtcggtttggcacgcaaaccgaggccaagcaagttaagtgtgtgattctaataatgcaagttacaaacaaaataataatgattttccaattagaggagcaattggtcaaagggtgacttgccttgctcaaagtcttcacgaagcttcacgaatcttcaagaaaacccgcgatcgacgaaaatccggtaaccgcaactgtacgcaaacaactgaaaacctaagcaaaagaccaaaagagggatcctatttagactaattagtagtgccattaaatagatctcaattttacggaattactggaagtggaacggaggcaatcggacgaacggatcgagggatatgaattttggaagtttaaaggaatttttctggacaaagagacgatttgtcggaattttctggaatacgagaaatagtttatggaatttatagaaataatattctcaagaatattattgacatccactgacatacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaataagaaggtgagagagagaggagcaattggagggagtaattgtggacttttagctcttgggtgatggacactgggcttggacaaagggagtgtatgtggactttgttttcttacttatcaggccgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagcactggcggcaggaggaggagaaggggaactcattccacggctcggatcgggaagacgacgcgcgacgacggccggcggcggcggccaatctcgccgacacgccaacgtggccgcacgcgagaagagcgaagggcacgcgggctcgggcttcgccgaaccggtatggggttgcgacgcgcacgcggtgacgcgggacccgatggtcaccggcgacgcacgcgcggtggcgttatgcggcggcggaaggggcgacacggcgcggaggcaaaggagaaggccggcggcctagggacagtcagggggagctcaaggggatctccgggagcgtggcggcgagaggaatcggctcgagaggtgccgacggcggtcgattgcggcggcggcaatcaccggcgagcaaaaggggaaaacacaacgagacgacgaggattcgattcaaaggggtgggagcatctccggggttcaaggaatccgtttccggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttggcgagggtggtcgacgagctggggcccgacgacggcgcgcgactgcgcgcggcggcggaaacagagcaacggcgaggcgcgcggcgcatcgtccggcaggctatggcgtgcggcggcgggcacggcatagcgaacggtaggaggaaagggttcggcggggagctcaccgacaagaggaagcggcgtcggcggatcgaagggagtcgtggttaggtggtcgcgacggtgggacggaacggcaccgggtgggcgcggccggggagnaagagaggaaaggtggcgcccggagctcctcgtcacgcgcccacgcacgcaccggttcctccggtgctcggcggcggacggcgacgacgagatcgagtcgagcggcaacagggcggcgatggttgttcggctacaatggcgcggtggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggcggcgaaggcggtggatcgagcggcggaaaatcgaaccgcgggagcgggaggattagcgcgggctggcgcggtcaaggtgggggtggcgagctggcgctggcgtctgcgtctctgcctccgagcgctagcggccaaggagtggaggcatggcgtcgttgcttgggagggaaaaagagagggaggacggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcgggttttgggcggcgacggcgggaatcggcgccgggaggggagagagcagagagagagagagcgaagacgggagagagaaagaacgagagagcgagagagctctctctcggctcacatgcgtgcaacgcacgtgcgaggggggttaagatgatgggctgggaggggagatgggccgggggagaaaacggcccacaaaaatccgagggaggcaaaatagactttttcggaggggattgattcgaagagaatttgaacttggaatttgacttagattttggaattgggatctcgatgagaggaaggagtagacggaggattcaagatggggttttgaatattttggatctggggaagtatttggcgatgattcaaagagagggatagaatttcagagtttgattgggacacttgagtcggaagaggaatttcaagggggcaaatttgtgatggttacaagagggatcaaggacggatttgaattgagatcttggcacaacttagactcgcacacaaa

SEQ ID NO: 63668 - DNA, 28687 bp, Oryza sativa
cctccacccctctttatatggcgcagggtgacgggggcccaccagccattgggctgggtgcccccgatcagggcgcgggtcaaggcctccttgagctgttgggctcaaggggagggagatctatctaacattctcccccttgatctcactatttcttttagcctttttctattccatcatagatttgcatatagagcatgtttcatcgtcacggttaatcaccgatggattcgacagccactatacacatctctattcagaaacagatactttaacttttgggccctatagtccaggattcataaggcttcccttaaacccatgcatgctgcatgttccttgaacacgttgggaggtaggcctttcgtgagcggatccgcgagtatcctttctgttctaatgtgctcgagactgattgtttgatcctggactttgtctttcacaacatagtactttatgtcaatgtgtttggcagcaccacttgactgattgttgtgagagtacattactgtgggttcgctatcgcagtataactttagtggtttctcaatactgtcaaccacctttaaaaccgggtatgaatttctttagccagttcacctgccccgttgcctcatagcatgctataaactcggcatacatagtagaccctgcagtgatagtctgttttgagcttttccatgaaatagctcctcctgccagggtgaacacatatcccgatgttgactttgtattatcttttgcaaagtcagaatcagaatacctcactatctggagcgattctgattttctgtaagacagcatgaggccttttgttccttgcaaataacgcaagactttctataccaatttccagtgctctgggcctggattactctgaaatctgccaagtaacccggtaacaaatgccaagtcaggtcgtgtgtacatttgcgcatcctgttggcttcctacaactgacgcatatggctttgtttttcatttcattgagctcatactgatttctaggacattgcgatgccccatacttttcgcctttgactataggagcaggtgtagcactgcatctgtacatgttgaatttcttcaacacattttctatatatgccttttgagaaagtcctaatgcatactttgttctatctcggtgaatctctatgcccaaaacatatgaagcctcaccgagatctttcatgtcaaagtttgaggacaagaatttctttgtttcctgcagtagactgacatcactactagccagtagaatgtcatccacatacagaattaggaaaatgaatctcccattcttaaactttgaataaatacagttgtcctcgatattctcttgaaacccaaatttctttattgtcccatcaaacttcaagtaccactgtctcaaagcttattctaatccataaatggatctctttagacggcatcccatattttcatttcctttcatgacgaaaccttttggttgtgccatgtatactttttcctccaaatctccatttagaaatgtcgtttttacatccatctgatgtaattctaaatcataatgtgccaccagtgccattataatcccgaaggaaactttacaagagactggagaaaatgtctcattgtaatcaatcccttctcttttgcgtgaagccttttgccacaagtcacgctttaaacttttctatattccctctagagtcatatttggttttgtagacccatttacagcctactgttttggctcctttaggaattttttctaaatcccagacaacatttaatttcattgatttaatttcatctttcatggcttccaaccattcagatgagcgggcgcttcttatggcctcttcatatgaggtgggatcattctgcatatgcgactcttctatattataaacttcatagtcatcatggatagccgatcttctgactctttcagaccttctaggggcctcctgttttggcacattatctgtttgaggctattgtagctcctcctctggtgtggcaataatttctgttgaatcctgtagaacaggttcctcactttctttcattgttgccacaggagagataacaataggtgttggtaccgcaacgtcatgcattgcaagcacaacatcagcaggtagagaggagaaggctcttgaatcgactgagcgggctcagacacccgcctctcgtcaagatcaatttctcgaactaccgagctccccctaatcatttcgtcttccaagaagacggcatgtcccgtttctacaaactttgtacaactgtttggacagtagaaacaatgaccctttgatctttcagaatagccaataaaatgacagcttactgttttgggatccaatttcccaagatttgggttaaatactttggcctctgtaggactcccccacacacggaggatccatagctcatacggtgttttgggcgctgatgcattctatgcattgtatgcattgttctaaaactgagaactccaatggaggaagaattacattcttaaccagtctctcaattctccccctcgaaatatggcctaaacgacagtgccataatttcgatgagacatcaggagttcgctttcttttcttgttttcttttgtcaacgaggacacaacattcacattctcaaaaagagataacaaataaagctaatcttgcaacacagcaagaccaatacatgcattattataccatagttcacatttgccatttccaaaatgacaatcatatccatcaaaatacaatttggatacacttatttctttgcaaagaagggacataaaaaacatctcgaagtaaaagtgtgaagccattcgtgagctctaggcgaagatctctaacagcttcaacttttgcttcaactccattggcaactctaatggatctttcgcttctttgcatagtcctcatcgaacggaatccctttaaacaattacacacatgaatagttgctccagaatcaatccaccatgtggatctagaataaccaatcataatgagattcatttacaaatgtaataatgttctcacctttctttgccatgatcactgtcacgaagtcaggacgatctttcttggaatgtcttgtcttcttgcagtggagacactgatcctgtctcaactgtgaactgttgttgctgaggcagatgctgaggctgttttgcttttgaggagggtgacctgtggctcttttccttgttatctttaacaaggttaattgagccaccaatggtctctttgattctttcctcctcttgcacacaattagagatgagctcttcaatattccatttctctggacttattttgtagttgacaacaaggttgacaaagtgctttggcaatgaggtcataaccagatgaaccagaaagtcatctgagatgcccaaatctttttgcttcaacttggaagccatgttgctcatcctaagaatgtggtcttttacaccacctctatggtacctttctgtcacaagctgctttatcagttgtgtcgcataaaactttgaagaaccagcaaactggctctttatactttcgaggtacttagagacggtgtcatactctgggattaagcccaatatggttggctcaatcgtgttctttaccgcagccaaacattccttgttggctaaggtccatttcgtatgcccaatgtcatacgacatgatgagggaagcattttccctctctctcttttgccattcagcatctgactctttttcacctctgaaaagttcagcaggttctataggacatggggtagtcaacacccagtccacctctcccaagataaaagcaaggtcgagttctcttttccattctttgtagttatctcctttcagggtcggaatatctttaatgtaacccatcaaggagtagtcacctgagataatcatgtattgtgagaacaaaattaacattaaaaatattatgtattaagtctacatcaccgttgggcagaaaatagacataacacataaagccataactataacattgcaatcatcaacgtgggtcagaaaattacaacatcatagcacataattaatgttcctaaaattaaattctcccgttggttcgaaatttaattttagaaacactaattttcatcaatatcatctatttgcagcggaagatctatattaaaatccataagaacagtaacaaaactatgttatttactctctgtaaaaattctcctgttggttcaaatttaaacagaggaaaaacatgtaaaaacaattcaaaattctattgtaatttgcatgaaaacatacaaaatacatgttcagaagcatttctcacatttatctattctctaaacaattttcacaatttacaaattgcttagaaataaaaacaatcattaaacatattgaaaatgattctgaatagggacatttattaaacttcttttccttcgccgagggacctaatatggacttttttggcctttgccggtcggcccacggtcgcctttaggcgcttgcggccatgccccctcccccaggccgcaacctaggcctgggccaggaaagccgccccccgcgcgcgccctcttgggctattttcggcccggccgccgccggccgtccgatcgctagggtttcgatcggacgaccgcgcggagagatcgggcaaaacaaaacctgacccccagtcgcctgcgccaaaaaccctagcttcttctcttctctctcatgcgaccgccgaaaccctagcacagcgccggcggcggcacggccccggcggcggcttaccgcgcggcggcggaacggcgacacggcagcgccgtcgcactccccctcgccggtgcgcgcactcactcaagggtgagtgcgctaccgtcgagcggctgtgccgcggcgccccctccttttctcttcgctttctctctcgggcgggctcggccgcgccgagcggtgtcgtcgacgcctcttttctcttctcccccatcgcgccaccagccccaccgagtgagagagagtagcggcgacgaaggagatggcggcgccgccgcgggccccctcgccggcgcgcgcgtgcacccgcgggtgcgcgcgcagccgtcgaggggctccttggcggtgcctctttgcccctcccccctccgttgtcggcgtcaacgacggccggcgacgaggtaagattagggttagggtttctcttttcaatccgttggatcgtttgcttttctttcttttgcttttctctttggatttccatccccgaaaacaagatccaaacgctagggttgctctgataccatttgttagcattgctttgggatcacctaggttagatctagtcgggtagaacactttggatagacgaacaacaatagatggattaacaaagagggagtgagagggtttagggatgtgaccggtcgatgttgaggaggaggaagtgcggccggccatcgtcgttgtcgtcgcgggcttgacgtggacggcggcgatggtgtgcttgacggcgacggtggtcgtagcagtgggagtcgtggtcgacgatgaggcgtggcgcggcggtggggcgttcccatcactggctgcgccccctctcgatctgattagggtttgtggggtggagttggcggcggtgacaaacttcgtgtcttgtgccgctctgcctccacccctctttatatggcgcagggtgatgggggcccaccagccattgggctgggcgcccccgatcagggcgtgggtcaaggcctccttgagccgttgggctcaaggggagggagatctatctaacatgtagcagcccagaactcacctactatggctaagaaattcagaccatgacaatgcgcaacttatgggttcagtgtttctatctctcgttttgtccaccgagcaaaaactttactcctaattaatgggtgctcaactgttatataatataagtcatgcgcccatgtcaatgcattatgcgtgccatggcccatggtgcctgaaattttgttgagcacagggttctcaaattcacgcccctcgtgtcgagaccaaagctgcggtgcattgggtttctgcaactcaccttgcaattaaccagtaataaactagtaatcgattccctaagcagaatagtcgattccagaataaccatgattctctccctttttttagtgcgactacaaccatgactaggactagaactggatcgggagggatgcaagcagggtgggcaagcgggctttttttgcccgcttatcccacttctagttcatttattcttctaaattttgaactaccatgcaagaaatacactagcaagcggatttttatgtgggtagcgggactacccacttgcatccctagatcgagttagcaaagcaacgaaaacaagggtttccttgccaagcaaagaggatccaagaaggattcggagggggataaggggggagagagcacccgtagaggaatggcctggatgggattctccctcgcctcgtcggttgctcttggtccggtcgtagagcctcgcctgccgtcaagccggcaccctagcgcttagctgatcgcctcgccgccatcgccggtcacctcgcgattactcggtcgagttgactagtcgagggcacccctcagttttctcggatcgtgcgaagtgaagttaggagatctcgggaagtagatgggctgatatgtaattggggcggttggtttatttctgaacagaaacagaaatatgtactttctctgtctcaaaatattactactacctagtatcttctgttcttaggtattgctatccaaaatattaaaagcttagcgataaacaaatcatgttgttacctaaaaattctatcttagatagcaatattttgagatagaggtggtagttggtgtggaggagccgaggaggtagttaagagtttccttcgctggctcgagctactctccgccaaacagccggatcagctgtttcgcatagccttcggatgttaccggctcccggccgctccggcacgtgccaagccaaacactccgagtccacgacattcgccctctgaccagtgacgaagctacatgtaatctgtatagtcagctaaccccataggtttttgcaaaatagataaaaaaaattgatatttgtgttgtaacaatagaaaacttaaaaaaatttatagctttgaccccgcaggtttttgctgctggcttcctcatgcatcaggctgtgaccttgccagttggcacccatcggtcgggctagggctgtcaacgagccgagctcgagcgagcttgcttgcctaggctcgagcttgtgtgacacaggctcgagccaagctcgaatcgagcctagtcctccttcgagcttttaagcaggctcagctcgagctcggttaggctcgcgagctcgatcaagtataagacaatgtatattttgatggcaaaattttgcaaaaaaaaataattttaattaacaatattgaaggaaaaaaaatgagaatctaagattaatatatgatgccaaaatacaattttcacacgaatatatactaatttatcctcgagctactaacttatcatataaaaagataaatatttcacacacagttaggctcgtgagaagctcgagctcggctcgacaaagctcgcgagcttgcagctaggctcgggttcggctcgttaagatctcgagctgagctcgaatcgagtctgagacgagccgagctcgagcaactcgcgagcctcgtgctttttttgacagccctacgtcaggcctcccacagggccgacatcacgtcaggtccatgtcgcgctcctcgtgttgctgagtttcccggcccaactgccaaacccgtgtgtcgcgatgaacgcacgttcacctcacgtcctacctccaagcattccatcccgagttcggatgcctccgacagacaagctgtgtttagattcaggggtgaaaagttttggcatgtcacatcggatatacggatatatatttgaagtattaaacgtagattaataataaaacaaattatagattccgtctataaactgcgagacgaatttattaagcctaattaatccgtcattagcaaatgtttactgtaacaccatattatcaaatcatggagcaattaggtttaaaagattcgtctctcaattcacacgcaatctgtataattagttattttttcgtttatatttaatactccatgcatatgtccaaacattcgatatgacagggtaaaaaattttgccgggggatgtaaacagggccaagaattcctgtcttttcggagacattgcctgattgactatgacacatgtgagtcgcgatgcgccggtgacaacctggccaaaaacaacaataaggggaatgagaaagaaggtgaaaccacatctgcacctgataaaaataacaggggagatgaggtcatgtcacccacatctacccaattgatctcactaatgtgccaataagccaattattaattagaaacttcgcactcgtgtcgattgtagctgaattgaccagcttcgtagagtcaatgttgcagctttgaattttttgtcaggccggcaatggagcaccgcccaggtttttctttttctttggacttcccagtgcccaccattgtttaaaattttggaacacagattgagttgcatcaccggcggtgcccaaggtctcttgttgaagcgcgtggtccggaaatgggggacatcgccggcgaagagcatcgagtccagatagcagccagagccagctccgaccggcaagacaaggtcgcggcgccggaaaaatgggtgaattgcttcgttcgcgtggtgacactgatggagaggacgagcaatgcactcggcacgctggctttcacttgggctaccgttgtcctgctaggtggctaccctgtggtgctcgactcgcatggcgatttttggttcgcgacagccatcgtattcctagaagccgcaaggtatatacagctacttatgtactgcccatctacacctgtttttgattttttgttctgcagtctaagttttcacttttctttgattacacaggatgttcggtcgcaacaatagatttgattaccaattgttcttccggacaagaggtgctttcagtttcagatcacttggcgggaacggactgatcgcgatcgtatacttttctgctgctaaggtggccattgttgttcgggaggtgcaggacggggcatttatgttgattataatcatggtattagtagtaatactacttacggttggcccattagtatctcgaggagctcgaagaccacgcacctgtagtctgctgctccgtgtgatatcgctatggagccccgtggttgcaatcctattgatgggttcctccatattccatatgtacggagacagttttgtcatgtggatagtgtacatagtgctccttgcggttgtgctcttggtgacggtcagcaggctgcggttctcaattattgtcaaccaagtgcgtcctgctttgggcagtaaacacgtattttggcgtcgggttattccttttttttttttttttttttttttggcaaccgtcggtttattcttaactcgtgcatgcttgctgcgatagtgatgatgcttttcatggttgatccagtccttcaactgttcaacacgtgatgatcttgctcgatttatgtggttttgccatactgtcatctggcaacttgcagattcctgcagctatcgtgcgcgaagagctcgcgaggatgcgccttacgcgacatgactacatcggtgttggtgagaagacaaatcttggccaatctcttaccatcctctacagcatggtgcttggccaaggcatactttacatcgttgccggcacgctggaggtcttctcgttcatcccactgagatccctcgtttgccgtgctggatttacaggtcagtggggagttgaatctatcaatctgtactacgaatatgccttcgacaaatacatggaaggaggtgtgtttgctccaaagaggatcaacctcagcaactttgcgatagattctataaactctgacttgtccaagaatcaactgtacgggatccagatgatgcacacttttctgcaaagagatccgacaagagcacaactcctggagaaactcaccacttcaatgcagacgaaggccaggttgatcaacatgttggactggactaatggaaaccaacatacaactattagattatatgctgcgaaggtcatggccgagttcgcaaagagcctccgaattgtaactgtccctgaggcaatgcagcttgtatcaacgcttctggataccgagggaagaccaaaaagaggacacccacttctaaatgcagatgatgatcaagatccttttgttgatccaacagaagaaagactagatgcagctggtgatcaagagcaaagacaagaattagttgcggacactgacaactagctggaaacgccaacccaatcagcacacagcaacgaccaagtatccatactcagaagttggcagaggatatcagagtattggtcaattcccaaggagcagccgctgacaaaggacgatcttctcccagcattgggcatgtcaattgtctacagtcttgctagttgtgatcaaaataactgtgtggaaatagacaaagtaactgacctgatccccaaaatcataggattcacaagcttcagaagtgcaatggtgaattccgtagcacaacagaaggttctcgtaaagtcatcactgagggtgctgtagaggctcacaagcattgaaggggaaattggcatagcattgcggtacaagatatcaaaacatcccttcctgttgggaaaccttgcggagatcttgggagacaacactagcatgcaagaattaaggaagctcgtcgcaggaatcctcagaaaccttgccattgaccgagacacaaggcaggagattgggcaaatgcaggtgctcattaccaggctgatgaaggcgtccctcaattctgatggaccatctagtacagatggtgattgcttgcttccgaaggttgctgggcaagcattggcaatgctggcatcagaaaatgtgcataactgcttggttatgttgaaggaaccagaattcattaataaactaaaaaatatgatcctaatccatgatgggaaatgtatatatgtggctgcgagcctgttgcgtaatctgtacctgcatgctcaagctcaacccgacctcacagaatcaaaccaaaatgacctatctgatgcctttcaaaaggtgagccctgctaatccatacttcaagtgtaatattagatatgtatagtatgttgtatcatttgtacatttgttgtctattaatgtttgtcaagacataattattttataatcaaaatggacatttatttaccactaaattgtataagtataattatagtttacaactatgttcatcatgctacatgacattgctggttccactacacaggtcttggaaacaataacggatgttgaaggggcagaattagaaatcctcattggtcttagttcacagatatgcaaagtcaaacctgaagaatttgtgcaagagctagagcacggacagattaagcgaagattcgtgaagaagctagtggatgcactgaatgcgaatatgaaaccaagtgttgattaccctgggatccggaggatgatacttgagcaaaccatatatatgatggagagcagttcttgctatgccaattgtttcaatgaatttcagatgatgaatgcactgctgatggtagaagagacgccctcaagggttgagaactacatgattttcttgggtgatacaggcttcatggaatgcaacacacctctctctgctctcgtggacagagcaaaacaattgattggacattagtggctgcaaggcatcagcagcgacaaataaataaattgtaagagatgaattcccattgacagttgcagtgaattattgaactgttattgcagttgaaatgctatgaatttataatttacgcatgttgtggcgatgacataaggaacagagaaaaaaaatggtggcattagaatcagaataccattcatattgttacttgtttttttttttttgccggaatgaccgaaggaggtcattcaatgcaattaagataggaagaaaatattacaagaaaagttttacatcgacagctggctgtcgaggaaggatgtgcactagagcacacgccccgaaccatgtgccaaccgtccaaacacacgctacagagagggaagccaagcaccgaaccggccatcgctatgcgagaccgatcgccaccgggccaacaacaccattatgacacgaagactctaaaacgacgccctcacaagggtcgcgacgccgaaagacgccgtcgtcatccgtccaaaaactggacaaggttttcacccagagttccttgccgagggaggaggggtatctcaacaatgccctcaggatggttaccatgcctgaaggcgtagtcaccgttggcccaaagaaattaggctaagctttcgctcgaaaccccttaccgccgtggtccatcgcccaatccgaatccaccatctaaacatcggcggcacatggcttccaccacacccgaccgatgcccctccgcgattagcttccagtcctgccaacgacaagactgccaccacaccgcaccgacgccccaccgtcggccgacttcatcgaaccaccatccctgagagctggcctaggacccctccatgccaccacccgccggcctcctcgccagatctggctgaaggagaacctgggactgggtggcattgcttcggcatcctgagcttcccccgctgacaagtgacaacctgccgtctcaatccaacctagaaactccctgcaaagaaggggggagctccagaaagggcgagggtgccgaccagcaacgaagaagacgacccacagccgccagctccctttgcactaccatctgagcctacgccgatgccggaaatgctgccgctccggcttcggagcccccccacggtcgccgcgtcttgggctgccggccactaggcggccaagccgagcggccgtcgccgagccgccgctgccgcacctccgcaccgacctccgtgctgcacttcggccaccgcgccgacgcaggctctactccggccgatgcgtcgacatcgtgccaccgacacagccggcgcgccaccaccactggccgccgcgccaccagccaccacatgggcgcaagcgacactccggctgccgcgtcaccgacgtagccggcgcgctgacagcccgagccgccgccacgccggagccagaccgacgcccagccaccgcgttgccaccacgggccaccgcgccgccgcagtggccctgccacggtcgccacgccgtcgctcgagctcgcgccgtcgccgcaccgaccagattcgggggtgggagggccggatctaccgcctccacacgatgccctgccatcttcgcctccaaccgctgaggttgacgctgtcggctttgccccaacctcctcgcgccaaggaggacgccgccgagctcaactggcctcgccgccgccttcccagctcgccggcggcacgccggcaagctccggcggtggcgaggtggaggagagggccgggatgcggcggcgcgggcggctagggtttcgcctcccgagccgcccacccgtgttacttgttagcacggggtaaaaaactggaatgtgcatatggctttagaaagaaacatgattttcgttcgagatgagcaaacgttatttgtaattttacctcattagtactgtttgtctgcttttctactgatgatttgtccaaatatcatctcttaagagtgaccaattaatgcataataattggttagatataggtgtttaaggtgattgcagttcctatgccaagttctagtgcgtcccgcttttggcatcaaattttttggtaaaatctttgggttattttttatacctggaaattatttgctatcaattaatgtgaactcaactgaacatccatgaaatatacaaatcatgcgcccatgtcaaccgtgcatgccatgacatctgactctagtttagtacagggccactaaagtcatgtacatggccctattgagaccaaaactatgctgtactggagctttctactaactcagcattgcgattgacctagtagtaaactagcaacccaagagcactcccaagattccaaatccctaagcagagcagtcgatttcagtataaccatcactctgttctttctgtaagactaagagtgtaaacatcagttaccttgccaagaggagagggggcacggaggaagagatgaggcaaaagggtgatcggatcgggacctgtttgaggaatggcctggaggggattcgccggctcgccctcgccacgtatgtcggctgctcgtctccaccgaagatcctcgcccgccgcccccgcctggtgccgtcgcgcctagctggtcgccttgtcggctgctttggttgcccgccggagatcgtcgcccagccagcaccgtcgcgcctagcagcctggcaggttgccggccgcctcgcgttagtcgatcgaggcagccaggccattgccggatcgtgcgtctgtcggtgggatggacaatgagggctgctagagaacggtataccgttcaacggtatatccattacctctcccctagacgagatgcgtgtgtatccactcgacaggacgtgccccctagacacactatagggtctagtagcttgcctgccggctggtatggagttgtgctatgtgtcaatcgctagctagctacggagtagaagctatgcatatgcgtcagtatgggacagtgttccctggctgtagtctgcactaaaattaattactcttgtataatgagtttgcttatggtaaaatagttgttccgttatttttattattaaataatttagatttttaagccaaccatgcacaattattagttggctaattgggccaactaatgattgctcatttaatttagttggatcatattagacgaattgtcaatattatatctggtacccataggtaggtaccataggtaccggagcaaagctaatatcacgggtaccaggtacttggtatctggtacccgtgatacctggtagcctggacgaggaggagaagagagaggataaggcagccgcgtggtggagcatggaggcaagacgacggtagcgcggcacctggaccacacgtttgagaaagctcgcgtcagcgcacttcgtaatgtagttgttggtggtgataccttctatgctcgggcgatgatacttgtaggcacttatgatgatatatgtctagttaaaagggatgatagtgatgatacgtatcaatgtatagttatatatacatgtactagtgtacatatccatatgactgatttgactgctgcataggcctcacgatcatgcatgcatgactggttcaccagctatcacctgcacacatggaccccacccatgtaagcctacttctaccatgcagtaggtgtcacgccctaaaaatcctaattatataaattgttgtttaattggaatttttagaaatttaaattaaaagcctacaagctaaaccctaataatctaggaaaattttcaacataaaaatgagctagataaaattttattaaatactacacttgctcctctattttctagatttttctgggaattatttgagcaagggaagtatttttaataaatgaaacaacatttcacaaattttttttaattaaaaagttccaaaactcctcctttaagccgttgggctgagtttggcccaacatgccccctccccgcccgagcggccgagccggcccattcggcccagccgacaccgcccgccctccctcacgtgggacaccgacatgtggggcccacatgtcgggcccttctcctacctccggccggccggccatgccaagcccgagccgccgccttgcgccctcaaatccgccccaatccagccgccccgagtccgattgttaggggggtttttatcctctcatcctcctctatctttacccccaaaaatcgaagcaaatcgttgagtatcttgcccgaatcgaactcgttttcgagtttatctccaaaaccgagttttgtttttctcggatcgatttcttgcgggaggagtccgatctcttcaatccaaggctttatataggaccccctagtccttctctttcgtttgccccctctcccgtgctttcccgtgccttgtagcgccgccgccacaccacccaacccgccgccgccgccggccatcctccggccacgccgcaccgccgcgtccgccgtcgttgccgcctctcgttgccgccgttaggtgcgcacgggagcgaggaagctcggccgccccctctccgccgtcgccggccgtcgtagcgccatcaccgccgttcaaccgagccgccgccgtctcttgcgttgtcgccggccgccgtccctcgttgttggacgcattggtgagtaccatcgggttcgcgccgacgtcctctacgcgtaggtgtcctccaaaatcccggccgaccaccctagctccggcgaggttgccatccgagccggccaccattgatgacgtcatcatgacatcatcatcttatccttttcgttttttctaatagattaaatcttcagaaaatcgtaactaaataaccgtagatccgtttcaggtggttcaagttgctaaatttttctaaaatcaagatctacatgttaaaaatattcacatgtactgtttatgcttgtttttgtactgttttgttgattttttgtttaattgctttagtttccgacgttccggaggagtgcgtttccgttgaggaaggttccgaagagtttgcggaagcccaagacaagtcacacagatcccaaacaaccctttgagcatgttgaacccgtttaaagctattatttaatttcaactatgcattattttcgaatgtcatcgggtggtgaacctttcccaattaattaatggccgaagatgatcttattttcctatgggttataatttgattagcatgaaccttatatgttggattggttcagctaaatgctatatgtaagtttgcttagccatgtttagaaacattagctaactaaagggattaattataaattatgttactttattgttttaattatggttacattaaatggtagctcacgatggttaatcgtgtgatgttaattgattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgagaagcggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtacccgcggttatgggtgagttgagcaatgtttttcgtgattagtttcacactactcatcaatgttaataatgtgataattaatttgactcctggtttggaatggataattcctggtttggaggtttgatctgtacgaccggggttggttgttcaggtttggttgggcctgagtggcatgggtgtgctgttcagtgttgattaatattgatgattaattactctattattttactactcttaaatctttgctaaatgctgtttttgcaaatgagcctatattatgccatcccttggtatccttgtgcacttgcatacttgctgtgtggcttgttgagtatgtcatatgctcattcttgcaatatttaatcatcagaagaggagtatttcagcgaaggtgatgatctgaaggattgagcttgttctggttaagatgcctgtggagtggagtcgccatagctgttccgtagtttgttatagttttatttttttttccgctgcgtagaaggttattctttgagaggaactatctacctctgtaataatttgtttgcgaatattaaatagttatttatttgtactctattatgtaacatacccgaaattttaggacttaaaatttcttgtcaaaatagttagaggttaacttctccaattttgagagccaaaatttccgttttaatttaggtgatgaccaacttaaaccattgcatgattaaaatttgagaacaaaataaaatcttttcattcccaacattagactagaaatgtcaccaagcatacatgtacataatgcatgcctaggctcgagttctttgtgcatttggagttttggtcttgcattccataatagatcccatgagcataatctaaaagaattacttcactaaacaaacctatagttaatcttgagtgataacatgtggacttaatattaaactcaaatatcatcttctcagtctaaaacaagtttaatgtaatccctataataatattagatgcaattatgaagtgggaacacatatacaaacaaaggtcaacttaattctctaaaatattttgtgcaagataaaatcatggaaaaatttatgtggacaatgattagcacaaacttatcctctgtaatttggtaacatgttaacactcaagttgatatctcaaattaatcggttgaagcagacaactaaaagaaatcaaattaaatttaattggctaaaaccatatttcatccaaaagtacattgaactgcacataagtgaacatgggaaatgatttattcaaacactagattagttatcatgaataaatgtaatttttctagaattttcctcctctgtttaagcctcctaaaaattcaatctagctttctaatagcccatctttgtttaatttctgtgagcagtctacccattatttttgagtgcaaccaaagaaaatggaatctaggtgtaatcatttacctccagtaaattcaacactagataatttggtccacacattaagttatgaagctacaaagttagaggagaaaataattccgaaaattaatctaaaaatcaagtttaccagtcttctacccatatctctctccctggcctagtttccatcgagttggccccacttgtcagtgccttaggctaggttcagccctgtccaacacttcctccttctacacctctctcttgcctagtgggaccccattgtcagcctcacatccctctccacacgggcccacgactcagaccccgcgcgccacgcgtgtgagcacgcgttgagcgcggaagagggcgagctcctcctccccatctccgccggcgaccgtacttaacccgaccggccgaccaactctcactctctctcgcccctgtctcgtttcgcggaagaaccgaggtaccccgcctcggattcgccgggaacgggggtgccaactccggcgccggtgagagaagtcctcgacgccgtcgcaatccggtgagctccatttccgttcaataagcattctgtaattccctctcaatgccgtctctaacgccaccaagaacgcctcttttagtgcagccaatctccgggaacgcgaccgcgtcaactcggaacaccgtcgcgctctggccgccgacgccattcctttctttctccttctctggtgagcttcggcgcaatctttttcgcctagagctaccttgtgctgatctaaaccgaagcatgcaccctctatatgcagtagaagcccgggagtacaccgtcgacgacgaccgtagcagttgcgccgtcgccgaaccagtacaccgtcgctaagacttcgccgagccgcgtttgattcttggtgagcctcctagtagtccctagagtccttatcatacgcatgcacgattaaatcgagcctcaaaacccacgtgcatgtgcaagccgagcttagccaccgcctctaacaccctaacagccgctatagagcaccaaatcttgccagaaagccaccaataggttcgcacggttgttctctacactttttgttttgggagcttaagctgaatcgccgttgttcgccactggtgatgctgtgaagctcgcggctgtgctgctgctctgctctgtccagagcaagggcatggcttttgaaatttaaagactcccagggatgtattaacaactggaacagtcacttacaagtaggaccagtaataatctgtaaataaactaaaactcaagcatcgttttgcatacaaacctaaaactaggggactgcgggatctatttcccgagaaaccaggggtttttgcgaaaaatgttagtaactgacatatgggcctaggactgcgggttgattcctagaaacctcaagggcctttgtgcatattggtccctcacagccatgtggacccatcctttaaaatctgaagaaaaattaggaaaatgcccaaacaattatatgtttagcagaaaaatgcacaaagttgtaaaatctatataaaatcaaatatagctcattttgaagtgattccagttgctgtagattcttgaagttatgaaatttattccaggaatataaaacttgacacttactgtacaaataatgtctctaagatttatctaagataagtcatacataaaacatgtacaaacttataaaatgcatagaaaattcatttcaactcattttgaaacaaaatcaaattctacagattcatcatcatacagtctctgattaggtgaaataaaagtaattacttactttgcatcaaatgcctctaaaactataatctctataatgattaattttagataagctaaactttagaaattgatgtagaacccaatttagcttcaatttgagtaaacttaagttctgtaggatcattaaaacatgtatttccaagttatgaaataatattatatacttactgtgtagtaaaagtctctaaatattcatataaggatttactaacatagagcagccattaatttgtaaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaaattagaagaacttagctcatataacaatttctaggttaatataatatattgctagtttagattagagcatctctagtttataaaatatgaaccatactagtaaagatcataaacatgtgaactaaaaatgttttagttaaccaaattattccttttattcaacttaaacaggaagtagcatgttctgaacctatcactcaaaagtcatgaacatataaaacactatatgcctaaaacatgttgtaacttgtaaaatctataagaaaatcattataactccaaaaattgtgaaaccaaatgtgttagtcttagaaaacacaacttcacactcctatgaagtctaatctagtaaaaatcactttacaaaagtatttcataacactacctaagactatactactataaaccgataaaacttctaaaattcataactcccaaatggaataaaataaaataggaattatttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacttatttgctgcatattccaccttgaataattgatcctcttgctgtttgaacccctagaaatggttagagtacactctttgtgctcaaatgggtttatatatgctctatgtgcaactacttgctcagccatgcttagaaatatgcaaatgctcattccatctataattaaaatgtgaatttttatacatgaacccttgctggaataaaatgaatatgatgggtatttacgaactaaaatgtgtaaaatgtgattttatacttgggcggcaagtggtgtgcatatggtattagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagagctttggtgatgtgtcatgagtatagactatgttttaaaaatgtgatcttgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcaactcttttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccctttgtttgcaggtttagtcttagtctttgagtgatgcgggttccgattgcttcttctaggatgagaacttaatggggtaaacccctagtcggtgtgcttgtgattgggtagtcaagcttccgctgttctctattaagtctatttggccggtcggcctatgtaattattaagttgttgtaagtcttaagttctttcatcttagttgtgtttgctatgtataatcatgcttaagatgaaagtgtggatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacatattatcaatttgttattgtgtgcctcggttgattcctggacgagggtttaacacacatgtaagcgcttggaattttggatagaaattccgggcgtgacagtaggcaagaggagttaactgctccttgggccaaccattatgcacgcatgcacatagtcaccagctatcaacctatcacctggccctactgacgcatatgtaaaagacgcgcatgggtctatatactttcatgagagagctgatgggggtgagatggtaacggttcgggcacattaagtttgtcccgtgaccgtcgcaccaccacatgatgccgttaggtagtttttgtgatggataatagatatagatgggctaaatcggtttttttttccgtagaaaagaaatatactccatatttgggccggttgaaatttgggaatgcaaagtaacggatgaagactccaacatttcaaacggacatacttgatcatttttatataaaactacttacgtattttatattgggatcatgagatttttttaaggactgttttctcaaggaagagtggttttctatgatgtttttttatgagagggagcggtttttgacgaaaaaaggaaaatgattgtcttttaaagtagttaagaaatacactggcttctttaaaaatatatagttcaagataaatataattatttaacccttttttagagaaacatcaataacctgctggaaacaccaacccgatcaatgcacatcaacgaccaaagatacatacctagaatttggtagaggataccggcgtactggtcgattccaaaggagcagccattgacagacaatgatctcctccctgcactaggcatgtcaatcatttatagccttgctggttgtgatcaaaataactgcgtggaaatagacagagtaactgacctgatccccaaaatcattggattcacaagcttcaaaagtgcaatggtaaattccgaagcacaacagaaggttctgttaatgtcatcgttgaaggtgctgcagaggctcacaagcattgaaggggaaattggcataacactgaggtacaagatatcaaaacattccttcttattgagaaaccttgcagagatcttgggagatagcagcagcaatcaaagaactaaggaggatccttttacaatgggtcctcctgttggattacggtcgtctacggtccccagtccgatgcggacaaggtgctattccttcaggagctgtgcgatatcagaagtatgcgtaatgggccatgggtagttgttggcgattttaatctaatctaccaagatagggacaaaaacaacgccaacctcaaccatcggatgatgagtcgtttccgtcggactatcaacgatctagctctccacaagctccacctgaatggacgtgcttttacctggtcgaatgggtgggagaacccaaccctggagtgacttgaagccgactgggaaaaactcttccctcaatgcttcctcaaggctctgccttccttgatctcggatcattgccctctactcctttcaaccttgccggcccatccgtcgaaggggagatttcacttcgaaaatttttggtgcaaattgaatggattctctgatgtggtgcagcaatcttggtcggaatcgtgtaccatcatcgatcccatttccaggcttgactccaagctcaagtcggttggttgtgccctaaaaagctggagtgatcggaaggtggggaatgttaagctacagctagaaatgattagagaactcattgggaaacttgatcgagcggaggaagtgcgcggtctctcggcacaagaaagattcctgcaccgaggactaaagaagaggtatttggcgtactcttccttagaacggacaatggctaggcacagatcgtgcatcacttggttgcaagaaggagatgcgaacacgaagttctttcatcagcaagcagcttggcgtcgtcggtgaaactttgttcagcaattggaattcgactcagaggtcgcaactgccccggaagagaaggcgtaacttgcacagtccttcttctccgaagttcttagctcagtcagtccgcgtgagttctcgctcgaattgagcttccttgagcagccggggcagccgttatccgatttggaggaccctttcactgacgaaaaggtgtggcaagcggtcaaggaaattccttgcgacaaagcgccgggaccagacgggttcaccgggcagttctaccattgctgctgggacatcatcaaagtggatgttctagctgctctccaacagctccatcgtatggatggttcgagtttggagaaggtgaacaaggcattcattatgctactgccaaagcgcccagatgccaggaacttgcgggattttcgcccaattagcttggttcacagcttcgttaagcttttcacgaagatcctctcacgccacctagctcccaagctagattctcaggttgccaataatcaaagtgcgttcatcaagaagagatgtattcaggacaacttcatgctagtgcggcagtcggcgaagcggttgcatgagcggaagcaatcctccttgcttttgaagctcgacattgcgcaggcattcgattccacctcctggcaattcattttagaggttctggagcacaaagggttcggtagccgttggtgtgcttggattgccatgcttttcctaatagcaagtacgcgggtcctgatcaatggcataccggggaaccctatcttgcaccggcgaggggtgtgccaaggggatccaatctctcccatgctgttcatcctcgctatggactcattaagctctcttttctctaaagcagagaatgaagggctgttacagccgctgcacctgccctaccgaacttccctctacgcggacgacacggtcgttttcattcggtcggatcctgaggaaatcagcacagcaaaggaaattctacacatctttggggaagccacagggcttgggatgaatttcgctaagtgtgcagctctcccaattcagtgcaacgacaacaacattgcactgatccaggacgaactaccatgtcaggtcgcaacattcccttgcacttatttagggctgcccgtttccatcttccgtcttcgcaaagaagacctgtagccgtttgtggacaagatagcccgtcggttgccggtatggaaggcagagcagatggcgctcattggtcgggtcactatggtaaatgcggtattgagctctataccgatctatttgctgatggccatcaatgtgccaaagtgggtgataaagggaatcgataaggtccgtcgcggcttcctctaggccgggaaagcaagtgctagcggtggaagttgccgggtcgcttgggcacgtgtttgcgcacccaaatcgtatggtggattgggtgtccctgatcttgagcgcatgggacttgcgctctggtgccgctgggcttggcaactgaggacatcgccagaaaagccatggcatggactcaatgttccgatctcgcaaaaggagaggaacctactccaagtctctttgacatgtcgagtcggcaatggaatgaacgtgctcttctgggaagacaactagatccaggggtcgtcgatccgcacccttgcgccggctgtgcatgccgcggttgcagcaagaacccggaatcgcaggacggttcgcaaagcactccaaggtagaacatggatccgggatatatctggggctttcgaaatccaagcaatcctagagtacctcagcttgtggacatctttgcaatccttggatgccctcacggaagagccagattcaatcatctggagatgggagtcatcaggagaatactcagctcactcagcttatcagtccatgtttgtggggagggtccaattccaggacaagcctatctgggggtcgttagcaccgccccgatgctgctatttcctgtggttagtggcactaaacagatgttggacggccgatcgtttgcggagacagggtttaccacatcctgatcggtgcgtcctatgcgatcaagatgacgagacgattgatcatctcctagtcgcatgcccggagtcacgtcaactgtgctggttcgcactccgagcaattggtttgtcggacatactgccattcaatgaaccctccttcctctcatggctttgtgacaagagaatgaaggttgccaaagctcagcgacgaggattcgacaccgttgcagccttgatagcttggactatctggaaggagtggaacaacagggtcttcaaccaacagcaaaagacctgggtcgaagtggcaaagtgatggcggctgaggccgtgctttggcgcttagcgaacgcggcaatgctggagttacctctactgaccacggagtggcggtcgcaaaattttgtacgagattaggccttacattttgttgtccatccggtaccctatccccttctttattttcattttcaaatctctgtaaataaactttatttctcttaatacaaagatgcgcttcttgcgtattcccaaaaagaactaaggaggctcgtggcagaaatcctcagaaaccttgcaattgacagagacacaaggcaggagattggacaaatgaaaatgctcattaccaggctgatgaaggcattcctcgattctcatggatcattttagttcagatgttgattgcttgctgccaaaggtcgacgggcaagcactggtaatgctgtcatcagaaaacccgcataactgcttcattatgattctaatccat

SEQ ID NO: 63669 - DNA, 21982 bp, Oryza sativa
aggtgcggtgtccattgaccaaataccatatttatggagtgttttcctctaaaaatgagttcaggcggtatcccacggctaactccacgaagtcgaagcgtcctgtagcaaaatttacctcgaagtacacacttattatcactaaaaatgcacctggctaccttgcagatcatgcacttttctggtcagtcttttctaaggttgttcggtacaaacatatatatttagtgaatttattttgttgccacagtttatagggataattgaaactattgtttagatgctgtgttgggtactccaagttctcaacactcacctctccttttccacgcgcacgctttttaaactgctaaacagtgtgatttttgcaaaaaaaatttatatacaaaaattgctttaaaaaatcatattatcattttctttaaaaaaatagctaataattaattaatcacgcgctaattgatcacttcgtttttcgtgcgcactgtttgaagttaggaactgcatctgaacacagcctaaacaattctttcaccatctgatcgatgtcatctcgatccgagcatcaccccacagcaacagccactttcatttttttaaagttctattaaaacactatataaataatattatttatctcttcttcaccggtagtaatataccggtaatagatattatcaccagattttaattcttcgccactctcacagagcttgctaccggataggaaaagagcatttaatgcttcttaccggcagctaaaaagtaacattgttgatgcccttactgatcgatgccaatctcgatcctacacagtttccgaacatcgcggctggatacgtatacaaaagaagtaacgtaaacaagtatctctctgtttctttttgtttgatgccggttagttcaaaattacactaatcaatactatttatttgaaaacagaggtagtaataaacatggtgaatatttgtttctcattgtttatttgtttctcattattccatatcgatcgagcttacacacatatttaatggactaaccatattgttgatcctaatcggtgcctccattatttattcccgcgtgcatgcatttgccgtcgttgacacatcacggcttggccgatgttgcggccgacgatgatcgtttgcagatacgtaaaactcggcagatctttgttacgctcgacggcgggacgctaggcttttcctccgtgacatctgcgtggcctgtcgattgctccatcacgcatgcgaatggaaacagttaattaatgtacgtaggagtatgtgttacttcaaaaaaaaatccaatatatataaaaaaatatatactaaaccagaaaacgttcaaagtaattcctcctcgataaatttaaatctgaggcaattattatattttaaatagagaaagtatgtagacatagctagctatacttaattaaggctttgtttcgcaatgaaggtcttgggcacatgcaaaaatggagggactcgtaaccatatgattaattaagtattagcttatcaaaattagaagaaaaaattaatattttttaaaaatagtttttttatatacataactttttaaaaaaattatcgtttaatagttcgagaaacatgcaagtagaaataagagagtagaggttaaaaaggggagggccaaacacacgctagaagaaagaaccgcaactccaaatgttcaaagagatgtagtggttagtttctccacatgatatttcacaaaacatatacagatggaactggtaattaacactgatgttattcttaccggcggcagtgttcgtgggcatcggaaccaactggcgggcgaatgccgaaggcagcagagcttgctgctggctactcaggaccagcaggattgcaaggctaaacagcaagtacttggcagaaggagaacccatatttgcttgtgtagtcaattagtgcgcgcgcagtagctacgagtataactaatttgcaattgcaagatagcaagagatatgctgaatgttttgatgcagttgcagtcgatcatcgagccaattatagtcaggcaggcctacgcctctttgtattactcaggcggcgtttttagtgataaggatgaagtcaagtcgtcgtcgactgggtgtgtgcttccgagaagcaacgtcggtaaagcaggaagtacaagccagcaggctaaaaaacaatttctgctatatcatcacgttcctagagagaatctataattgaggagagagagagcacaacagatatatatcctttcgattaaaaaaattgtaggaatatgagtccagataattatttgtttgtccaaattgatctttgcaaattagtttttttttaaacggaggatgagatatttgtttctagttttttgaattgttggtagtagggtggacacactttttattactgtcagtcaatttttagattttttttctgaaaaataaagaggaatctattcccaacccaaaatccgattagcaatcttgaggttgtaattttgatgatggattatgttgaacggtcccacatttgttgttgaaggataaaaaaacaatgtataagagagaaagcccttaccttattggttagcttttaaggtagaaaagatattttaagattttacaattggcattaggtcttatctagtttaacatctttgtcctaagggacatagtgaagttctaatagaccataggtgctgcggtaccaatataccttagatacttgtcataagtgacatccgttggaataacgctattagccctttagaagaagatgctttggaagtgctttttattttcaacgagaaaggtagcccgcgcattcgcgtgggcatgtattatagtttgtgtttcaaactctataacgacggaatataagttgtagaacatttccggaatataaatcagaaaagaattttgcatagatgcacaggcatcttatttgttattaaaaaaagaatgctaaaaggaatcatacatcactatatatataatcactatatatatagtgtaagagaatttagatcatcctacaataaaaaaaggaatatatttaccataaaatagatggtagattttaatatactactaatgtgataagaatgtctcttagatttaaataaaaatccctttatcctggtcgtatataaactggttgtttgtcatcactacttactataattgttttaagagttagatgacttttaataaatgaatctgtattagcaccacttaaacaaatgatacattattaatacactaaaaaattcatctacacaacataacccggtgttcatcacttttttcaatcatatgtacaattagtataaatatatcatatctaccgaataatatgataacaccattaaaaataaacatgaatgcctctctaatggatgaagtatgtaatggcttaaaacatataggtcccgcatttcgatgtagccatgcccctaaaaaccatcatacaatacaatttcaacacttagtacactattggtacacttacaaatgattatattgataactatgtcactttagttacattgcctatgatggtctttcacagacaccaccttaactcaaccatgtagatgcccatacaatatatatgacagcgtagcaagtactgcaccctgcattaaatgtcaaagagggatagaaagaaggaggaggtgatgaaaacaatttttttcaaaaaaatttgagtcgatttttggtagagaatagacaaaatgtgtatatgaagttagtaataagtacttatcaaattttaatggaatacatacaatatcatatttttcaaatgagtggggttaatcattcgacactacttaaaaaaatatagctaaagagatgtactaccacgaaaatctgtaaaacaccgtatcattatttatattttgataaagatttatactttagcgccaaatttgtttccaccatatgttatttataattatatgagactcatttaataattctaagaatgtacttattttcacaaacttatttacactaaccaattcgctagagtgcatttatagttgggttctgtggtgtataacattcgtcaattatatacccagtatattagaatttctatcaactacaaaaaatataatataagtagttttatgcgtattttattggattattcatgttttgccaatactacttggcaaagataatacatacttctcgtgatgaattaagagttgtattctagcaaaataactgtctaaaatcttatttatttttttttcacatctatctatcatgtatgcttctcactcctcaaataacaatcaaaaagttttgaaaaatttcagatacctttagaatctcaatatcacccaaaataaacctaaaaagatccacttaaaaaccaaagctaaattctattgttttattatcactggctaaaatttaatttatgttttctcatcaatctattaattgtgcttctcatacctcaaataagaaaagttttgaaaaattcctaatactttgagaatctcaatctcttccaaaattaaataaacctaaatagatgtactcaaaaaacaatgctataggttttgttattttaattttttacatatgtagattcaaattaacgttgtatatttgtcacgtgatatttgacaccataaaatacgatatgaaattatttggaacattattatcgcattaactattacatgttggcgtcatttgtcatgatatatttatcactacaataagtttacgattaagtttagctgtgcatatttgtgtagtattatttataataaaatcgtagattaaaggatgttgacaacaaatcagtgctgacgctgatgatttttcatgattagaatttctttccgatactactatgtacgtgtgcatgttttctttttatttttttggctttatcttttttcgatcatatatggtgtaggtatttaagttttttttccccgagtaggagacgatcgtacgacgtaagcaagttatgtttttttccgggatagagattagcagcacggaaattttaagagctctaatccaatgtttaaaatagtgggtccactaatttaagtgaaaattaaaggttggatggttttctttttctactctaaatttttaggatttctctaattttattagagcatcacgtgacaatgttggagtgtttaatagacttttagtgtataatagatttttagtgtttctctaatttatttgagagaaagtttaatgtactttttttatataatagatagatttagaagatggtttaaaagaacattgataggatatttattatagatcttaatttaactaaatatatttatatgtgtgaagtaatatattttatctttatatagtagaaaatcatattttaaatactgttgatttttatgaatgtatgttttttctgtcatttttatgtacatgtatatgttttttttccagcgaagattaggaaagttttgttttcaatcatgtacaacgtttgtacgtatggaaagaaagcagtggcatttgtaacgtataaactcaaactcatacattcatgaggatattattttttaataatagatctaatctaatagtgtaaaataacaggtctatcaatttaagtgaaaatgaacggtgagattagatagtaccatgtggcgacttaggagcgtttgtaggagtgccacgtggcggcttaagagcgtttgtaggaagtttaatggacttttagtatataatagaagattggtactctttactaccatgcgtgcaattaatcagcttaaaaaatatcatgtactcatgcattggaacccacggtgtaaaagaccaagttaaagggaatgtgtgaatcatccatgtgccagaaagtcaatagtgttaattcttcagacttagactcaaatatttcgaaagtgaaacaatataaaaccacaagtttaatgatgcagcatttgcaatattcagttttcatcaacagtacaggtgtgcaacttatggtcgccatcagtctgtagatagtttgcaatccaggtttgggttacaacttggtagacttgcaaaaatgaaattggcggctcaccggttcgttaaaaaaaatgtttcttccatctcttgattcaaaaactcgaactaaatagtttttttttcttaagatgatggattaactcctcctattgaacatcgatttctttccacggcataaaatttctcacaataagatggactcaagatttacgtgtgctatcttttcccaatcccactcattcccagttgaatcggtagagccgaccattgtttcccttttactacaggtcttccacctatctaaactttctagtatacaaagctttccagtatacaaagagatgagaatggacagtgcaagtgagtgcttggtagagaaaataaattccagtagctgaactactggttctatacgaataatggaagaagacaattaattagacaaacgggatgtacctaattaatcataagatcaacgaggtcagtcacagaatcactgcacatccatcctcatcctttctatttgcgtcactctggatgcttcccattccaaatagtattacggcacaatgagatcagaattgaagcattccaaaaagaatttagcttcttcgatttatatgcacatcagcacatcaaggccagattttgaatgcttcaatgttttcgatttcctactgtgtgtttccgactaggctaaacacagtaggtgcattatccgacaacaatgcatttatttcctaccatttgataagtgcactgtatagttccaaatattggtttctacaatttttcccaacttgatatctaatctccaactaattaaactaatttctattgtccaccaatgtgctaaagccggtgctgacatcaatagagtagctattccgtccgccccatatacaagttaatatagtacgagatgtggcatatcctaaccagtactataaatctggccaattagattaacttattatgggatgaaggtagtagctgctagcaccatctaaaagcactacacattggctccatttgaacctgattaagatacagattttacctcgatttctgttagcatgttttttaaattgctaaacggcttttttcatgcgaaagttttataggtaaatgttgctttaaaataccaaataaattcatttttcaagtttaaaacaactaaaacttaattaatcatgatataataactctcattttacatgtatgtacttaatctgcatcttgggctagcttatctggggaattcggtaaggcatgcacagtggagaaaagaaactaccccagctacaaaagttaaatcaaacaataatgctatgcagcacctgtgggcgatgatgattctgaagcctactatttatccatgaacagtatcacggctgccatgttttcttcttttctggtgccacccactcctaaacagcacaaggaagaattaatattggcataacacttgctgtataaaactttgtccaccatatttcacagtggtacatttcactttatgccctgtgggcctctgtttggagctcaatattctgggttagtcgtagtagtaggaagacagaagctaagctgctagctgctaggatgaagcttggattacgatttgatttatgcaattgttgtcaatctgtcagtataaatggaggacaagcttaagcacactgtactagatgacacctcacaggtttctagctaggggaagttataatgtaaaataagcaagattgaacaaatgactctgtatggtaggcacgaatatataaacgcagaacatgcgaccagattgatcgggttaattagctcttcttgatggtgtggcctcgtgcatgggatgagctgataggtagtatatgttagggtttaggtggtagaaaaataaaaaatagttatccaaagaatagaaacaataaataggaagctaaatggccacatcatgccacaggcaaaaagatgaatgaaataaaattgtgcacaatcatcttactacagtttaaactcatgaatgaaataaaattgtgcacaatcatcttactaaaattgtgcacatcatgccttatttattctagttgtctacccatccatttcacaggttattatttattacaaatactataaatgttgttagaactacttctaatattccaagcgtcaaacatgcatcagcctaggcccaccccaccccacgtcccgtcatcccacttctactgttgtcggagtaaacgatttactcctatcgcgcgcctcaaccacccacatttattcgagtaaacgatttaattcaataataaaaacaactcccctgcttccgattccaccccacgtcccgcatcgtgctcctaccattatcggagtcaatgatttacttcgataaaaacaacttctctgcttccggtatatattctattttttctgtacccaaccaaccactctcgcgcccactttattttttttcctttttttcagaacccactttattttttttcctttttttcggatctgaattgatccaccatcccagcccacagatcggcgatacaccatggaggaggacgacgacaccgtggcggttgatggcggtgaccggcgagcggtggccggcggtagttgaggcgaaggcactgcttcgggcctcgctgccggacgctaggcaacaccttaacgagcatggagatgttcacctgggcctatagcaacaaccagtggctgctccatgtcggcgactttgatagaacaagcaagtaaggaaatgacactctgatttatatttgcatactctccttcaacttcacacatgaagccctaattttttttgcaaatcaaattaacgtgcaatctctaatattacctgatctcaattgatgggctgcacaggccttacatttgcacatcgtgctccatggggctggccgcagaggatagggtggaatccgccagtgacagaggttgtttgctatttttcttttgctcgtcgtctctattgacatgaacaaaaatggttttttatttttttcgtacttgctagatgatggatggctgctactgcccaacgtcgagctcatctctataccacaccgctacatccttccatgattccatcatcgactactgctcgccacccggttgccctctccactaccagtcacaagacacagaccatgctcttcatccttatagcaagatccagcaaagccaccagatgaatttttggctgaatcattttttttcttttctagtttgattcatatgtgagtaattttatcgcttgtgtgtgattgagcatgtaaattttttcattcatacgactattttgggatacagattaacaatactcttagtatcagtctacacggtggctacgagatcatggttgtatcgagaggaaggtggtaattgttttactcgcagaccacgaaatctcagtctcttatactgtgtattgaacacatcagtaaacatattactacacggtggctacgagatcatgggctatattgagaggaaggtagtaattattttactcatagaccacgaaatttaaacaatatttataatattggttaaagaattactagcattgtaagctggtaatatttcttttatgaccatctaggtattgcgttatacgatgtggaggcattaatgagagtaaatttgttacttttggatgagtaaatgtgggaggctgggagtaaatgaaaaactccacggagtaaattcgttacttttgaaacgtgcggagatataaaaaaaggaaaaatcggaaagaaaaattagatggtaaatattttacaaaaacgtgaaaatagaaaaactatagagaaggaatgaaaaacaaaaaaatctggatggttaatattttaccaggcccattgatgaagcatggatgagatggaaaagtgaaaaaacatagaaggtggggtggtaaaaaacaaaaaagacgaaccgagaaaatgtgggatgcggaggaaaggtggagtggtaaaaaagggaaaaatcggaaggacagggtattctgcggcgctcgaactaatattccgcactgtagcgcgtggaatagtgctaccattaatgttgtaatattatgttaaacatattggttatctttcgtgtgattatattaaaagaggagtccatataagttacaactttgctaattattaatttagaatagtagaactgaattaatagagcgcaaaattgagagtctaagatgggtgtaaaatatattactaccttcgtctcaaaatataacaacttttagttcgatgtcacatatcctagtactacgaatctggacaggtcactaggatatatcacatccaccaaaaaattgctacagttttggacggagggagtaatattgattacttgtggatttcaaaattataaatttagagcccacactattataatgcatgatttattttacacagactcgcaaccccatgcatggctcaagctaatattgttgatattaaaaatattaagattgctttcatatcttatatgtcttggtttctttcattattctggctttgctgaaaagaagaatccattccattttcaattttcttgttattatttccgaatttaggatatattaaaattttaggtatgtctataactaaatagtccatggtagtaaaatttgaagagtccatgatattataattaatcaataacacactacatttaacacgaatcctctcttattataaagttataacccactaactcctaaagtttaatatgcaaagatgccacatcattgtccactaacaatatgccacatcctcatccactaacaatcattaaatttaaacatcatacaaacatattatattatctataaatttataatttgttaaattttagagcttttaaaatataaacatgttaaatcatcatcccgtataattcacataatatttcaatatatatcttcattatttttacaatatgctatgtagctatatagtttatcctcacttagttaatgttatttctctcttctctcattgagtcatatcacatcaattgtttttagtgcttaaatgattaatctatggtctaaattatcacctcaattatttttagcctttagaagattaatctacggtccaaactatctcaatatttttcttctttcataaagtcatatcaccttacttttacatttgaatcattattgtatatactatttaaatttaaattatcataaaccacgttaacttatataatattatattgtctagttatcttacacgttatttttacttattattatcgtactagactcccgcagcaacgcacggggtttcacttagtatttagtacggcattgataaccaactaacaaacagtcgcaacttcttgattggtattgcttagattttaataaaataacacattgactttcgagcatgtaaagtaaaacttcatatttgttgttttgaagaataaatataaaattataaatttaaccatatgcatggatgaataagttggcattgtcatccttgaagaactaattaagaaagtatattttttaattgtaaattactttttggtgttttacaatcttgaaatatcattggcgttttattttagtaaagaaggaatagtgagttaattaaaactgcaatgtaattatttatatatttgtacaaacaatactaacttaaaactataactatgttactcttctaaatctattcatgaccatggattattatgctgtggttatttctggtagttgtatcgatcgtgaaatcagcgaatacatattggatgccaggacaatatgcttatatttgttggcatcttctcagcacatttagtacatgtcctcatcgagggttcgcatcccctgcctttgggcataacggcaagtttggatttcgctggtccatacatacacctcaaaaatcacttttttctcgaacggaagacctcttagacatcatggttgtggcccactgtagctcaattttgttttatgtccatcatgaatacctgcatcttcaagatttattatccacaatacatatcattagggaatgtatgtgtgtattttaacaaatgtatcagttttttctcattggacatggaacaaatggaattaaatttaaaaatatactgttcatccaattttttgtcaggaatattcgggatgcaaaaacttgtggagaaatattgtaacatacccgaattttaggtcttaaaaatttcttgttaaaatagttagaaactaacttttctaattttgagagccaaaaattgctactttaacctaggtgaggtcaacttaacttgtacttaaataaaaatttgagaacaaattaaaacctttccattttcagcctagcacaaaaatgcaaaaaaaaaaagtgtacatgcatatgcatctagcattagtttgatttcagtcttttatgtgcatttggattttggtttgcatatcatgttaggttcatgaacatgaataaaaggacaacttcactagacaaacccatggtcattcttgtgacgtaattataaggacatgaaagtgaattcaaataataacaactcagttcaagtcaagtcctaatacaagtctttacaaacatttagatgcatttatataatgagaacacttatataaataaacgccttgctaattattgaaaataatttatgcaaggtaaaatcatgggaaaattcatgtagtctctactcaacacatacaattcactataattttattaaaattttaacacttagaatgatacctcgaataaatcagtcaaaccagttaaatgatagaccaattataatccttaatcggctaaaacctgcctcaccataatgtgcattaaactgcataaaagtgtatagggtaaataatttattaaaatactaggttatttatcatgaataaatagaatttttacagaatttatctactctgttcaaatctcctaaaaattcaaacaaagttctaccgagcccatattctccaattttctgagtgcaaaccacataaaatttttaagagaaacaaaataaaatggaaactaggtatcttcagctacctccagaaaaatccacatgaatttatcgtgcccacaaattaaactatagattaacaaagagagaagagagattcaaatcctgaaaatcatccaaaatggattaacacccaatctcctacccacctctctcactccagacttgttcccttcgccctggacccacttggcagcctccttggcttgcccttcctctgtctctcctctccaaccgaccaagaacacgagagagaagaggggacacgccctgggcgccggtcgacgcgtggccgagacgcgtggacgcccagttctgcatctctagctttctcctcctcccagttgcatcgccacacatcactcaccacccgtgagccaaagaaaccgagagggagagctccagctctcctcttccctctcctcttcgttgccggccgccaggaagaaggacgccgcaacccatcgtcgagacatcgccaacaccaaatatttcccgttccgtattctaatcttcatgccgaacaagtttccttttgacaccatctcatttcatccactgcagcgacgggaacgccatcgtgcccacgggagctccagagcgcgcccggagcgccgccgccacgacctcgtcgctgtcccggcttctgtggagcgaatccggtcgagccgtcgcgctaacatcttcccctcgaggtcctctccaaatgccctcaagaatccccaagatctgagcactgaggagagagatcgagctattcttctccaactccggccgccgagctccatctttgattcttctttctccggtgagctccaagtcgattccatgcatttcctaggacctctttaacaccagagacatacatgcatggcacttcttgtagtgagtcaagccgacgccgttcatcgagaaggagcgccgtcgccgagccgttccgaacgccgtcgtcgacgaccaagcttcgccaacctcatccaatactactgtgagcaccctggagcttctagagttgcatgcatgcattttatccacctagatccggcctctaacgtgacatgcatcactaccccgagacccaaagccactcgtgctgccgtcgccattgattccggtaaccacagatcacgataagaccaccattggcttcgaaaagaacccctattccttttatattttggtttcatgccgagatctgccaccgttcgccgccagaaagctcgagaacgagctcagccatggctagctctgtttcagctcgaaccagggacctctgtggagaagaaacaaaactgtagatactactttgtaaaaactaccacacacatggaacagtcataggactgcggattgatttcctgaaaagccagggaccttttgcatattggtctctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagaaggatgaaatttaatatggaaacataaaacttggcacttgcagtataaatttcacctctaaaatttgtctaagaaaaactatacataaagcatgcacaaatttacaaaatgtatagagaattcatttcaacttaaattgaagcaaactcaacttccacagattcatcaacttactctctaaggtaaaataaaataaaaagatgcacttgctttacaccaaatacctctaaatgtatgttatacaaaataactaattttagacaagctgaactttaaaaatttatataaaattcatcttacttcctttttgagtaaactcaagttctgtagaatcatcaagtttagcactttagatatataaaataaaaatatatacttacagtgcaataaaagcccctaaatatttatataaggaataaacaacttagagcacccttcaacttctaaaatttgtagagaattcatctttagtccaaatggaatgaaccaaatttctttagaactagcaagtaatgaactttaattaggtaaaataaaatgtggcaccttctatactaaatatgtcactaaactttaaatagataacttcagtgctagtcacatggtataggttaggcaatacatatgtataaatgtatatataaatgcactctagctctaagtaaccaaaataaaacttgatagaccagagaggtcatagttctatccccaaccaccaaaaacttagcacacttagctcatatatcaatttctagattggtatgttaagtaactaacatagaacactcccctagcgtataaaatgtgtagtagcgtaatataatctctaaaattgtgaactaagattatattggttaataaaattagtcattttatacatcacaaacaatatgaaacatgtactggacataaaactccaaaaccatgtacacatagaagctacctacctacaacacgttaaaacttgtaaaatacataagaaattcataataactctaaaagttatgaaaccaaatgtgttagtcttagaaaacacatctctacacccctgagaaatcaaacctaataaaaatcactttgcaaaaatatttcataacactacctaagtaaataccaccctgtaccgagtaaacttctaaaactcataactcacaaataaaaagagataaaatataaattctttcacctaaattcatcttagatcagtacctacccactgtgcacaaagcatgcattttagagcattttgaatttttacctattttggtgtttaattgcataacgtgtattttatatagataattgcgtaaatgatgaagaagtgaattaggtgctaacatttcccaggaacaaggcaagttttctcctcccaatctttgatcacattgaatcccatgttttgaggaatgaaaatatatttgtttgcaaagttgcatatgaatttagactataacggtatttgaaacttggttatggtagctatgacctaattgctgcatttacttctttgaataattgtgatcctcactgattgtaaccttagaaatggttacttagaaatggttagagtactttcaaagtgctcaattgggtttatacatgcttacataaaagccttacgcttagccatgcctagtagtttctaaataatttcatgatcacttttaaaatgagaatttaggggaaaattttcactgctggacagaggtgaatatctctgatatttgtgaattaaaaggtgtaaaagtgtgattttagacctgggcggcaagtggtatgcatatggtgttagttgcatacctataggggaagtgctcgccctagtcaattaaggaccgaactttgtgtcaccatctaagtataccgtgcaaccacatgtgctaggaatgggacggccttagcttattaagttgtttaatgtctaaccttgcattgggaggcagtagtagtatgaactagtcggaatgatggtttataggagctacctagtgcggttgtgcctaggcgtctaagcgtgtccaatataacggttaatataacggttaagtacctcgtggaggaatggatgtgttcgctgccatggcgctagggatggcgagggccccccgacctagcggcacttgggttgctcctcgtgtgaataaacacttgccgtgctcgtgcaaggttaggcattagacaatgtaaaggcttcgttatgacctttagaccacattcaacgtgaagaatgtggtagagtcttgcaaactcgaaacaaactatagtgttcatatcatgtgggtaaagctgtacaaactctgtagagttctttaaaactaatcgattagccatgctcacggtcatgagcgctttggtgatgtgtcatgagtatagccttgtgttgatgaaacttgggattgaaatggaaaaattgtgttgagttgtgtgagtgatgatgattataagagttgtgccattgaaggcaacaagagtatgcttatgatgatatgttgttatatatgatgatatattatgttaattatgatgaacttacaaatttgttaatttaattgaatcaactcctttacaaaatatttgtgaaccaaaacttgctttatgctgaaattaaactacatattgtcctttgaatatatgccttacatgtagtatgttaggattgatttttggcttgccagtacattaaggtactgactcttgctactggaataatcttttgcttgcaggttagacttagtcttcttgagtggtgcgggtttcgattgctttttctaggacttgaacttaatggggtaaacccttaatcggtgtgcttgtggttgggtagtcaagcttccgctgttctctgttatctatctatatttggtcggtcggcctatgtaactataaagtagttgtaaatttgaatcgctttcgtcttatttgtatttgctatgcataaccatgcttaagaagaaagtgtgaatctagtacatatcctaggaacaagattcatatgagtatgagttaaggatatttgaggtatcgtagatctttagcccatttgacaagtctcctgaatgtgtaacacatctgatcgtctccttcgtgtggtttgatgggcacatctcaggctgaagttgactggcaagctaaaggcccattaatgtctctaatatccttctctcgaggcgtcggatgttttattacgtttgtttgatggcttgaattattcactttatccctcaaatataatgagaggtccggagagcctacgacaaatataccgtcggtatcgcacagccattgcgcgaaaataacgtgggaaagacgtcgcgtcggtatcgcacagccattgtgcgaaaataacgtgggaaagacgtcgcagacggtatcgtgcggtctcgcacgccgcgctgtcgctcgtgttgttgatgagttgattttgacaaagaatgtgttgaaaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcgtgttaaacacatggaagaaattgttaaacaagataaggtgttttcttgcccaacttgtagaaaataaaaaggtcttttggatgcttgtaaaaattgtgctattcttacacagaaggtttcttatttgaaaagttctttgcaaagattttctgatggtaaaaagaacctcaacatgattctggatcaatctaaggttagcacacacaatcgtggtttaggttttgattcttatgcttatcatgctagacatcctcctattattttgggtgttgctaggaggtgaaattttgattggatctgagcctaagaacactgtgtttaaatttgctggcatcatgtcttctttaagtgcatcttcatcgaaatcaaatgttgtgaatgcaaaaccatcaatttcagaatcatctacttcacaaacttgtcgtgaaaagtacacttattctttttgtggaaaaaatggacatttggttgttttttgttttagacttgcccataaacagaaaaaggaaagagaaattgcttttgcaaaatgacattggcaaaaatcgggttttaattcgaggagcacagttagaccgacattgtccagtcggtcagaccgcaggtgaacgggcggtcagaccagttgccaggcccggtcagaccgcaggtacagcggcggtcagaccggccttggggcaatttttcgcatacttcaaatcggacttttgtgaaacgacaaggtaagttttcaggtaagtctggttctgattttattagtgcatatgtatctactggttctactggttgtgtgactcagtgttggattccaaaatttcttatttctaaccccaacacagaggcgtcgacatcttctcgtttgtaggtagtttggtggcatagtccccatgtgcgttcaatgttgagatgacgattgcttttcaaggtaacatcaatttacttttggattgacataatattgttctactttcttgattattagcttttcatgtgctagtgtttgagattgtagtttttgttgatactaatgaatgtatgtcaattttgagagtatttgtgatatctttggcaattggatgtctttttcaaaatctttgatttcttcttgatttttgttcggggagaattggaggttattttgagggggagttagtgctttttatgactttcttttggcatgatttaagggggagtttatacctcatggttttatcaagcaaaaatatgacaatgaaaaaattgataaaagagagctttgtttatacatatggtattttcttgtgcatgccagcaatactttgaaggtttatttgtctctagcatagcttgtatgtattctagtcttttcatgagatttaaattttgcttttaagagagatgatgcatgacacttaaattctatacttgaattaagcaaatatgcaatgttgatgtaaaagcatatggtttgatttctaaatgctatatatatatatgttttattgaattgttattcctcaaatagctttaattgctcattgtgaaaaagagaataaaatatgaaaaaatgaataccgaatccttggaaacagtcttgacgacaaagacgtattcgatgtgagtaaaataatgggtgccgaatccctggaaacagtcttgacgacagggacgtactcagaataaaaaaaagagaaaaatatgagaaaaaggctcaagaaaagaaaaagttaaaaattctctttgttatgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttcttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagttagtcaaaatttttgtaaggagtgctgttggtgcactttgtaaacacagagagaagtaataaagtcgtcatccactttaagagttcttcgatttgtgtttcaccaggtttcggtggtctaaccgacgactcatcggcggtcggaccggcggcaaggcggcggtcagaccggcggaagcgaggcggtcagaccggcgatagcagcaggcacggtaggcgatctcggcggttcgaccggagttcgatctcggtcagaccggcgtgttccaggcggttagaccggtgcaactacttcggtcagaccgcgatccatcgatttcgaaggtaacttttatttccgctaaaagtttttggtttttgggtatctcaaccattcaccccccctttggttggcttagttcttgtgattcaatcctacaagtggtatcagagccacgtttgctctttttgatctttgccgatcttgagtttttgccatggttacttctaataaatttacaactaagcctcatattttcgatggaacggat

SEQ ID NO: 63670 - DNA, 23480 bp, Oryza sativa
ctagaatgacttacattgtgaaacgaaggaagtattcatcaatgagcagcatgtcaagctatgtagaaatgtagactagaaaagatcatattttaaatctatgtagtaatgcaaaatacagaaaaaaaaaaggttttattatgccattacttgaagtctgaaatatccaacatacgtcatagttaatatcaaaaggggaaaaaaagatagaaacatcatacctttatctcatcaacaaatgctaagaagtttctttccatgtctcccaaaatcgagtcccactccactgaatttcagagcatgtcccagagaaaagctgccacagaatgaaacgagatcatcacaaggccatcaaaagcagcacgacctggctatgatcgaagacggaagggtcaagataatagctgcctacagcgcagctatccgttcctgcttgctccgcgtcggtacgccttcgccaccgaaccctcccgcggtgcagcagcggaggagccacggcggcgggatgatcgatccagtcggtgaggtgtggtcggggcattacagcaaacacctggtgggcgcggcgcaccggtgctatgcgaaatcgccaaccagagactagagcccgcctccttcgcatagcctggcgtggatggtggaggcgaggagctatgtgaagaacgcagaaggtgggcacggcgggcagagctgatcggcggcggcggcgccaccggcgccggcttattcatcaaccgaaaaaagaaaaaagaaaaataatcagttgcggggtccggctgcagcgtagcgtgcggtagaaagccaccattcgcattatctgtcattaaggggtgaatagtagatacgaacagtgaaaatataatacatgctacagtattttactatagctatagtagaattaccttaaaaaaagaattaaatagtgttcgatggttctatattggtctactgtaaattactgttgattaatcccgtgcatttatgctgcagttggaatgacaaaggataccatcccgacagccacaatactatataacattagctattttctaacattaatcaacagtaatctacattagaccaatacggaaccatcgaacaatattttcatacgtttctacagtaattctattgtagtataccttacattttactattcatcaataacattcaccctctaataaacattttactattcgtcaataacattcaccttctaatagcagagggtacataccatttagttttgagataaaatgtgagcatgatgagtgaaaagacaaaatctgtcaaaatctcaataaaattcaaacaaaacttggcaaccaaaatttaaacgattcttttgaatgttttaaccaagtgaagtagacgaaaattgttcatttttagttgaaattcatttggtttatggaaaactcgttgcttttcctataaatagaataaatgaagaataaatgttacagaattgagagaaatgctaaagaaattatgaaggaatcggaaataaaaaatgcagaataaattttacaaaattgagaagaatggtaagaaatgaggaataatcagttgataattagtgttaccatcctgtttttctctgattttttttaaggctaccttggtgatttacacattgcccctttgtgccctcggctcctcgtgctcgcgcgggttaccactcgtatgaggtgcgccggtcaatccgatttttaggccaagtgggatgtgcatgcgtgccggtccccgctgttggttggtactggtttcatcaataggctattttgtaaaaaaaaaaatctcgtgtttgcatgaaatatcatatacgtcctaggacagcctaccacgctgttatgtttcttccaaaaaaactcttcgtcttttagagaaatacaacaggaagaagaaaaaaatcttgcttataaggatagagctgtaatcattaaaattacaggggcattcttgaaaataaccacatctgaagttgcatctatccccctagtgggttttggtgattaatgacgaataaggttaagggactaatgagttttattgagatactcaggtgattagtcccaaggtaaacttaggtgagcaagagatgcttggagacctccccccccacaacaatcattcaagcggtattagaactcgaagggtgcataggatagtttaattttgcaatcgagtcttaggaaaaccatactattaggaggggttccaagtatggttctgggatataaaaagtactcttagtgagatcttagtatcgaaatatttttgggagctatttttggaaatagccctgccccggacagagaaggctggccgaaagttccggtctctggacccggaagttccggaccttcgagagtgaaattttcctaagtattgtccggaagtttcgggtgtcaggaagttccagactccttccagttcaaaaatgtgagtaacagctagatgacgtcacctagccgttatatatatatccagatctcacccagctcaccttttggccatttttacttcagttatttcatgccctaggtttctcttgaagttgcatttatccccctagtgggttttggtgattaatgatgaataaggttaagggactaatgtgtttattgagatatacaggtaattagtcccaaggtgatcttaggtgatcaagagatgcttggagacccctacaacattcattcatgcggatttgaagctcgaaagttaataggatagttttcatttttgaaattgagtcttaggaaaaaccgtactattaagaggggtttcaagtgtggttctgagatataaaaagtgctcttagtgggttcatagtgatagaatatttttgggagccatttttgcaaatgggtccagaccggacagagaaggctggccggaagttccggtccctggacctggaacttccggaccctgcattggatgaaatttgcctaagtgttggccggaagttccgagggtcaggaacttccggacttcctccagttcaaaaatgtgagtaacggctagatgacgtcacatagccgttatatatatctagatcgcacccagctcattttttggccattccacttcagttctttcatcccctaggttgttctagcctctcccaaggtccctttgcttcctccactcaaatctagagcctttcttgtgagattgtgagagtagatgagagtgtaggagtgatttggagaagctttgaaaactaggtgtggttgagcactttggatatcttgtgggctgtcacttggggcttattactcttggagatcttctcctatacggataggtgtcgcccgcgagcttccgaaatcttgtggatgtcccgggaaagtttgtgaaggttttcctcacccctgcaaggaaacgaggtaagtgattaaggattcttgtgctgagttttcagaggttctcctaggtagagcaacttgcggttgtggtcttttctagaaggatttgtgagttggatcttggtggttattcaaattctagaaaatgacctaggagtgttgagttgaaggccttggacttccttcccgttctttgtacaagtgaggcaaggggttaatcgagacccggctctttggagcacctcaatggagagtaggatcccaagatccgaacttcggggaaaaatcatctttgttccctctgtgatgattgtgcatgttactgtgattgtgcttttgttctgtcatcctgtagtttatttcgtgcaaattagctcaactccctgttagatcttcaggtttttctgttgcccggaactagttatctcgtgcaaattagctcaactccctgttagatcttcaggtttttctgttgcccggaagttccggtgctaagaacaccggaagttccagactgtctgagcagaccggaagttctggtgttctacaccaggaggttctaggcctgttgaattttaccactacgatttgtttgtgattttcaggaaagcctattcaccccccctctaggctacatctctgcgcgttcaacatctacccccaaaccctaccctgaccgtctcccatctcctccccaccacgacccacccagatctggatcgtctgcctttacgtggtgactgcatgagcgtgccttcagcacccatccaccatccaaacaatctgacggctcacatggggcacgccatagctgacataaccagccatcgaagcccacgaaaacctaacaagaggcagcaatgacatgcccacgcccatcgccgcctgcgctggggattggcccggagcttgttcgatggtatgtgctgccgtcagtcgagtgacctgaagcttttccagtggcacacgccaccattggccgctccgagagccgggctggacgtcgtgttcaatctccgccagcggatcttccattgaggacaagtttatagcggcggcagcgtagtagcagtcggaggcaagcatgacaaggtcttctcgttgtgattccgcagaaaacctgattgagggcctgtttagatcaatttgctgcggcaaatttttttgtaaaagatttggcattgcaattttacaactaggtgtttagatccattttacccaaacagtggtctaaaaaggaaaacttttgtcattttggagagtctaaacaggccctgaatgcatacgtaatgcgttacttgctacatggtcgaatcagaacgcaaagctttgcttgatgcttggtgtaactataatcgtgttatgctactaccaggattcctaattcgcgcgtacgcgccgcgggcgagcacttccggcccacacggcccgtacgcgcggtgctgccagcgctaatcgagattttttttcatagcgcacgtttaatgtaagtaactgtttaaggataatgataataattaatgaaagatttttttcttttttgagatttttttactaatagatagaaaatttttaagttacatttgaaaacttttgacttaagatttaaactttgaagtcaaattttgaaaactttcaactcatatttgaaaactttcaactccgatttaaaaacttacgactcaagatttgaaaacttttgactcagatttgaaaactttcgactcaggtttgaaactttcaactcaagatctaaaaactttcaactcaaattttaaaaattttcaactcaaaattgaaaacttttcatattaaaatcgaaaactttcaactcaaaattcaaaaactttttaactcatatttgaaaactttcaagttgatattttgaaaactttcaaatcgtattttcaaaattttcaagtcaatatttgaaaattttaactcaaaatttcaaaatcaattgtttttatttttttattgataaattactgtagcattttcgttaatcactagtcagacgttgttgttttctttcgagaaaaacgctaagcgctacttaaagcgaaggtccacgtgcacgcgacttaacgtcctcgcgcgtgcgcgcgagctagccaccccctgctactactcgatcttggtgcatccatatttttcaagtttcacagacagcaagcatgctgaattgtttccaattgctgcatccaatcctagcaggaagatcgtctgccttcacggggtcgtcgtccgttcccggctgctggtggtggcgcatcctgacggacgagtccccgctgtggacggcggcggctatagcgacaacgaggacgctgcgtggggtttggtgggctggttctattggttaggaatgagcttaggaatattagtaggtgggcacacacccagagtaacataatttaatctataacctctacgacggattaaatttatcacacataaatagattagggacttggaaaaaaaatctcgtttcacaaactttatgggtaacctcaccacccacaagaataggtatttacacacaagatgtatctatccaaccaaacaacatcttctgcatgctaccattccatccgccccatgctgcaaccaaccaaacaacatctcatcatatccaggttcatctcatccaagcaaccaaacgcctgcatgtgtatcccctaaaccaagctaaacttagcctggatgagggagatgagccagactagagggatacgagcaatcaaacacacccatgagccaggctagagggatacgagcaatcaaacacacccttaactgtttaaggatacgcatcatgcgatagccgtcggatacttggatggcttggtgcagtcaccccgtgaaggcagactatcttgatccgccccacccgtggatagactgtctccgccgccgtctaccctccccgcgacgccgacttccactctccccccgccgccaccttccggcctccccgctgccgtgcgccaccaccgcccctcgctgccgccaccaccaccgcctcctcccaccctcttcctccttcccctcctcacctccgccctcctccgctagattgacgaccgcagcaggtgcgcctcctcctcccttgatcagaagacgacagaagaaaagaattaaggtaggatataactataagtggccaaatgttacggcatgaaaccaaatcgctccaaatgtgagctgagtaatgtaggaaaggctgttgctacaaccagcccgtagctcctcatcctcctcctccgtcgatttgagaacagcctagctcctagcgcccgtcagaccagggagcagcagcgtcctgttggcccggcctcgtcccagcgagccatatgttacgactcgagatctcagcaagaagaattagagatagaatctggaatttagaaggaacaaagaagaacagagcagatacagacttggagagggggaaaggattggtatttagaatatgtttgttcaatacagttcacctctttcagtacaagggtaatctatttatagaccttgcccgaagctactggacccaatccttccccttcacgtgcgggttgtcacgcctctcccgtctgggccgagcggtagccgacggcccacttgatttgatccttcctcccgcgcctgagcctgatgacgaatactctggtgtgacattcctccctccttgagaaccagcttgaccccaagctggtgcagctggaaacttgtgacgaagttcctcaagattctcccatgtaatagctggagaagaagtacccttccattcaacctgaacttgttcaattagtttggcaccccgttgacgaaggtggcgttccaaaatacgatgatgaacagctaacggaccaatttcagaatctagtgtgggaagagaagcctgaacttgttcagctggtgccaatgccttcttcaattgagagacatgcacaacaggatggatcatacttgtagacggcaaatccaacttataagccacactgcccactcgttgcaagacttgaaaaggtccataaaatttgaaagataatttccgattggccctggtcatgacagattgctgcacatatggttggagcttaaggaacacccaatcacccactgtaaagacacactccgatcgatgtaaatctgcttgatgtttcatgcgttgctgagcccgcagcaaatgatgatgaatcaaagcactcatgttattgcgatcagtcaactaggaagccaaactcacaggagcatcaacggcagtaatagttaatccgaaataggatggtttatgaccaaacaatgcttcaaaaggagtcatagcaatggttgaatggtaagaagagttgtaccaaaactgagccattcccaaccaatgcttccactgtttggggcaagagtgcacaaaacaacgaagaaatgtctctaaacattgattaaccctctctgtttgtccatcagtttgcggatgataagaagaactcattcgcaattgagtgccagctcttaaaaataactccttccacaaagtgctagtaaatacccgatctcggtcagaaatgatggcacaaggcagaccatgaatgcaatgtatgtgatccataaaaagttgagctacagacaaagctgtgtaaggatgtcgaagagccaaaaaatgagcaaacttcgaaaatttatccacaatgaccaaaataacattgcaatggtctgataatggtaaaccctcaatgaaatccattgaaatgacttgctaagcatgatcaggtacttccaaaggttgtaatagcccaggtaacttgatatgctcagacttagctcgttgacaaacatcacaagcctgaacaaaattgtgcacagattgccttaaacctggccaagcaaaaagttgcttcactcgatgataagtagccaaattaccagagtgtccacccacagttgcagtatgcaaattggccagaatttgctgttgcaaagatttattgttaccaatccaaatccttttcttaaaatacaagatattagattgcaattcataatgtgcatgatgctttccattattaagcagagaagtaagaatccactgagtgtcagaatcagtagcatatcccagaggtacctcctgcagccaagcaggaatactgacagatagcgccgaaatctccaccatatcaacaggagattgtcgagataacgcatcagcagctccattttccaaaccctttttatagacaatgcgataacgcaaccccaataacttggtaagagctttctgttgccaagtggtggacaatcgttgattatctaagaaggccaaactatggtggtcagtccgtattacaaattcagcatgttgcagatatgatctccaatgctccatagccaaaataattgccaaactttccttctcataagtagagagaccttgagtgcgaggtcctaatgctttactgaggaaagcaatagggtgatctgactgcattaagatagcaccaattcctttgtcagatgcatctgtttcgacaacaaattatttctgaaagtctggcatggccaaaacaggagctgagatcaaggcagatttcagagtaacaaaagcctcctcatgaacagatgtccagacaaacaactgtcccttcctcaacaagttagtcaatggtttacaaataatcccataattgcgcacaaacttgcggtaatagcctgataacccaagaaaactgcgcaattctttgactgatgtaggagtaatccaattccgaacagccacgattttgtcctcatcagtagctactccattggcactaatcacatgacccaaataagccaactggggctgaggaaaagaacattttgattgcttaaccttcaagtgattatcagataagatctgcaaaacttggcgcaaatgcacttcatgctctgccaaagagtgactgtaaacaaggatgtcatcgacaaacaccaatacactgcgacgcagatatggagctagaactgagttcataatactctgaaatgttgctggagcgctagtcaacccaaaaggaagcacacgaaactcaaaatccccatgatacgtcttaaaggcagtcttatgctcatcatctggatgcatgcgtatttgatgatagccggaacgcaaatccaatttagagaaccgacaagcacccgctaattcatccaagagttcatcaatgataggcaaaggatatttgtttttgacagtaatcgcattaagatggcgataatcaacgcaaaaccgccaagaaccatctttctttttgaccaaaagaaccagagaagagaaaggacttgagcagggtttgatgatacctctgtccaacatatcaacaacttggcattcaatttcatccttctgcaatggtgtataacgataagggcgaacattaactggttgcgcaccaggaattaacggaatggtgtgatcacattcgcgaacaggaggaagtccttgtggttcttgaaacacatccgcaaagctctgtaacaattgctgaatattgtccggaattggcaaatcagaactagactcagaatcaagggtgtataactgaactagaccttcaatagaaccggactgatataattgatgtaattccaggaccgataagacaggattagcaggtactgatggaaccaccccacataaagtaatcagctgaccatccaatgtaaaccgaattgttttctgctgccagtcaatatccatagggctataccgctccaaccaatccattcctaaaatcatatcataactctgaagtggtaacaccttcaaagcagaacaaaaatgatgtccctgaactgaccaagaaacattagccaattcagtttcacaagacaacatttgtccattagccaccttaacttgaaaagaaacaggtaactgtatcagattcgacaactgaggcatcactgaagaactgatgaaactgcaggaactaccagagtctactaaaattagaatatcatagccctgaataatcccttgcaaacgcatagtttgagcagtagttgtaccctgaatagcatggactgacaaagagaacagagaatgaggctcagtatcctctcccgaagaattaccagaatcactgtcattttgttgcagtagagcaaatacctcctgaacagcattcaattgcacagaacctgaacacttgtgagatggtgaccatttctctgcacaaatataacagagaccttgggctcgccgatgagccttgagagctcgcattctatccgcaatagcagtagtcttgacaggttcagatgaagacttgctagcccctgcactagattccgacaccttggtaggaggaagaggaagaggataagctcctttaatccgcggaacatgatcacccaatttacgaaattccttgggcttctgagtctccatccattcctcctgtaaacaagcaatagccagagtagtctctaggtcgcgaggacgttgcatcataacagcatgacgaatgtcaaaacgcaacccttcagtgaacctatgcacaatcatgagctgattgtacataggatcataagcaagcaattgattcataacatcatcaaaacgctcataaaactcctccaccgtcccggtttgcttaatctgctctatctgacgaatcaacatctgatgcctatctcgatcaaatttcctatccactgctaagcaaaaatccgaccactcagaaaaccgcaaatgagccttcgacgagcgtaaccacgaggctgctcttcccgtaaagtaaatggtagccaccctgacccaaagtattggatgagtaccataaaccccaaagtaatgctcacatctcatacgccaattttgtggatctaccccatcaaactgtggaaaatccaatttcggaatccggtgattatagcctcgatcctcagaacccccaacttcatcccgatgcaatgaatcacaagcaaagtgatggggaaatggagaattagtcgtacccgtgacaggaggtggcacaggaggaataatcactcctgttgccttcccccggttgttgattgcaacgcggtggccatttgagccagaatctcccgccgacgtcgaagcaacgaacgactccggcgtgggaagtagcggtggacgttgatcgttgtcgtcgccttgcttccgcgtggagatggcacctacctgcaacatgttcgacgaattgcccaactcgccacgaagcttctccagaatctccacttgtttcttcagctcacccatctcagattgaagtcccttgactgctgcatccacttgaggtcgccagctagccatcgctttatccatctggagcaccaccgcttgtgtttcatcctgcttcaccgcaacggcgccgatggcgttctggattccctcaagcatcttctcgaatcctcccgcttgtttctccatggcatcgacttgaagctgtagccgcgtttggaaccttggcttctccaggatggaaacgagctctgatactaagatgttacgacccgagatctcagcaagaagaattagagatagaatctggaatttagaaggaacagagaagaatacagacttggagagggggaaaggattggtattcagaatatgtttgttcaatacagttcaactatttcagtacaagggtaatctatttatagaccttgcccgaagctactggacccaatccttccccttcacgtgcgggttgtcacgcctctcccgtctgggccgagcggtagctgatggcccacttgatttgatccttcctcccgcgcctgagcctgatgacgaatactctggcgtgacaccataaccgctggctgcaccattgaccgtccttccgcacctatttggcccagcgccgtcccgacaatggagcaagggggtggctctgcgcgaccttctctttactcgctttatctggctgtagccatagcccagacgatggattaggagcggctgtcttcagtgctcaggtattgcgccctattttctgtgtcttaaattgggatttgttgtctcatatatgcaggattaattatgctttggactacaatttatcctctgttgtatccacacttgatgactttacttgctggattgcttcttgtttattacattcacaaaagaatacgtgctttcgaaatgctttagatatgatacgctttgcatgacatgaagaggtagctgccagtaccatatgttaaaaatacacggaatacttttatataacacaggttggtttccttgatattttccgtaacaacaacatggtactggaattgatttcttatcatgctacttacagttgattggaatatattgatatctccttgagctaattaattagatccaacttagacatcacgagcagattcagttcaacctgtttttattataatcatcatattattttgataattggatttcattaattctataagagtgtgatgttcagttccaaattattggcctgtacactgtatatctagctgcctagcatctgatgtgagaaggatgttgatgcaatggaagtttgatctatgattgttcaagaaattaaaatgctggaccttttcttatatatcactaactttagtatgactaaattcgttgcagggcgcgcatatttgtaagcaaggaggtaagcatggactgtctgtctagctataatttttttatgaattcttgacattgctacttgctacctgcctacctccatgtctcgaaagttgtatacaccatcctgtttacagactgtcacctccttattactcgctgactagcttcgcagttcacaccctattggacataatgctttagtgcttattattactgtcatggacatgttgtgatgtaattctttgttctgaaacagagtgaaacgcaaattcgtcctaaactagcataaaaaaagaatttcatgaagttcatgcatgctaccttcattcatagaaaaaacaaaatgcagggttgattttctttagaatgaaagccaaaagttgctgatatatttctttaaaccatctgttatcagggcaattttaagttcagatattcttcatgtccaatttatcgcatatgcattccaggatagatctgcaactgctgtaaaactatttcagaaaggttggaatacactcaggcaatcctatttttaaaagccttttaccatttattttggtcttcccttctctaatacaatgttggacttactgtctacttgcttcagggaagaagggaatgccattcgaagtgagctgaaacaaataggtgatactgaaaagaaatcagtagttgtgtaatagtatcttgcgttattgcctttttctatgccaaatggaatttgagaatggaaattgcctcatcttgaatttgtcatatattagatgtgtgcctgaatcctatcaggtctcacgagcattctcgatcagattcccatgtatctgggttttgatcaggggtcagcatattttctggtatctgaattctgaacactatgatgtttactgaaacaattaggtgatgttgaacctgtcactgcaatttgtttttccccatatgcatatctgttggctatttttttttcgataggaaagggtatataagttttattcagtcattgtcggcaacgatattataattagtgtgcagaaattatttttcacggcttcgtatctcataattgcagcattacattattttatcataaaccaatttttacattaagataagatagtattttgaagattggagttctgtaatgttaatttatagcaaggttatttttctattgcagatatctggcctagcttctcaggtaaagaagaagatatactaacaccctcttgatgattgtgaactatggtgttcctatctaactgtccaatgccagcttcacatatggcattatctgctgtcggcaaatttgaaagcaaatgtattggtcgtaggagaagtctttgatagcttacgttgatgattgctgcaactttttccctcagcccattatatattttgtttaacatgtgaatacaatgttttggacatattgtatcttgcatatgcttctattttgcaaaaatgcctttatctcatctagtctcattaacagaggcagagcccggcgaaagataatcttattagcagataagataattacacaaagtcattgggttccacgaatcttcaacaccgccggcaagccaaagataattacataggaccagaatcttttcccgatgaattttaggactggcgctgcttgatacctcgctgcccagattccaactctaatacgcaccgagtttgccacgataaggggcctccggacctccatacatgcagacaagaaggagagaaaagtgatggcgcagacagactttgccatggtgagagcaacgggagctagcacgacgtacatgcccaaggcgaaggcggcgaccaggcttgtagctgagctccgcatcatgaccaacgatagggactggtatacgtagcggatggagatctcccgcgacggcatcccagagtagagcaggctgacggtagctagcagagagcaactgaatgctagcgtgtttgcggtgatgaatgcgttgaaggagtagctcccagcaagcgtcggtgtcccgccgttcgcgtggtcgtctgctctgtatcccccaggtaacgtgaaagctgctgcaaatgtcaccgttgcaatcagaacagatgaaatgccgagaactgaagttgcgttcgtcaagtactctgaatcgatttcttcatccctcctctttgaatgcttctcatagaagtggtcctggcgactgtgaccaactggagctctggcaagtgctaatgattggtgtatcatacctcgtgaattctgcaggttaacgtatcgtatatagtggggacagaatcagacaacttcatatatgtagctaggataaattgacacaaaagccagaaaaaaaaaacgattactacctttttatagtagaatcttgcaggaatcataatccatgaaagatcacgaggtgtcagcccgtctttgtttggtaaattcaagctcacctccctattccgaaacaagaggttgaaaattgagacaagtccagctttgacagcaaggtgcagcgcggtatccccctggttgtcctgcacatttaacacagatgcaagttcgggccttttgcacacaaatgcaacaatactatgcctcttcttctccacagcaacgtggaggaaagtctttccttgcatgttccgcaatgcgatgcagccaggggaccttccgagcaaggttatgacagccttgagcgtcccattggaggcagcaacatgtataggatatgatcctccgttatccggttggtacatagcagattcattggcatcaagcagcagcgtggttggacttggtttcggatggaaatattcagaccatcttgacaaacctgtggtactagttttcagcgatgcagcgaagtgaagcggagtgctcccatttttgtcgccttgactagtaaggtgtaagagaacaggcatactcctataccggcctccctgatcaatgttgaccttaacatccttgcacttgtctaacagtatagacagcgctgcaattcggtgtcgtcggttaagcaagtccaaagggaaaataaggctcataatagtaatacccaatcaacgccagtacataactggcatcaccactagtttttgaattaccagcactttataaaagaaggaagtgatattagtgccagagctagcaattaatgatatttgaattccaaattcaaattttgtaatgccataaacaaatattatgtatccatctcttatggccagactactcgtatgtgtaaaacccttttaggagtactttataaatgctgtgcatactttgaatactctaaaaaagtatactctttgatattaggcagcatttctttcactgtcttgagagactatgatactagctagtattaatttacttgtgtttttttttgtttcgtttgcacattcttcttatggctggttactttggatgttttacttggtacagatgtccaaggagaaccaaaggtatcttgagaaatcctgtagtctcaatgggtctcagtgcggcacataacaggattgattgcagagtttcaatggccggaatatattatgaatggaaaataaacaaggagttggccatacataccttcgccgcggtataccgagatatgcagcacgttttggccttcaggcccagagtatgacaatgttgtaggacttctatcaagcaggtcccgtgcaatctccaagcgccccagcgaaacggcgaggtacagcggcgaggcgccgatgccacgatcctccggaatcctggccagctccggatcctccgacacgagcctctccaccaccatcctgttgccgccgcggatcgcgccgtgtagcgccgtctccccgagcttgttcctggtgctcaggatccgtccgttggcggcgccgccctcgtgcgcggccaacgagatgagacggcagaccatggcatggtgcccggctctggcggcgcagtgcagaggcgtgtcgcctctgttgttggtcgcgcctagcaggtgcctcgccctgccgtggatcatctccgcgcactgcacgtactgctcgccgtcgccggaggtggccaccacatggagggccgaatcctggtccgaatcaagagtcaacccttccaggagaggcgacgctgctgctggacgatttgcaggttgaccttgttgagctagatcactactagtactactagtatttgaagctccctcctccggcatgcggatgacgagatgggattcagcagccgcctcctcatggttgacgagaagattctcaagcgccttgcacgcaccagatcgtgcagccatcagcagctgcggatccataatcacaggggaatccatcgcgacaccacgccaatcgtgctctggagagggagatcgtttagggcgatagcagtgcaggcacccgatattgagttaccccgtacgccagctaggcctagcaccgttgaaagaaacaacctccacactgcacgagtgcacgtgacctcaaatagagcccaaaaaattttagcccacagtggtgtatccttgattgagtgtaccaaacagcagaaagaaataaattaccctaaactttcctcaactacacccgcatctccttttcttctttttttttttacttctcgaggcttcttgccatctctcgcgactcgccatctctatccgcacaaccgcgccttctccgcccgccgaatcgctcctcagctcagccacgccgcatcgctcctctgcgccgccttcgagcgttttttcccctcccccaatcgagcgaaggcgaggctcagtggcatgagagattgcgacgccctcacctcccccaactccaccagctctcccattgcccctccgccagcgcccctcctccctccgccggcgccggctcgacgacgccgcctctcccctctcatccctgggcggcgagttaacaagctccccagccgccgcgccgtttctccctcctccccatccgtcggcgcatcgatgcagaggagcgcagcggcctcggggatgagcggcagcggcggcggcatcagggatgagcggcggagcttggcgtcgaccttgatttgtgttgccgcgatgttagcgatttttccaaatctcctcggggccgagcggcaagcggtgattttgttgccgcgatttgtgttccttgatttgttgccactattttggtgggcgtgttccttgatttgttgccgcgaatttggtgggcgaatttggggaaaacacttccacgggtggcgcgaggtcacgagcgggcgggggcgcggggcaacgcgctctatagcgcttctctccgtgggagcgagtgtctcttctgaggcgcggaacctagcgccacgcaagctcgattccgacgtggtgcatcatagcaccgatccacggtgttgcactgtgaagggccttagccactcattccccgccctcgcagtcggacgggctgccatgagaaatcatcatgggaactgcaggggcattcgcctccttgtccgattactccatgccatggactccctccctggcttccttctacgtaggattgcaatcaacgctcttctccctcttcttaccctttctgcagccttaagtctgagctaaactcggtaaagcttgctctaccccagcagaccgttcgttttctctataaagcagggcatcagtgtgttggcaattttttgtgacaagttgacaacaacgattgcagcaccttatgccttgcggtgatcctagagtcgccaaccacctcgatctagcaaagagctaaatctagatgggttttgacaaataaaccggctagtggagccgatttaagataacttctcgtttcgtgggcaaaacggaaggttttcaggacaaacctacaaagaaatgtcgcactctcgcaacggcggcggacagtttacggtgcaaaccgacaaagatggacaaactaagagaaaactgaaagcaatatgaaaaacgatttgattgattgattgtagattggttttttacaatgaaccagccatgtcccttatataggggttggtcttgtcctctacaggccctcctccacatccaactcggggtagaaactaaaggaaacccgaaacatgccttcccgagcaaggaaaccatgaaacccgacgaaacgcagtcggactcggacctgccggtcagaccggccacacaccgtcggtctgaccggccctcaaccgacggtctgaccggccctcaaccgacggtctgaccgcccaacacacggcggtcagaccggcccactcggaggaaaccggtagacttccaaattttggcaatctttcctattttaatcctaggtgccaaatttgggtgtaaacacatgcccccctgcctttttgatgaacaacgtgaatctaaaagcatagaacatgttttggtcttaggactataatccaattaccggccatagtacctcctaagcgtcttgccacacactcgggaagtatttcttcaagtatttcccattgattgctcgctgaaaacgctccccttgaagtgtctccaagaaatatgcatttccttgaacaatgccgcatactcgataaggaccctcccaactaggtgaccacttaccgaactccctggatcgagtacccaaaggcaaaattgtcttccaaaccaagtctccaacttgaaacaactttgctttcaccatcttgttgtacgccttggccaccctcttcttttctttttctatttcttccaaagccttcaagcgcttgtcgatgacttcatcaaggttgtctcccatcaatgtcttgtaatcttcacttgacaaatcatcttgcctgatgtaacgaagagaaccaagatttacctcaaccggtaaaacggcttcttgaccataaaccaactcaaaaggagtgaatttagtggcaccatgtttagatatcctatgcgcccacaatgcttcggaaagcacttcatgccacctctttgggtgttcctcaatcttctttttcactaatttcaacaatgtcttattactcgactcggcttgtccattagcctgagcgtagtaaggagaagaactcaacaatttaataccataagattcggcaaaattcttcacttccttagatataaaagaagcacattgatccgtagttaatgtttgtggaatatcgaatctatggataatatgcttcaaaataaagtcaattacctccgtatgagtcatattcttcaacggcacagcttcggcccacttggtgaagtaatccgtagcaactagcacgaatctatgcccctttgatgacggaagataaatttgaccaatgaaatctaaagcccaacctcggaacggccatggtttgattataggattcaacacggcggcgggcgccaattgaacattgccgaaccgttgacaagcttcacatcctctataatatttgaagcaatcatcaataatcgtcggccaataaaaccccgctctcctaagcaaccaattcatcttgtgggccgattgatgagtcccacaaattccttcatgtacctctctcatagccactttagattgatcttcatctaagcactttaacaagacaccatctatatttcagcgatataaatcttcatcaagcaatgtgtacttgaatgcttgccgccgaattttccgatcaaccttaagcgtgggatctttcaaatatcgaatcaaaggaatcttccaatcttcttctgtttcttgggcacaaatgtccgaattcacaattaattcggcctttaaattgattgaaaagtgccccccagcgctctgcccagaactgatcagaccgctcggggtcgccggtctgaccgacggcatgtggccggtcagaccgcccctggtcaccggtcagaccggccgtgcaatgccggtcagaccgctcctggtctccagttttgccaatttcgcacaaagatttaaaatcaagcaccggctcttctaatatcagaaataatcctttcttcacattataaccagatgcttgttgtgccaagtcatttgctctagaattatcatgcctagcaatatgtctaatagcaaaattatcaaaattggcaataatatccaaacatgaattaaggtacctatttagtgatccatccaagtatttgtaaactccggcgacttgttgcaccaccaattccgaatcaccaaaagcttccacgtacttagctccaaccatctccatgacttgtaagccgaataacaaagcattgtattcggcttgattatttgtacaataatattccaaacgaaccgatgcttcataacacacgccattaagtgaaaacaaaactacccctatgccttagaccttctttgtaagaagaaccatcaaaataaatcctccaaggtataacttcaactaggcaaatctcttcctcataagcaatatatacatgatggtccactataaaatcacatatgatttggcctttcatagatttcaatggttcataagccaaatcatattctatcaaaacatacgcccacttgccaattctcccacttagaattggcctttgcaacatgtgtttaataacatcagtttgacaagcaactatgcatgtaatagataacaaataatgcttcaatttggtacaagcatactataagcacaaacaaagtatctctataaagacatacctcgtctcggcatccaaaagacggcggctcaaatatgtaatgatatattccttgccatcttcctcttgcgtcaaaacggcaccaatgactttgtcttcggaggcaaaatataaccgaaaaggttttccggttttaggcgcccgcacaacgggtggagtagacaaatacctcttcaactcctcaaacgcatcttgttgttttgccccccaagtaaaatcggcctcctttttcaagcgaagtataggaacaaaagcatcgattttacccgctaggttagaaataagccttctcaaataattcaccttacctagcaacttttggacctccttcttacatttcggcgctttgaaatcacgaatcttttctatcttcttaggatcaatctcaacccctctctcatgcaccatgaatcctaagaacttccccgccgacacaccaaaagcacatttaagtgagtttatcttcaaaccataccggcgcatcctctcaaaagctaacttcaaatcggctatgcgtccttccataccatccgatttgacaacaatatcatcaatgtagatctctaagataatacctagcaaatcatgaaagatcaaattcattgccctttgatatgttgtaccggcattcttcaatccaaaagtcatgacaacccactcaaacaaaccaacaaatcccgggcacctaaaagccgttttgtacatatcttccttcgccataaagatttgattgtagccggcattaccatctaaaaagctaatcaccttatgacccgaagcatcattgatcatcatgtcggctataggcataggatattcatctttgggagtggctttatttaaatctctaaaatctatgcaaactctaatcttaccactccccttcttctccaccgggactatgctagaaacccactccgcataacgacatggcctaataaaccccgccttcaacaaccgatcaatctcctctttgactcggtcatatagcaaatgattaaaacgacgaggtggttgtttataaggcctaaaacccggtttaattggaagccgatgctcaacaagctcacggctaagacccggcatctcattatactcccatgcaaaacaatcaacatactctttaagtatctctattatcttaaccttataatctgctctcatatttttgtttacaaaagtcggccttggtttgattccatcacctatgtctacttcctccaatggatcggccgatgtaaacccttgtccaagcttctccacttcatcaaaatcttcaatagtttcaccaatatcgttctttgtagaccgatattcttgcaccctcttttgtaaccactctaaattagcctctttactcattatacaaatttatatggcttagccgtgctacactagctggctttacatagataggtacaaatttgccatcggagatactaataaaatcatagctagaaagatccctccccgataagcattgaatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttacattgcacatcgacgatgaagaaagcggttagtaacgtcttgttccccatggtaagctccgccgaaaagatacccttcgcctccgttggtttaccattgaagctattgagaatcatgttagtcttcttcaactcatcatcctcacgccccaacttcttgaataatgaatacg

SEQ ID NO: 63671 - DNA, 737 bp, Oryza sativa
  unsure (1)..(737): unsure at all n locations
gttttttaatagaaaacgccgttgactttttttcatatggttaaccatttgttttattcaaaaattttatgtaaatgtataagatataaattgcacttaggtacatgcatgatcaacatggtataacatgtttgaccatgtttgacatatttaatctttagtcctggttcaaatgcnantagggcctgtggccccccccccccccccccccgtgatctttagtcctggttggtaacaccaaccgggactaaagtcccacccctatatatatatgtcttctttctcctccagctgcccaagcaagcttcaaaatttcttcaaaaaagaggggaggtcatgccaaaatttctagtgaatttattttggtgattacatacaaatcggaggtgcctaaaaggtttgcaactttatcctccaatgttttttttgtcatattacatttggagctatgttttgcacacttttttgtctccaaaatttagttgtgatgagagagaaaatttgtgtggagaagaaagaatatatataaatttagttgatttgctaaagaaggttttataaaatatttgagaaggaaaatatagtgaaagttaatcttcaataacagaaaacaaactaaaatgaaaattaaaagaagtaaaacacattaatattagtttaaaactttagaaatagtaaataagaattatttggtgtaatattttatgatttttgtatgaataaagatatgttattat

SEQ ID NO: 63672 - DNA, 2226 bp, Oryza sativa
tcctgcagcccagatcatgccggagaagtccagcgactggcaccgctcctccatcagtatctccttcctacacacaccgtcctccacgcggaagctcagctcttgccgcctccgccgcctaggaaagtcacgatggcgcacgacgagaaggacactgcgatccccacccgtggccgcaggtgcagccgtcgcgccgcccgggccgcggcccaggaacccggcagctgcacccctcctatcctccgcctgccctcctgcgtgcggcgcgccggctctaggctccaagcagtcaccgtctgccaatggggtgatggattgggaggggaatcaatggaggattggatagaagaagataagggcaaaaatgtcattttttatggtttctctcttattaattgggcgaatattatattttaatgcatccagtgttcagcagcaaattaccgcaattttgaaatgttctcgaacatattcatatctttgtgatgttcttcagctaattacgcattttctgagtgccctggaacaaattttaccataatcttaacttaattaaaggattcatatttttttcaatcgtcacctcgctttccgatgattttcgtcggtcgtcgtccgcgtccgatttgtgaacctggaaaatgaatcgataagattaattgaaatcgatctggtgcggtaattgtcatcctgtagcaaagtaatcggtaccattggctgggcctaacaagaatgggcttgcagcctgctgatgggatttctgcatgagagtctacatactcaactgatggcaatgcaaacgtgacagctcatgtcaaaatatatttatcaaaggttgataagcagttgtcaaaggtagaacacgggagtttttttcaaacgcgcaagagccttgcacgtagaagataaaattttgtataactgttaaacgtggataccaagtatttttttttcactagacgagtcattaacacatgaactatttgattttttaaaaagaaatttctatatagaaaacttttgtccgaaacgtaccgtttagcactttgtaaaacgtgctctagaactcagccttagcctagaagcattgagcactactcagtcgtaacaagaaccgctagcatgttgtctccaatttacaatccacaatcacttccctctaatactacctttgttctaaaaaataaaaagaagttctgcccaaagtaaatctaggggttataataagaaacatccataccaatcctggaaaaatctgaaacacatatataaaaaagatcccgttgcaacgcatgggcattttttttgctagtaaaataaaaagcagagtgaatggtagacacatgatatatatatagtaccactggtggagaaaccgtttgtaatcccgattggtaaccccctttagtcccggttgtccaaccgggactatgaatctgggactaaagatagctatatttagtcccgggtaaaataaccgggactaaagatcggtcagccacgtggccggccgagccatctttagtcccggtttgtgttacaaaccgggactaaagattggtgcactatttttttttatttgcatggccctgtttgctgcatggttgattatatatatatatatatatatatatatatatatatatatatatatatatatatatataggacactcatatggggcaccatggtgcccgggcaccatggtatcaaatacacaaaatatatatatatatatatatatatacacacatatatatatgcatatatatatatatacatatatacacatacatatatatatatatacacacacacacacacacatatatatatatatatgtatatatatatatgtatatatatatatatatgtgtgtgtgcacacacacacacatatgtcacaatatatatatgcataatatataagcatatataacacatacatatatatatatatacacacacacacacacatatatatatatatgtatatatatatatgtatatatatatatatatatatatatgtatatatatatatatgtgtgtgtgcacacacacacacatatgtcacaatatatatatgcataatatataagcatatatatatatatatatatgtatatatgcatatgtgtatatgtataaatcatatattgcacacatatgtataatttaaagcacttaacattttatgtgcatatatgttaccaaaatatatat

SEQ ID NO: 63673 - DNA, 40586 bp, Oryza sativa
ccgtccgcgtgcgtgcgcgccgccgccgccgcccccgcctgatgtcgtgcgtgtgagagagagaggggaagagagacatagagtgagactgtgagagagagaagagagaggaaaagagaggatatggcaggtgggtcccatatttttttataaatagaatgctaactgaattgctacacgtacgccacgtagaccaaaaccaccgcggattgggtcgagggggggtaattcatccggtttgcatagttggggagggggggggtgaagaatgtcgtttttgtggtttagaggggtaattcggacgactgcgatagttcaggggggtaatttgtactttttcctattgaatattgaacattgaattctgaaactgaactggcattattttgaagaaaaaaataaagataagtataaaaaaatcccaatcatgttatcttattaaagataagtgatcagggttcaagttgatatggaaccatattattaaatgtttaattttgattattttcctagccatgtactgaagtattgtctaattaatgacaccggaatatgcaatttgacctctttgaattacttgacatttgaattttttctaccttagccatgacggttttgtaaggttgccttttatgatacctgtatagttagatgcaatctttaaccaatcgaagtagacgtttttgtgtatttttattttttttttacttttcagaaataaggaagaaacacaaattggaattgcaaaacttgatgctaacaaagcatccgaatagggcattacatttttttttcatgttagcaaatatcaatggtgtaattaatactactcacctgataaatacataaattccttggcaatgctactaccgagtcattttttttgctcgtgtgcatgaacattttattttcctcttctgatctcaagtcccaacccctattaatttatttctttaggtttctgcttcaacgtgttaagaaataaaaaaactactgatcataaacaaggctatttgataaagcagattaccctaatctaaattgggcgcggcaaggccgcgcgtctatgcatagtcagtactatagcctcactaatcctcgtcgaggaatctccttgccgccctagaagtttgagattgtgcctgactgttttggagtctgttcagcagctccttcagcgcctggggattgacgtcggactggagtcggctcaacatgaaatcaagcatggtatgatagtcttcttcacggagctcctctccattcttcagagtaatatcacacaatgtgtccagaatctgggcgtgacaggcgcaggctttttgtagagaactttcctttcaaagagagaggtttctagtgatccttggatccaaacgttttgtcccttgtggctttgcccatctcttgtattctgatcggagtcttgggtagttacgaggatttaaaatccattgctagtgtttccaggaacacaaagtatatgatacttggatctgaacgttttgttctgtttcttggaaaggctttctctgttttcaggaacgcacattcacctcgcgacatcagatcctttcaaagaaaactttacaaagacattggatgagagcatgttagacctgaaaacacaaactttacaaagacattggatgatagctagggtttcccttaccgtaaaccacgcggtaaccattggatgataacttcactcccccgcggtaagacagaaccgcgtggtaaccgtcggaaaccacgtgaaattcgttctcaaatatttgaattaaaaaatcgatggtttcagcgtggttactgtgcagtttcgcgtggtaaccacgaatatcgcgcgattaccgctaattgtgtagcagaacagagaagctgttagaaaaaattgaaaaaacatttaaattcatgtagaaattgggaataattagaagaatatagaggaaacttgcaaacataacttttggggtgtaaaatacaaaaaatcaatatgacctttttctatattatggacttcaacgcaattcaacatttcgtagcataataattcgacaacaataattcaacaacctcacatttgaaagcattatgatgtccacatgaagctgaaataatagagtccacaatagagagagcaatagagagagatgagaggaccaggagatattttctccacttataggccttaatggactggacagtagtacaagataagaccttattatttttttcatttctaatgtactttcggtttttccctcaaaattgaatttatctaattctttttcaaaaaaatttcttcaccatccgccactaaaaatgaagaactatatccacgattttttttcagttttttcagaattttgaatgtgggcaaaattcaccaaaccctaccaccggtaacccctaccgtaccccgcgataaacgcgcagttatcggcattaagagaaaccctgatgagagcatgtttagccttctccgttttgtagaaggaaataatataaaaatagctcctatataaagatattcatttgtttgtaatccaattgtgcaccaccaccgacaaaccctagaataggtgtagaataggtgatatttactggaccggcggcgtctcctcgagtaaaggcttccacccaaattgcatgactaacaggtcttacgtgtaaaggatcatgtacccatgattcaaaatttccttgccaagcgacataaaacagattacccgaaaaggcaaaaatgttataataaagacattcctcactaatatcatcatgacattggaaattaactaatatcatcatgacattggaaattaatctcaaaatcatgtgcggtagcgataccaacccaacaaaataaaaccagtagctagtgggggtccttagctatgccttggcactactagaaaacagcttttcacaggcggcctaaacaggtttttgcaggcggacgagtgcaactgaacgattgtgaaaatagttacttttcacaggcggacaactagtccgcttgcgaaaatagcacctggcattaaaaaaaaaaagggcagccaccgcccactgccgttccagccaatagcagtagctttccattctcctcccattccctcatccagattcaacatcaaaccaaatcaaatacacaaaaacataacagattaacagacatcgtagtggttcacaatcaaatcaaatcacaaattttccatggatgtcgtcatcgccgtcgcacggacgcaccccgccgccatctgccccgtgccgccggccggtccgcccgcccgccggcctcccccctcccccctccggccaaatctgggagggagggagggaggggagccgccgccgaccgccccttccgccgtcggggaggtgtaggggaggggagaggattagaggagtaggggagaggaaagactcttagaaaaatatcagcccacgtgccacatatatataccacgctaattttcgcaagcacactttatgtggtccgcctgcgaaaatagcaggcaccgcttaagtggtccgcagcgcccttcaccccgatttgcatttttgtaggcggctatttggctctaagggtcatgcccgtctgtaaaaataaatacctaatattggcgaaaatgctttttcagtagtgtggctaaacctgggaaacacacaactcatctagttaaataacatgtgcactaaccctcttcctagcttcaaaatgggattaatcggtgctactctagttagctaagcgaggtggtattattgccgctacaggtgttactgctttctaccttgccgagctgctatgcagctgcaactactgttgctcaacactagttggacaaaggcccaaagcctctgttgctgctgaaggcgagctaagcagcccactacctcaacataccctcatccttttttctcttttttttttcatcaattatttttggggcacaccacggttttactttttttcaagtgcaagtggcaaaagttattgccgaatatattagaaagatagagttaatcctatttataagcaaaatcgggcctaaaaaccatataactgcacggtttgcagaagtgaaacctacgaaaatcttacacagaagacacaaaaagcatgaggcaaaacaattacgaaccacagaatgctgagggaaaagcaagaccctaagacgaagccttcaagaatatcaacacgacgaagctttcaagaatgtgaacaacgacataagccattgtcgacgcccgcccagaatgggttttcacctaggtgggagagagtccataaggcaacacctccaaggaggaatcggcacccgcagacgtcgatattgccgatcctggaagagcatgcagggcttgagcaaaagctctcgcaccatggaggtaagcacaccgctccaacctcagcaccacaacaagctcagaaagccacagtgcacgtgaagcaccggtgaggcctaagagccctatctacgtacaaacaggaccaataccacggacgaacaaactcctcaagcaccgaaagagaccacggccagatctggaagtagacagccaagggaaggggaggcaccaaagaggcatggtcggcccggagaggaactaagagctgaacatagggctgtggcgaccacctgcaacttcaccaccagtgcagagaggggagcgctgcgggggagtggggagaggatggtctcccccaacagtttgttctgcgagggggcatagcgaggaacacacaggaggtagccagcaaggaaccggcgcccgcggcggtccgctgcgcgggggggcgctgggggcagccagccagcgcacacccccagcaggccgacatgccgtcgacccggagccggttgccgccgcctgctgcctcacgagtcacctcgcgccgcgacacgccgcgagcgccggtcaccgccggccacctcacgagtcgcaaccgccacgccacctcgcgcccgcgagcagcgacgcctcgcgggcgccagccatgcatcccacgagccacaaccaccacgccgcctcgcgccgcagcggcctccgccggccgtaccgcctccgcaacacgcttccagacatcgccgtcatagatctggcgacagcggggccggatctacagcagcccaattaacctgaaggcctcgccgccgccggcgaacgatgcatcccccgcgctgagaaggggcaccaccgcgagaaggccccccgccgccatccttacacaatggatgccactgccaggagtaacatctctttcccaaatgaatggaaccaagatacattaattattatttggcagtaggataattacaatgccagatatattcacacccgtaccatattattattagcaaaaatacaaaaagaatctaatcctgatatcaaattgttcccttgaacactcgactgaattttcaaaattctctacatcatctccaagaaaattccgaatgcatacctccttcacatatgcatacggacgagacgatgatgacggaacaattagaacgaagaaacacctaatcctagtctgcaatgcgacgactcggccatttgagtcgcatcacctgctatgatcttgccattgtccagctccggcagctcctctttaacaccaatgtcgccgttcacgtccaccaccgtcttgacaacgtcgacgatgtcggcgttcacgtccaccattgtcttgataatgtcgatgttgctgttctcgtccaccattgtcttgacatcgatgtcggcgttcatatccaccatttccttgacctcgatgtccgtgttcacgtccaccgtctgcacttgctcctcctcctgccgaaggtcgaacacatcgacgagtgacggtcccgactttatctcgaaccccttatcatcaatctggttgtgctcatccacccctaccggcatttggtgatcggatgtgagctcaaccttgtgttcagcatcatagttggtgtcgaaatcaaaatgctgcattccatcgacattgatgtcgagatgcggcttgctactgacgtcgtcaccggcggtcgagtcgtagtagaagtaatcgtaaagctgctgtggttgaccgtgatggtgttcacgctgactctcgtcctgattatgatggccgtcggcgtgtaggatcgcagcatcggcttcttgattggcatagagcgcatcaacgacctcatgctccgcactgagtaggagaggctggtttgacgaggtgacatcgagatcggcgcacgcgtcgtccaacacgcctgccggcagcgcagcggcgacgctaccggacgcgccagcggcagccgcctgacgacacatcgccagatggtggagtacggtgttgagttcggccgtgtcgagctcgagctggcgctcgagatcgcagatgacgcggcaacacccgccgacggggtcgtgggcccgcatctcggcctggtagatgagcgtgcgcatggcgtcgtcgcacagctcgggcttgaggtggcggagcgtcttgaggatgttgctgacgccgaagaggcggtgcgcgttgaggaagcggcgctgctggtcggcggggaagtagggcgccatcgggcagtccgggttgcacttgcgccgctggtacttgcacgccgcgcatgcctgattcgtccctccccctccacctccaccaccacctccaccaccaccacctcctccgctccctccgccgctggcgccgcgatgcgagccgccgctgccgctgccgctgccgctggagtgcggaggacgggcggcgacgggaaggctctggcgttggtgggaggcagtggtggtggtggtggtggagacggggttgttgttgttgttggtggtggtggtggtggtgttggtggtggtgatggtggtggtggaggtcatggcggcagccgcggcggcagcggcgacgggggctctctggctcgccaggtcgcgaggtcggaggcgacggtggagggctggccctggcgtcgtcgtaggaataggagaggccctcagcagctgtccatgtcatccgccattttctccaccactcgtctccatcgatcgccggatgcctattaaaagtaaaacggattttcgatcgagcctagcatcgatccatgcatggtgcagttgccaacagctggtgcttaactgtgtgcaagctgtcaagagagcactgatatgatcgactcaaaagagctgcatgaaaagccatgaaaagggatatgatcggagagggaggtcgatcggtttggtggctggtaggcctagctaggagatggagttgcttgatcgattcagaatttccatggatctcgaatgtgttcgagcattgcggggatgtcacactcgagagtttgttgctacataaaaaggtttgatgtgtcaaactgctactaccattagaattagaatagctaagactgcagctaacgatgttaagccagaagtttagctagacttttccttaaagatttaacagtgtactctctccgtgttgaaaaatagttgttattttggacgagactatgttaaacttatttgaattttgattacgaataatttctaaaactagaaagatagcccgcgtatgcgcgggcatcttatttaactgtgctagaaatttgattaggaatgtttatgattactctattttaaacatgtttaatttttcaataatttgtgtggtgtttctctgaatgctagtaaccatcgctggtgtataaattctaaactaaaattatttaaaaccatgcaaattaggttttataagaaaaatatatatgtgaaactatatatcacttctacaaaatgcacttcttttttttaatatttagcatatcttatttttgcacattctaaactatgagtaacaatttttcttttgtatactatatatgtttttatgaattttaggatatattaattgaagatattttctattaaaaatatggctaatacgactacatcatctaactaaatgaactgaatatgttgaaatattgatttaattgtaagtatatagtattgcagtatgaatttatggtttagcagtaaaagtttttctaaatcagaaacagaaaatatattagaaaatgagacttttatcgttctcaagttatagtttagggttgtatacttcgaactgatattatgttagattttatttccaacataatgcccaaaatgtcaaattttatattatattttatttagaattttaattattttcattgtatcagtactcctaaatatttgaacattgctatttagaatgggttttagattaaaaaaatcttaaatttagaaaaacaaagttcagtcttcaattatttttatcatgttatttttttttctagatttctatttcatcaagcatcccttaaatgttttggtctctgcaatttggtatagaaatataagtgggttaaggccatacaacttggcatgggataaagttatcgcttaattgttttcaatctattgtctataacaaatagatcctagacagggtacacgttatgacataaaaaatgatataattaaaagctttttctctaatccattagtgacatcaaatatcataggtataatttagatgttatgatcatcttaggaacatttatttatctctaaaaagatcatttattcataaaagcgcatctaggatgaagtataagagaaattaactacttccattgttgaggaaagtatatcaatatttacatcaccaaattatttttattgaattcagaattgaatatgttttttataatataattgttttgtgttgaaaatgttactatgtttttataaactaattcaagtaacttgacatagacaaaatttaaaatgacttgtaatctgaaatagaaggagttggaagaaggtcattagatatttagcatggtataaataataggttgactgtttattaaaaacataaggtgggattttttattttttaattagaaattttagtattttattttatttattggaggcttcaaggtagatagatgtggtccacaatgtactgaattattgatttaattgaaaattgtaatagtttagaaatgtcatcaattgaatataagatttaaaaatttatgattattttaaagtctaatttatgttgtttctataagtgctagcttgagaagaaagagaagagaagcacatgacagagtaaaaggttgctagatttgttaggcggagtctatttgtaggtgtttttttttctcttaaatataattttggatttagttgctatggagataaagaacagagaatgaatggtagggaaagaggaacgggagaaatgggagggagggagtttttggattttcgtttaaagatagatctaactatataagatagtggatccattagttcaagtggaaaccgatggttggatattttgttttcatttgtcacacttatagagtttttcaatttattagagtgacacgtggtgatcgatttagaaacatttatgggtgtaccattaggcctagacatttgtagttagaggagaggaggaggaggaagaggaagagatgggggtgaatgaggaagaagagataaagggaggaggagatagaacttattaactgatcctgtgcgcctcctcctcctcgatctcgcgcgcacgcctcgccctctccacgtatgccgatcatttttcccggttgataacaccaaccgtcactaaagataatagaggagtttgacaccgcctgccttttttttaccgggactaaaaataatctttagtcccgattgttgttaccaaatgggactaaagatcaaaaagtagctctaaacttttgaaccgggactaaagataatcttatatttagtctggttttattgcaaccgggactattaattgtggaatttggtcgaccgatcaaagatggtttttcatctttttccagaagtgcattgatcaccctactaattagactaaatataacccaacctaacatggctaactaaataaataatttttaagacgtcatctttccgactgaatgaaacaaaataataaaataataattaatacaagctaactccaaacctaaccgctacatgcaaatgtccaatcctaacactttgctaataaaatattaatccatctgctaagagcaaggttaatagagaaagcttatcgtcggcaccaaagaagtccagctctgctttatagctaaccatatacatgtagtgcgtatattagtaatatcctcatattatctctaaaagctattttatcttttaccggacccacaattctaatttgataggctcatacacagaaattatctcttggcaggcacgtgttaactagccatttgctttcttcacctaggcgcttgtgctcagccggcgcttgtgcaatcgctcacttgcctctctctcatctcatctccctcatccacgtaggacttatttgacgtggcttggctattagccagcagagctggacttattatacctgctctaatattcaccatgcttcccacacaatgcgagattgttatctgattcaaaccatgcttcccacacaatgcgagacagggattgtgtcatattcagactacgcttgatgcataatgtaagacaaccggtggatatattgccttctattgtgtttctgaaatttacagcttatgattttctgaaaaaaagcatgctagctagaaaacttttacacaatgtatttgaccacttccatacctttaataatgacacccatgcatatagacagcgagtatgtataattaaaataatctttacacattccaacgcacgggaatttgtttctagtatgcatattaattttaaaatatacttcaataaaatcgaatttctataatatagaaaaagagtgatgaaatttatttttttaaatgtggttttctgtaaaacgacaattattttcaaacagaacggagagtaatagtttagccctccgtccatgaacaatcacagttccaaaaatttttttagataatatcagagttgctaatttaatcatcgttaaccgttgttgggaatcttctcgcaggttactgcccggccggccgtgattaaactaaacacggtccaaataaaaattaattctcacccacttgcatgaattacacatgcttaagcttaattaacaaccacgtacagcttagtccgtgtacgctgagagagagaagtggagatccaatgcgattttccactccagatgatcagcatgtcatgtgtctcacgcgcccgcgcgcactgcttcttctcgatctttcatttgtttattgttcgacaccaaccaaaccatctctcacagattcttaatatacagaggtttcgaggacgagcagatcgctgcaactgcaagaaagcaaagaccggggtgtagtgagagtgtgtgtgacaagatcgatggccgcggttgagtcgtcgtcgtcgccgtcgttgtggtggtggccgctgccgccgtggctcagcccgggcgccgcgtggttcgtcctgttcaccgtcgttgtcggcgccgtcgctgtgtcgtcccgggcgcatgagcaggcgccgccgccgccgccgtcgtcgaccaggcgcaggctcactcgcagcgcgtcgtccatggtcatggagcggctacggtccttctccgccttctccttcgtccacgcgatctccggtgtgcaagaggacgacatcaccgtaggtccaccgacgtcgccggcggcgtcagggaatgcagaggcggcggaggagaatcccattggattggacgaggcgcacgcgcatccagcggtggccgccgttcggccgccgccgccacaagctgctgctgctgctgctgccaccgccggcgaggtggctgctgctgctacggcggaggagaggccgaggaagaggagggaggcggcgaaggggaggcgcgcgttcgcggaggtggaagggaaggcggaggtgaacgcgagggcggagcggttcatccggcagttcagggaggatctcaggctgcagcgcctcatgtccgtcctcaaccgcacccatgcgctcgccggcgccgcctcgtcgtccgcaccgtagcggcgtatagtagacggtggcgtggctgccggccggccagctagctgcctgccacgccgcggcaacaccattgtactgctccatatatattccattttgctttgcttaattaggatatctaatttaaccttcatcacatgcgaaaagcaagagttatggtatatagttgttttttcttgtcgaggtcagcagggatgaagctagcgctcctcaaattttcttttctggaatgactagtacaagacggtacgaaattctagtgatagagtagaaaaaaattataatattacatcctgtaggtcgtaaccagaaaaaacaaaaaaatgtactgccgcccacacaccgacaacgccaaaccacaagtcctggagaagagtagcaccggactggccgctgctaaactaacaacagaaacaaccgagatcgcccaaaaccctacccttacaaacaacacaaaatccaactttatccacgtctttaggatttagcgagagagggtgagagagaagatggaacatctctccccctaggccctccgccgtggccaacttgtagtatttaggacgccgccacgagaggaagaaatttagagcgtgcttgcgccaaaagtttgggtggttttggtaaggggatgcctagatgacgtctccaaggagagaagcgatggaaacaccgccgccgccgtccgtcaaggtctcaagagagccgagactgggctttcgcctggcaacaaccgttgaggggtgagacggcacgacaacaccctcaggaggggaatgacacttgaacgccatcgattgtcggtccggccgaggccgggctgggttttcacccgccgtccaccacctgccaatctaccacagaaactccattgctccaccgccataaaaaacctctgccggcgcgtcggtacactgcaccggcgcccccaccggctagtatccgcgtgcagccacctcaccaggctccgcctccatgacatcacctcctgctgcgtagccatcacgcgtcggccgtcctcgatgccgccgaccaagcctacacgcgcttcatggctgccggccgcaacttcttcggtgagctggcgccacctccaccgtcacggagtcgaacctcgcccgccgccgtgccaccgggcaccgccgtcgatcgccagcagtagaccccgccaccggtcacttccccgccatttctaggcgcggatctagcggtcacttccaccgccgccatcacctccaaacgccgccgccacccccgccaaatgccaccgccccacggcactaccccgccgccaacttccttcctaccagatccggccggaacgcacaaatctgggcggttccaccgttccaaatgccgagcagccccctacccctgcgtggtgagagaagcgaagccccgccgcccccatccttgcggtcacgcagctttgccgacggccactcaggcggcggcgaggcagaggaggagggaaggagaggtcggcgatggcagccaagtcgcctcccgtgtcgcccgagggggatggcgacgcgagggccgttcgctcctcaaatttaacggagatccatgggtggatgtccactcaaccaaatatctatgagaaaactttaaaaaaattgataagataaattaatgtgtaatatattacttcacaagtatgtaaattcaaattcaacttctagtgtaaaaaaaataagaaatttaatacaacctttacaagttgaatttgaggttgctttgtggagtgatatattacccattaatctatcgtgtcaaattttttgaatttttttttatttcgtggaggcaattgaagggattgccgatttgttaaacggtgtacacattagtagaggcctgtggatgaaatcatcacggcaatgccgcaactctctaatcgatcgatttcatctattattgctgcatgggtatccgaaagattactttctcagcaacctttaccttctaaaaggattgttttatgtatctctctgacttgtatcagtttaaagcaacgtacatgggaatttatatttccctactcttattaatatatataagtcgaatattcaaaaaagcccgcatgccatccaaaaacctcataaaaaattagtcatgtaatttaaattcgagctattcaaataaaaatatcattgtttttattcgtatatgcttttacttgtatagcatgtgacatcagcgatccagaagtttcatagggcatgtcttatagtccctccattagttttttaatagataatgttgttgacttttaaatacatgtttgatcatttgtcttattcaaaagttttaaagcatccatgcctagatccagtagcttgaaaactggttggcgtcggatgcagccccaggagtgaaggtttgccggatctggggcatccgtggctagatccggcatcttgtcggctcagttggtgatgatgggtgatgatggacgctccatttatttttggagggtgtcggtggctgcggtgtaggaaagtaggtcaccttgacacactacgttgggctagggcagctgtaaacacacctgtgagcgagcacaactgacagtgggactgctttaacattggcagctcggtggaggctatggtgaaagcctagacggcaatgcctgtgggcgccgttctcttcttggaggtgacatttttgtctcctcgtcatgctgtgtttcgattcttcgaatgaaaacctagctcaaggccagcaatgacgacgtggtttggcatggtgtccttcttgaaggcatcatcgagaaaatccttcatatctttgctagtgtgggagtcttcctttcttctagcttgttgcatggccttgccgtttatgtgttgagcatcgtttgttgactgtccttttccgttgctatgttgtttaggttagttgaagactttgttggagttgtgattttcactcagttttttctaattaactatgtgctgtaaaattcagttccctttttttcttaaaataggatacattcttctttatttaaaacatcgggaatgggttgaccgttcgaaaaagaatttataattgatgatcaggaaggtgcagattgaagacgtatttcattatcccctatcccacaaaagcttgatgaggcacgatcctaaacatgcatatatgttgtcatatccctattatcataaatatatgtttcctttcactagggttatgggcttgtgtcaaagcagaccttaggaagattcaaatacattattgttctcgtctctcccaactaagactcaatacctaacgagatctcattttaattaggttccttttgtagtttcccagagaagttggtatatagaattgttcttgccattcctaatattttacctgattttttattgtaaatttgcgtacagatatattgaaaagtacaattgaatttgatatgcaatttttgctatgtgtaattatattttgttcacacagctatatggctatttgctccattataatcttgatacaccacaatataacggtgcccatatttctattttttaacaaaaaatatttttcttattttacacctctaagctatttcattggagcacttaacctctataaataattttctcactcattttataccccagactactgaaagtcattcaacttactcactaatgttatttcttctttttttttctctctctctatacaagtcgaattttgcattaaaatttggtgtgattgatagatgcactatataatattttttttggaatttttatttaaaaactagaactcatttaaacattgaggctttaaatttcaagtcaacaatcatgaaaatttcgaaaaatattttacaattttaataatgatgtcatctatagctctaaaaatttttagcttaaaataaaaatcatatgaagaaaagaaaaggagagatatcattaagaagtaaagtggcccatgtttaatagtttatgaggtataaagtgagcctagaaaatagtttaggatattaaatgctttggtgatatagtttgggagaggaaagtagatttttttttaattaacatgttaaattttaggacgcatattaggcttttagaaactcaaactttgcatatcttgaccaataattagttgcagctaataaaagtcatctgtagcctataggttcatattttagagagttttacaaaagaacaactttttacgagtaatcgtaaatcaacacctaatgccattgttactctaccgtagtagtatatgttgtttgcattaattcatacctaggaagttttttttaacgcaaaaggtagagagactctaccttataaccattgtattaatagctaggaagtactacaacatagatgcctgtttcttcgcttaagatggagaaaagcacaaagccagttcgaaagaacactgtcacttatccttggctttccttgtgcgcctgagtatcccttgctgccagatcacttaattctgcaacctggtaatatatataggtatctctgtaatcgctggctggcgactttgtcctctgattaattgtgcttcacggaaggaaggaaggagactgcagatcacaaccctgcactggctagctatatatacacatacgcgcgcaaatcattaagttcaggacagatactaacaataacagagagagagagagagagagagagagagagagagagagatcaggattaaggtaagctgagggagaggttgcaaccatggcacagcggttgctgcacggggtgatggaggccaaggtcctggaggccaagctgtcgtcagtgtcctcagaggcatcagattatggccatgggcagcccaagctggctgcctatagcaaggtatacatataagattcggagagctctgataacttgacgctgtttgtttgacatcccgatctactttcgttcactcagatgatctcacatactattctagctcacaagtatcaattaaagcaaattggcaacaggaaattgtcaaattatcaaatttttctaagagacattgtttcgcttggagctgactgtaagacgtaattgcttattaaggaccaataaataatttatgaataaaatttaaatatatatgcattcttagtgaatcaaaagcttatataaaaataacaaaatcaattataaaattaagattcaaaatttaaattttggatatggctaataagctcaacagcaaatgaatagcttgtacgatggcacttatgtataataacaattatagctagccaacgaaactacatgctagacaatttcactgatgtgaaagagggagaatagagataggaggggattgctaaacatttgcctgctagacgaagtactccctccgtcctaaaatattaaaatataagtgagataggaggggattgataaacatgctccctgtcctgattcgtagcacttaaaaaatgtcacatccgttcaaaatcccttatatttggggacggagggagtatattttaagaatttaagattgtctcagaaatattgtatttttagaatattaggtgtcacatcaatcatctcttgtttgaaattatcttcattttacccctaactacctcccacatccaattcattatttaatgaagagcatatatgtcatttttcttcctaatactttaccttccaagtgttagaaatgcacttgtaacataataacagatatagtactatatgaaacacaattttcgagggaaacccagtttcagcagaaaacatgtctatcaatgtagctaaaaataaccatagagcccattgaaataaataaagtgtactcttattggtgacagtaagtgcatttccagtggatagttttattttgtggtttccaatagtgcaacataatccattgaggcttgtaattatgaataaaattaaatatctccaatacactgtttcatttcgtggtttccaatgatttagtcacaatggactttcattctatttccaagatatagttaagtgcgtaaggtggtgtttggatccaaggactaaactttactccctgtcatatcggatgaatttggagtattaaacatagactacttataaaactaattacataaatgagagctaattcgtgtgacaaaatttttaagcctaattaatccataattagcgcatgtttactatagcatcacataggctaatcatggattaattaggctcaatagattcgtctcgcgaattagtccagcattatagaatgggttttattaatagtgtacatttaatatttataattagtgtctaaacatcttatgtgatagggactaaaaagttttagtcccatctaaacagggtctaaaccaagtttcatctagatgaaacccacttcttgtttctcttcataaatttcttgagtttagtttatatggcattggcatctcatttaataagattgaaaactattatgaaacttgcaccgggaatggcctaatatccattgagccaactcttgtgtgttattttaggaagtggactctcttaatgagatggaagacttaaggttgactttggaagtgagtttggaatatgatttttcagggtgcgcaaaatgtattaagccattagtgtataactaattgagtatctattatattattagaacaggtttgaaaagaggcaacgcgttcggcgtggacgctagaaactcccacattaatcagagaaaaagcaagttaagtatgaatacatttacaaatagctaaaattagaaatattgaaccaagagtccatatagaacactactagagattaattaaaattcgaaataaaaaaataaaaaaaaattgaaattagaaaaataaaaataagagttcaagtagaaatataatttagaaataactaaaattcggaatgaaaaataaagaatgttgagagaatagtccaattcagaataaaaataaaataaatttcaaaatagaaaaataataataagagttcaaataaaaatacaatttataaataactaaaattaaggataaaaaataaggactattgaaagaagaccatctacaacacaacattatttaaattttggacaaaagaataaattctaagattagatgagtgaaaatgagagttcaagtagcaatacaatttagaaataactgaaattcagaaaaataaatagtgcaagaacagtacatataaaatatagtatgaggctaaataaaattcaaaataaataataaaataaataatggaattcgaattaaaaataaaataaattctggaataagaaaaagtaatataacagttgaagtaaatacaatttataaataaaaatgagagtaaaaaatagagttttaaaaaacaatagttcatctagaaaataacgatgataaatgataataaagatgaaggagtaatgggcttataaagaaatagagtagtgatggtcgacgggacatctaaaaatataaaataaaccccaaaaatgattaggttcgatttttagaatcccaaacgattaaaaataggaccgatgggtaagccattaagcgacatgtatgcgacggttggtgggacttctaaaagtaaaaaaataaaccctaacaataattatgttcgattttaaaatgacaataaagaggggatgccatagaggaatacaatgacgatgtttgacgtgacttctaaatataaaaaggaggccaatgagacaataaattctaaaagctataaggtccaatttttaaatgttacaagataatgaatgtatatccattatatatatgtatgtgtgtatgtgaatcaaataaataggtaataaaggagtaagggatagtgacaggcgtgactattaaaaactactgcctccgtttcaggttataagattttctaacattgcccacattcacatagatgttaatgaatctaggcacgcatatatgtctaaattcgttagcatatatataaatttaggcaatgctagaaagttttataatatgaaacggagaaagtattaaattagaaacccgagatgataacatacgattttttaaagtcctaaggcaacattatagctatttaacaaattgtaagtaaaatcgtttgtaaaaaatagataacttcgtataggtgctagccacgcaattgcgcgagcaacccagctagttaattattataagttaaaaataagtttatttgattcttaaaagaaacatctatattaaaaaaagagcaaatttcacgaaactatatgtattttgatcaatctatcataaatagatttaagatattgtataaaaagaaactacaaattaacatcagttttaccacaaaagtacaatttttgttacctcaataatgctatggatataaactctaaaatttgtagttctttaataacttcatcacaaattaaagttgtagacttgtgatacaatgctttagatatgtggttgtatcataaatttgatgataaatttgtagttaaatctatagttttacgatagtttggttaaagttcctatagttttctgaaatttacttaagagaaacattgtttagcattttgggaagcgtgtgtgctaacgaaaatcaagcaagctgccaatacgggaccttagttttggttgggctgaactaaatggatatgcccttataaattgatagttgtttattctctcacagtgccatataattaatggatatctcaattatttcaagtccttaaattaatagctgatctatggtgtattctgttcctcttatctccttaagctacatcataattaatctaaggaacaaaattgaatagaacacgtaaagccaaacccattcaccacgtttaccattttgtcatttaacttaagtcacacgcataggatttcgatctagtgacatattataaccgtgcaatttgagaaaagaaatcgacttgtgcttgtaccagagtcagaagctgccgaggacaaagctcttgtcactaatcatgaagctgccgttcatcttcacctgccaggttcgaaaactctcctgtcactggtcatgaagtagccacatacgccatctaattgtccattattaattattgtacttaattatgcagtaatgcttctgtaactaattccagctgatacttgccagtactatcttccttcaattcgttgtttaatagatatatagcatcgttaatttttaaagttacctccttcattccaagataaattaatctaatataaaatatgacacatcttaatttacgaatttggacacatataatagtaagttaatttattttaagaggaggaagtacatcaaccattaatattattaaaattgtccaaatagaaaagaaatgtgctttaaatatatttaatgataaaccaagttaataaatagtacgtactattttaaatcagacgaacagtagttgtacataaaggtcgaaggtatttatgtattgaaaaaacggagtaacttccttgtaaaagaaaataatgatactggttaactgatgcactcgcagaggttcgacaagtccactgaccaagcgcaccacggcgacggcaagtgcctcgtctacgccaccattggcatggacgcggcgcgcgtcgcccggacgcgcgccaccgaccagccgcagtggactgaggagccgctccacgtctactgcgcgcacgacgccagcgacatcgtcttcaccatcgtgacgaccggcggccaccgcgacggcgatcctgaagacggcaccgccgaggaggtcgtcggccaagcctacctgcccgcggacgacgtcggcggcggcaaggagatcgaccggtggctcccgctctgcgacgagaagaggaagccactcgaaggccttgacaaggttcatgtccagctccggttcaccgacgtgatgtccgacgtcacgtcgcggtggggcaagggcgtcgatggtcccgtgccgccgccgccgtacaccgggctgccccgcgctttcttcgggcagcaccgcggatgcaaggtgaccctgtaccaggacgcgcacgtcgcgccgccgctcgccggcagcaggtgctgggaggacgtgttcgacgccgtcgccaacgcccggagtctggtgtacatcgccggctggtcggtgagcaccgacgtcgcgctggtgcgcgacccgaggcggcccgcgcagacgctggggcacctgctcaagtcgaaggccggggagcgcgtcgccgtgctgcttctggtgtgggacgatcgggcggccaccggcctcggcgcggcgcggcgggacgggaggatgggcgcggcgcgcggcgaggacacggcgagctacttccgcggcacgggcgtgcactgcgtcgtgtgcccccgggacgccgtgttcacgcaccaccagaaggcggtggtcgccgacggcccgcgcggcctcgtcgcgttcctcggcggcattgacctctgcggcggaaggtacgacacgcaggagcacccgctgttccggacgctcgccaccgcgcaccgcgacgacttccaccagcccagcttccccggcgcgtccgtcgccaagggcgggccgagggagccgtggcacgacgtgcactgccgcatcgagggcccggcggcgtgggacgtgctcgacaacttcgagcagaggtggcgggggcagggcggcgccggcggcgaggccctcctcgcccgcctcccaaggagctccgccgcgcgcgaggcggtggagcaggacaaccaggagtggcacgtgcaggtgttccggtccatcgacagccgcgcggtggaccggttcccggacaccgccggcgaggccgcgcggtgcggcctcgtcaccggcgccaccggcgacaccgtggagcgcagcatccaggacggctacatccacgccatccgccgcgccaagtacttcatctacatcgagagccagtgcttcctagggagctcctacgggtggaaccgtgacgtcgccggcggcgccgccaccgccaagaacgccgccgccgccgccgtggcgccgcacaccatccccaaggagctgtcgctgaagctcgcaagcaagatcaggtccggggactcgttcagggtgtacgtggtgctcccgatgtggccggagggcgtgccggagagcgccaccgtgcaggccgtcctggactggcagcggcggaccatggagatgatgtacaaggacgtggcggcggcgctcgccgcgaggggctcgacgcagaaccccagggagtacctcagcttcttctgcttgggcaaccgggagccgtacgtccccggcgagcacgcgccgccggagcggccggagctcgacagcgactacatgagggcgcagcaggccaggcgcttcaagatcaacgtcaacgccaacatcatgataggtactcccctctgtcccaatctatattacgtcgtttagtttccacataacgttcttcgtatgataaacttttgaataaaacgaatagttaaatacttaaatgttatctaaaaaatcaatggcatcataaattttaggacgaagagagtacattatatggaccagggatattgacaagatatggacatttgacaagaacacgatgatcaaaacgaaaccgttgacaatcgatcgccatgatttttttgcagtggacgacgagtacatcatcgtggggtcggcgaacgtgaaccagcgatccatggacggcggcagggacacggagatggcgatgggcgcgtaccagccgcggcacctggacaccccgaactcgtggccgagggggcaagtgcaccagttccggctcgcgctgtggcgggagcacctcggccaggcggcgttccaggccgccgccgccgccggcgacgacatgatctacccgtcgcgccatgggtgcatgagccgggtgaaccaggccgcgcggcagcactgggacatgtacgcgagcgacaagttccaggggagcctccccggccacctcatggcgtaccccgtcggcgtcggcgaccgcggcgagctctgggaggccgtccctttcttcccggacaccaacgccaaggtgttcggctgcagctccgacgagcttccaccggtcctcaccacatgaacttgtgctagcctccaatcacaataattaatatatatatatatatatatgcagcgaaaatgtattgcttgttgtacgaaaatatatgaggtggtgatttgtgaataaaaccatggtgtatgaaaatgcataaaatgcttctgctgcagttgtaaacatgaactgtactaatttatggatttgtgatatgagctatgaattcggatctggcgcctctgtgactgatctggctgcggtcaaccggcagcgtgaagatgtccttggagggcgacacgatctgagctggtggaggctacaacagcaggaaaactgacgtaggtgatggcagcgggcggccggtgtggttgacggcagcgagagacctgtgcaggcaatggaggctggtggaggccgcgcggtgtcttggcgatggccggtgacaccagctgctggcatcgacggcgggcgcagttgcgactccaacagtggcggcgacaccgatggtgggcgcgacagttggtggttgccatatgcaccaacggtaggccatggacttcgatggcgagcacggtgcactaaaggtgtgggagcagcggctggagcctgggaacggctggtgcaacagctgcctagctaagctgatggcggtgggtgactttctatacttagtgtttctatagggtggcatgtttgttagaatcatatggtaatgggaccacctatacatttgtcgacaaattttctcctaaaaatttgatagatgtaattatagtataatcgtagtgtaattacactgtaacttgtatgtaattacactgtaatttgcatgtaactacagtataacttgtatgtaagtttcacgtaattttgaatcgttagatctattacaagatttgttatagtgaggaagaaaaaaatcacagcacacacatatgtgaaaagatttgttcccacgacctccattttaccgaaataacatgttacagagagatttttgaaagttacattatagttacaatgtaattacatgcaaattacagtgtaattacactacgattgtactgtagttacatctgtcaaatttttggaagaaaatttatcgataaatatatagcaaaatcgtatttactaagcaatggcctaaattatgtagagaaggacttcgtaataatactgtatttttacaagaaagctaattggcacgcgctagctggcggcacggtcccacccccgcacggcgttttttttcccttttttcatgatttttttcttttgtttttgctcttttttctgattattttttaaacatttttagcacacgtatttttaaatagtttgtgttaaaagtatttaaatcatgacttgaaaatttttcaaatcttaacttaaaaattttcaactctcgagttgaaagtttttgaatctcaagttgaaagtttttaaatctgggttgaatattttcaaagttgagttaaaagtttttcaaatttgagatgaaaagttgaaagttttcaaaatttgactttaaaaattcaaaattcaagttgaaagttttaaaatctgggtttaaaattttgaaaatttgacttcatatatagattttcttttcaatttgttatttaaaaaaatctcgcgggaaaaagaaaatcttattatctactaccgtcattatctcaaacggttattatctaagactaatagattagtctaactaccttatcccaaagaaacacgcgccggcagacgcgccaactagcgatccccgtatttttatctcttttacctagtgagcagattaccattttattgtgttcaaaaacaaaattgttccttagcggtgagggagtaatttcttgggttatggaaagaaatagattgataaatagtgaaatgcacatgtacttacatatagttacatagattaacaactatattttgggagggaactattgggtgtggaaaatagagttgggcttatgactatattgttgaagatcaggcccaaaacatctatattggcgggctcaataagaagacaacataaaaggcttcccagccttctctttttgaaatttcaagttaaaaggaaaaaaaagtttatagaaacctctctttttctgaggatgctctatgctactacttcctatcaagtagataccaaaagttggtgttaatattgagcactccctggaaaatgggaactaatacttataatagtgattagtacaaaagcatcagtaccagactctcagttgtcaatagcacagtattcatgatcattctaggaaagaatcatatcgatcttgtttgaattaatgattctgattcatgataggcaggtgcagaggtgctggcgttccctgcaggatattgcaatgttttgtagctgccaaatatcatcacacagcatgacaaccttgtcgctgcccaaaaaaaaaaagcacatactattagcatatactccatataatataagactgactggtgaacctatttgctataaataccctactaaacttcgaagacttttccatcaaaatacccttcgaagccttaaatcttcagccactactacgaaaacctttttcgtggcggccattttagattttcgctggcggaatttggagccgccacaaagcaaaggccagtgaagatcacgattttcgctagcggttatcgaccgccagcaataattcattttcgtcttaagacgaccgccagcaaaaatggatctttgttggctgtcgtcttacacaggccgccagcaaaaattcattttcgctggcggctgtgttaaatcagccaccagggaaaatatattttgggaaaaaaattcgcatgcagctgcccagccgccagcgaagatttggagaaaagcccattgattcatttttaaaattcaaatccacatctagagatgtagattctaattcatatacatatggctgctcatttccaaattcaaacacaatacaaaatcatcattagcacaaaatcatcattagcacagatgtacacagatcaaacatcacaacatgcacaaaacatctgcatcatctagatcatcaggaaacatgcaaaaaaaaaaaaatcctaactgagctcgtcagatccgtgccgctgccggtctctcgtcgtcgccacctcaccgccgccggtggggaggaaggaggcgcaggatccgctccccgtcgcctcctcccccgcgccgctgacgccgagagccgctgccgccgccgcccccttccccgcgctactgccgaggcctcatcggcgtcggcagcagatccggggatccggcctcccccatcgtcgcggcggtggatccggccaccctcgtcgtcgtggcggcggatccgacctcccccgtcgtggcggtgacggctccggcctcccccgtcgatgtggctgcggattcggccacccccgtcgtcgcagcgacggatccaaccacccccatcgatgtggtggctggatccgaccccgagcctgcggtggagaggcgacggcagcccccggcggcagtggaggacggagagggagaaggagagaacgcgagtgagaaggagagaaggagagactgaggtaggggtggtaggtggtaggtgcggtgggtttatatattcgccttaaaactttttcctagcggtcccttttacctaccgccagcgaaaacgcgatttttgctggcggacacttaaaaggtccgccttaaaaaatagagttattttttatggcagacctcttagcatggccgccagcaaaaatcggttttcgctggcggtccgtaaccccctctccccttgttatatttttgctgacggtttttgcgtatggccgctagcgagaattatagggtaacgccatgaaaaattatttttctagtagtgagccacatcttgagcaaattgaagctaagagcattggttgtccttaataccgattttggacagttgttacaaagagtttgataggtttgccttttgaaattggacaagataaagcttgagtgaaataacaacgaaagtattggctggattgttgccatttcgcatgattttcaagtatccgtagcggaatgctagactccgggtattggctggattgttgccatttcgcatgattttcaagtatccgtagtgtatattttagtggaattctagattccgggataccattattagcgttcatgacgggatcctctcccaatctcacgtggctatgaacaaaaaatgacactgagaacacaatatttcatggcggccattacggcgcagagacaaccggattccgcgcgaggtagcggtgtgatggcgcggtggcggacaccaccgtcgcactgcgcagctgcccgcgccagccgaggacagcggcgctgcacggggcttggttgtcatcgctgaatcaaaaggagaggtcttgcaccaaggaacagtgcaggctcggtgtcggagccgatggatatgggttgtggtgacggctaggatggaattgtcataggagtggatagacgtgacggctgggacaaaattgtcgtaggagtggatagacctagtgcgaggaggattcggctaccaatgacgagctccagcgtggggcgtggactgtggaggacctacttgcagaggacgcaaccatcgacgatgagctctggagtgccgtgtggatggaggacctgctcaacgaggaggacgtggccactgctgacgagctctagcgtgggggcatggacggtggaggacctgctcctcgtgaactacatttgtcgcccacgtggagtatcatctgatacctcgtaagtatcaccgacacttcatacaaatcatctaatacctacaactatgagaacccaagtatcatgtgatacctcgccaagtatcacctgacatctcataggaatcatccaatatctataagtatcagaatccgatatcataagtatctctttgtacctcgtaagtatcacccgatacctcgcaggaatcatatgatacctcgtaagtatcgacgagtatcaggtggcatcaacggatatcaacatccggtaccaataagtatcagtcaatacctataagtatcacttgatacctaaccagtatcatcttgtctgaacgggttcgttgtatagcagcctcctaattaattctagcccactccaaattcaaagaaaagatgaaggtaaaatatatgtactctttgtgttgcatgaatgtactggtgctaattgtacaacttacggtcataaatatttaatgctcgactttttccatagctatcaaaatacaactctgaccacaattttatattggaataagttgataaaatctactaattttatcatattataatagtacttgtcaaggaaaatctacaaatgccattattattttgaacaaaggaattattacttctggcctttataccaactaaagatacatcaaccaaatttatatatactaggatttgaaccctggtaaattgagccatgtatccacgacttcactaccacactaatagtgaactaagcatttaaaagttattgaccaaatttttgttctaaatacgagttttgctaagctcaactataaatgctactgttggtatcctgtagtaagaaatgagtgaatgggcctggtgggacacaagaacatgcagagggctcaaaacttcaaatgctcaactaccatgccagatattgggccagtgacagataagttgattctcaacttttcacataagaaatcatcttgctcttcttaagttccattgatgcacaaaacaagaaaggcaacaacttttttagaagactaacctttacttggatacttaacttggatcttgcatttgcaatacaatctaagttcatggtaactagcctgtcctttctttgatgtatctcaattctcaggtcacaactcacaagtacagcttggcaagcttctcatcctttggattgttcatgttggcctttacggttgttggctatcaccatccaaacccccaaaatattaaaagaagggcaattttgccatggataatgactacctgttaatttaggcggagtagtatctttcccctggtgttattgtgaaatgatgtacttcgaatgatactactctaaagtggtgaactttggacggtataggtccaatctttcattcgattaattacatgtgatacaaatcatattaataatagtttaattcgactggcaaaccacacgaaattagtttaactcctatgtttaaatataacaaagtgtttgaaaataaaatatatatagtcattttctccaagcaatccatgtattccaagattccaactactaatttgagttgtcttacttagaaatatatagaaacagcatagcccaaagaaagttgtgcaagaatgagataaattggtactagcattttagcagcatgtaaaaaattatgagtaaatttcagaaaaccccatattttgtcgtcaaagttgtggaaaaccacaggtattatgatgtgtggcacatcacaggttttatggtctgaatgtttcataaaactccgcaatttttgaaatcttgataaatttcaacatatcttaaacaaaattttggaagtagtaaaaaattaaactatcgatcttaatcaagaaattaataattaaaattttcatttgcactctatgttttaaaattttaagtaaattcgcgctcaaaatgcataaaggtggggttttgtgaaattttaaaaccataatacctagattaggtgtcacatttcataatacatgtaatttttctttaattttgaccataaaaaaattaggttttatgaaatttacttaaaaattaatgtaagtattcaaaatcaagctagtacgtaccatccaatataataccaagtacaccagatccagtaccaacggctacgaccagatgtccctttgaaggtacgctcgtcgctggctcactgcacatcgtaggctgtcttgctgtagctgggcagttgtacagcggacaaaaacgtactctcctctttcttccattcacagaaagattgaatgaatgaacacagtggtccttccatagccacagacagtacgtctgaagaaaacaagacagtcaatgagggcacactgggtagttgctggagtaaaattcatcagttcttggacccagctctgattcacaaaagcctccatgagaactggtagtacacagagctgcagaagcatccaccactgttctggaatcttggatgatcaggtccctggccacataaccaccaatgctatctcaaattccactgtgtggcttaaatggcttgctgggagaggctgttaccatcaatgaacgccggccctgctcaaccacatcgagtgagtacttcatgattagtgtcttctcaggctgtctgctaggtgctagctccctagagctcactgacatcaacatcgatcaagcctccccccctaactcgtgcatttgtgaaggaggttaggatgcagccatcagctctgagtagacggtccatttcattgggggaggggggggatcggagtcaccacctcctaactgagttgcttcattcagtgatggacaacctagctgagaggacaatggggaaatcagttttctgacgaatcacaaattgcatcctgaacatctcacttaaacattattgcaagctgcaatgcagacagatacaggtaatatttgcaccctctgggctgtcctgtgccgtgctgtggatgtatttcgaccacagcttctcctgattgttgtctacaaaataagcacagagaagagagcattcaacagcaatgtggttttaaataacatggcatcaaactattaaaaatttgtagtcatatgatcacaagagggatgcaagacacaacttcagtttaatgagttcggtttcatattttctgctcctatgttccagtgaagtacttagaatcatcaggcaagaaaattgaccagcgtcctttgtcccttttaataactatgttttaggcgaaattccgaactaaaaacgaaaaagataatcccttctttctgacgcacttttcgtaaagatttgaactgtaatacagcttgatgaggacattcaaaccaacattacagtaacaggtaatgaacaagatacacaagtaaagccaagccaaacaccatttacaagaaattcaagtccgattacgcgcagtcaggcaaagaagctacaacaacagatttacgcgctactttctgagatgcatttccatattgatgagaataatatactacctaagtcatctacacttctcttactcaggtttacgtgcgaggatcctccaaagggagtggtttacgagaagaacaaggttaccacaagctaatggaagcctctgcttccaagaataactcagctcagcctgcttcgaatgaccaagcatgaaacatatggatggaaagcctatcaagtttacttttatatgcaacaaacgaattgtcatttggacttctaaggagggagttatggccattctactgaaaacagtccagcaatcaaagagccgcgcgagaagctgaagaaacctctcgatataccactataatttgcccatttacctcccaacgtgatgagttgtgttaacactctgttgggagggttgttaccactataaatacttccttatagctaccatttcagcactttttgatcactggataaaccaatacattatattgcagctgagttgccgagtgacttactcctatattcttgtgagttcatcctgggcttgcaagaggtccctcctggatcccctaatttgtgcttttggcttccgggtctcttgtgtggattagtttcggtttgtggttctgtggtcgtttggagattaggtcggagttcaggaggcttcggatcgtccctccccatcacttggtcgcaaccaaccttaacaggtataaagctagttacccctgctgttcacggccaattacctgtcaatcgtcaacctactatcgtgaagatcgggccatcctagcatgttcgcaccacagctggtcctttgtatccatcgtcttctgaaggcttctgcttgtgccctgtgtacgtttgggggcaagttgctgacaaaaaccaaagttttcgggttccagttgtatgaatgatctggtaggttctcatggtcccctacaaatttcaagctatttaattgcatagaagaggttgagatctaccctcacataaactgagaattgtatgcactacactcagaatcttaacaggtacagtaactgtctgttacatgaaaagaaaatccaacattattaaataattctcaccaattcccttgaaagaccacaaacctcactaaactgctggggtcattcttagtctgctcacacttttcagaaaaacacatgaacaccatcgtggttgcaaaggacgaaagaacaaaacagaggatgttatgtattatagatagctgttatactccagattgttactattatagtttagttctcttcttgctggcaccaaacaattttggtagttgatgtcatggccataaatgcaagctcctctctttatgaacaccgtttcaaaggttatttggatgtctaatgacatttttttaatacacggtactttcaagttcatatcaataagttcaacaaatacggtccatccatatctatcatctttacctctgacaaattatctatcatctttacctctgacaaatacggtcctaagcttctaaacggtgcgatttttataaaagttttctagaaataagtttcttccaataatttttaaaacaacttttacaactttgtaatagataatttattcgtttgtacccccaaaatattatcacaaaatcagataatccatcatccactcagaactaaagaacaaagaacagggccaacaatgccttcatctagggtgttgacagtgttgtcatctgcgcacttaaaaattatagcgttttgtgatctgcaaacttcaaagttacaacgtgttgtgatctacgaactacaaacttataaccaactgactgactatgcaatattaccattatagtatgataatgacaacacatatgcttccggaaatattgacaatgcaatggtagtacagtaccattttctgtactatggactagagaacctagctttactagatcccagattagtttcgaacaccttttcttgtaacacatgacttaaccgatgtttatctttactagcatggaaaagggaggttaagatctgtacctttctcccgagtctctctcctgcccagacagtcattttatcagcctgaacattgtcttcctttgtaacaatctctctgattttatttgttgaaagcaacatcaatttgaggatagcgaaggtagagcaatatctcagtataaactgctgagcaacaatgctgaaaacccctgttccgccaaaatctaatttggtctaatgatgaaaacagctgatgacagcaataattgtctccagaagccctaatattagatagtgatagtaatgtggaggcgtggagctcaataactgagcgaaaagttttaacaaaattctatgcatgctcaaactttagtctcatgagtccattaagcacaagttaggacctaataaaacaatttcggttcgtcttaatagaacatgtctttttcatttttttgcacctgtcacagtcaatcaaccaagactactttcactgtattttaaactattttcacttgagtcatgagctggatctgaaatgcttatcatataacctgttttcccatgatgtttcattataaaatgtacatataaatttgttaggtccctaggaaaccgtttatgagtagtagagtataagctttctaaggcacatcttcagtgtatattctattgggattctgactaccattgcactataaatctataatataaataacaaaaatgttgcctccggcactaatgcagtccactttcatgcttttgaggacccatcctctttaacaagttttcaagcattctgaacataacgaatagaagtgcagacattaaggctttggacctttcgtactgaattggttatgcagtcaatttgaatatgatgcaaatacagaagggaagtaaataccttggctttaaactgctactccctccggtttcattttaattgacgctttggacaatgacatgctctacaagatatacctttgaccttatttttctattataatatatacaataaataaatgcatgtttacttttattatagtgttttcaaagacaaatctatatatgtttttctagtttctttaaactaaatatttttaaagttattgatggtcaaagttataaaagtttaacctcaaccttgtcgaaaacgtcaattattatagaaccagagggaagtaacccatatgggcacaaaaatagaaacattaattagagttcaaatgagagtaagaaatgacagataggcatagcatgtccttcttactattgttacatgtaatcaaggggtgatgggcatattcacagtggtttagctgtagttagttggctgatgagtccataaatctaagtagtactcgaagtttgctgcctctgcattgaatagcacttaatggtatgggtgagctctcttgaatgcatgcacacagtggcactcccaatctcacagtgctgcatctgtctacataaacgattggaatgcatttgggcaagactgtgaggcagaacagaaatcagagaactgaggacagaaggcaagtaggaagaatctgagctgtctgaatggaagggaaaaacaactagggggagaaaaggaaaggattatccaagctttcgtgtatcatccgagtgtcccttgtatgcaatgggtttgatcaatagaggggtcttcttcaagatcttggccttcctctgcttcatcagatcatctcaaggtacattcaatctatttcagttcatatgttccttaagcgtcagcatgaatcattttccttcgacttcctttccactaaaacgaattcagtaggattttatgatggtcaaaggctggtttctcagagatgctggaatttgatcactcaaatttcaataagctgcttctatcaaccatagctttcatcatgacattttcatatttttatagcaaaaatggagttcagaattttggctgacactcagaatcataaccatgccatttgcaaccaactcctgtttatattactctctgatttcactatttttcgttggccagaaatcttaggtatagagcgatgcaataagaaatttgcaggaagaggagagggcgaaaaagacataccttataatctcggcctgtagtgaatattcagaagaaacctgatgaatggcaatgcagcatttagcttaaaccgattgagattttcttatgtataaagatataaaaggaagtgataaaaaccgtacctgaaactgggtagcttcagataaaacatgaatacttgtatttgcaggaagaaatcattttaccacattggatctccctcccctactgaaggcaagcagtttctccagaatacagcatgaggcatatgactacatcattgttggaggtggcacagctggatgcccattggcagcaacgttgtcccagaagtacaaggtgctcttgctggaaagaggagggtctccttacggcaaccggaacatctcacatcttgagaacttccacatttgcttggcagatgactcgccaaattcaccatctcagggatttatctccactgatggtgtcatcaatgcccgggcaaaggttctaggtggtggaactagtgtcaatgctggtttctacagccgagctgacccaaggtaaagaatttatcatgtatatagcattctacacatggcctgtctatctgttcaaatttatttttcacttatctctatgaacttaaccattgtcgaagaagtagcttccatagcgtgcataataacctcagatgaaaaatcagctgacaacttaaggcaaaaaacagggataattctgaaatatttataagaagcttagccaatttatggtgtctttgcatgtcgcgttctctaaccagcattttatacttgtgtcttaagcaattaacataagcttccactctgaaggtctacagatagccaatcaaagaagcctaagttgtaccggagtcactctaactattaggcagtgtattggctacttctccatgttcatgaacttactagtccaaccaagctatctcagtttccatttatacccatcaaagtacaaaaatactaccttgaagacagtcataatgggcagaccaaaaggcaaatcagggaacctacccataacaaattccaacatgtaccacaacagatcccataactgtacctcactgggggaattattatagaccttatgccttttggttgagttgtgaactcaggacaagatcttgaatcaaattggagatactccagtataaggatcgcaatgttggattgagttatagaattgaatatcctatcagattctacaaacaatacattgttccaaatttgcatgcttttcaacaaggatattttcgaattgtacttcagaaggttttagttttgccccagatgtacaaataatagccgatcccatgtataaaaggtgaagccttgcaagttgcaacttaaaggtcagctgcaagtaactattgtttttctagggaagtgaatacttattttcaattactaggattggtataattgtgaccatgatccaaaataatctgctagaagcccatgaataatatgattatatcaaattaagatccttcctatgttcaaatcagttcaataactgtagggcataagacctgaattgagattacaaacaattggttaggaatggcttggcacaattcattaatatatgccccttttttgaaattttaataaagtaagaatgtaattgttaaggtaattgctgaaatcccaactataaggttagcataagatgtgctttgcgcatagcgtgagcggctctaatggactgatattctcatgtcaatattacttttagtgatacagtaatgctaataatatattaagaatagaaaaaagggttcactgatgaatgtgcttgtcctgtagctttgttcaagacgcaggctgggatgcagagttggtaaaccaatcatacccttggatcgaagagaggattgtttattggcccaatattacaccgtggcaagctgcactgcgggacgggctgcttgaagcaggggtctcaccttacaatggatacagctatgatcatctctttggaacaaaggtcgggggaacaatctttgatgaggctgggtacaggcacactgctgctgacctccttgctgctggaaatcataacaacctcagggttctccttcatgctagtgtgaccagaataattttcaacacagaacaaggtaagaattaatccaaggcaggcctagctcttataatccctatccactttaacagcagacgcgatagtaacatcatctcttgcacagagcacaggaagccaaggaccattggtgttgaattcaaggatgagaatggggggcagcagcatgccttccttacccgaaacagagacagcgagattatcatctctgctggtgcaattggcagtccccagctattgttgcttagtggaattggacccagaaaggaacttaaaaagcataacatttctgtagtccttcgcaacgaacatgtgggtaaagggatgtcagataatccaatgaattccatctttatacctaccaaggatgcccctaagcaatcactgattcagactgttggaataaccgacggcggggcgttcatagaagccagcagtggtttcagccagtcaccagatagtatccagtgccaccatggaatcatgtccgctgaggtttggcatcaatttcaaagactttacttgcataaaattttgaattctttataagcatcatggggtgttggtgtatatcatacaaaagcttgtgtagttgtgtacataaacaacatccacatcagcactctcagaaaacaacacacgctaaattagcttgtcaaaagccatctttagtttttggtaagcaacttcattaagcttatcttcaggagcccaggattaagatatcagaggaacccagaatctaccaacatgtacacagaaattcatctcaatggttttaaactagagtaaattaaggttttaaagcagagtttcttctgggattatttatggacaaaaaattgtaataataagaaacttctttgaatttgtaaaagccaaaaagaaaaaaacgttaagcttatttacttttgagaagcatgctaactttcaagcttatcatccctcatgaattttgtcactgcaatgtagattgggcagctgtcaacgattcccccaaagcaaagaaatctagatgcagtcaagaagtatgtacataaaaaatataacctacccaaagaagtattcagtgggggttttatactttcgaagattgatggtccattgtctactggtaatctagttcttgtggatactgacatcaatagcaaccccacggttaccttcaactacttccagcacccaaaggatctcagtcggtgtgtctatgggatcaagaccatagagagaatactgaagacaaaccatttcactaattttaccctcaatggtggtggatatccaatggaagtggtgctcaacatgagtgtaacagcaaacataaacttgatacccaagcacacaaatgacagcacatccatggagcagttttgcagagacacagtggtcaccatctggcattaccatggcggatgccatgtgggcaaggtggttgaccaacaataccgtgtgattggtgtctcaggccttcgtgtgatcgatgggtcgaccttatttaggtcaccaggaaccaacccgcaagccacagtcatgatgatgggcaggtaaaggcaaaaacaaactatagtactctcctttaatctacaaaattaaatttcaagggttgatctttcttttgtcatattgtctttcatggtcagatacatgggagtgaagattctaagaagaagattaggacgagctgctggagtataactgattcttggaccttattgattatgtaagaatgtgacttaggaaaagaaaagtatatagtaatttttgaagcaattcaatatcatatcaccacagaaagaaaattaggagttttcgtttgtgttctagatgtggaaatctatggcatgtaatatcatctattgacaccattgtttctgcattatgaacaagtaaattatattacattgtaattacatgaactgcaaagttctactacctctgtttcacaatgtaagtcattctagcatttcccacattcatattgatgctaatgaatctaaatagatatataatgttacattcat

SEQ ID NO: 63674 - DNA, 1663 bp, Oryza sativa
aattcctgcagcccatacgtacatcgagctctcgtgttgtgcatatttggtttgataggcagtgggcatactcacatacgtagtagctgcataagttagttccctggttctgctttgcacactacataagaaacgatgagatatttaatatactatttatattaactgtaattagagattcaattcaatataattttggatcatgcatgtactcactggaaaatgaaacctccatccaagtttttctttccaagtcccgcggaccaattgacggaaccgatcccaagccatacatatgcagttgcaagctatgattaattaattattacccgagatcaacataatagcaatagattccccgcgactttggaatagatggcattatattacctgtctatcagttggaagaccttttcaaaaatcttctcctctttattcattgagtcgtacacagtgactctgcatgcgtccaagtcgaagaataacaggacccagtggaatctgaaatatgcgtgagatgatatatatatatatgaaaatgtacatgctatatgtatgggaacaaaatttgttcgaactacaataaaaactcactctgtgttgtacggcagtagtatgtacgtcttgaaatgctgctacgttaggagatggacgagattgtcctctgtgtctttctcgtacttgtcgatcatttcggtgttgattttccgagggtcgatgaacctagtatcgtagaccctccgccgtcgggccctttgaatctctattctacaatgatgaatggaaattattattgcttacatatatgccaggagctaattattgaacgaaacaaattgaactcaaagatactcacaaaatccatgcgctcagaagagagacgtcgagggcatccagatggtacagatcgaagagatccttgaaatggatccagagaacatcttctccttgcaagaagtcggggtttctgatcctcgctctgaacatctctctacccttggcgctcatttccatgtaccgttcatggaatttgtacatctgtgtcagtagggactgcagctgctcaggcgtgacaagcagtttccgaggtttaacttcgtatgccctttccgccttcgggattgatgcgcctcgaatcagctgatccacagttagaccggtgtctgaaatgaattccgttataccaaaatcttggctggtcaccaacggctcgacctcgtggtttggttgttctccaagctgaaggactggtttggacttcttgtgataggctctctgaagtgttcggtcatagtccgatatctgtaaggcctccttgtttgttgcggacattcccttgaagaagttcttcatgctcgggtcaataggtatcttctttttatgactccgaggcttgagttgcctcttcacttctcctgtcacataagcatcaagctcctcttgactgcaatcgtacggtggctccttgtttttggtggcgtcaactttcgccttcttcgttgtccttgtgcgggcaggcggtggagcttggcgagaccttgtcttgggaggtgcaggcggacatggtggaggtggaggagccagaggagccggaggagatggtgcaggaggaggtggcagaggagccagaggagatggtgcaggaggacgtggcggaggaacc

SEQ ID NO: 63675 - DNA, 2449 bp, Oryza sativa
gcgtctcaccgtctcctcctgggtagtccaactcgaggtcctcgtacgcggcttccaccagctcaacttcgaccctcgagtatcctgctggaatcggtctgcagtggtaagtcccgaaagggtccattgggatggccaatcccgacgccaccttcacgtgatgagaggttatttattagtaatcaacctaagcagcaacttgcggaatgtacaagtcaaaaaatcatcaaactacgagcataccttgattgataagttcttcaagggaatatgcagctcacatggtgtccgctgcatgatctcatcaacagggcaggtggtttcgtcctgggtttgcatggcgtccatgctctgtgattctacctgccccgttaaggcgcagctgctacgattgcctgatgggctgaccattgcaggaggaatgtacggctggggatcctgggaccgatgtgcggccatacgttcatccaccttccttgccacctcctcttgcatgctgagctcgtagctcgataccctgtactcaagatctgcaatcttcgccctggatgctcgggagtctgtagggcgagtgacagcttgtccttctctctgtcgggtcggaatgtgccctgagaagaggcttccactgcgtctgttagtcgactggcagcctcgtatatctgatcgttgaagacaagggagccatcaactgggttaagcgttccaccgtgagcatagtaccagaacttcaatcgatccggccatttagcggtggccggttcgatacccctctcaatcaaacttgcctctatctcctcccacttcggcattgcgacgctatatccgcctgaccccaagtggtgatggtacttcttcttggcggcattttctttgtttctgtccatcatcacttgcccttgttgcccagtcttgtaagcaatgaactcgtcccaatgatcccttagctttgggaatacatcaaaatttggtgttagtcccttcaggatgtatttcttatagagatctcccttgaagctctggaattgttctgccattttcctcagagtccactatttcactatgttctccgtacccacgggtagcgtgaacgtctcgagcattgtggtccacagcgtctctttctctgagtccgggacaaagctgtcattatccccgcgtgcccttgttctgcgccagtacaccgtgctgacaggcacgttgtccctcacaacccaaccgctgtggcgtacaaaattcttggctgcttttgctggggcactaggtcggccgtcttcgtccacctcagttatgatgtgacgaccctctatcttcttcgtggcacctcgttgtccgcgtgccctcttctgttcagtggagggatgacttccactagcctcctcctcatcgttcccctcctcgttcccctccgcatccctctccacgttcccctcctcgttcaagtactggtttggatcctcgttcccctcttcttcgttccagtactggcagcttccctctgcgattgtatcgtacagtatctgtttctcatcgcgatcagccatctgtgcatacaaaaaatatttgttaggtctataggtcatatttgctaaccgtaatattaaaactctactaatcttatattaaatctctactaatctcatattaaaattgtaataatcatatatatatatatatatatatatatatatatatatatatatatatatatatatatatatatatgctaagtataacagtcttatattaaatcgctactaatcttatattaaatctctactaatctcatattaaatcactactattcttatattaaaattgtaataatcatatatatatatgctaagtctaacaatcttatattgaatatctaacaatcttatattaaatcgctactaatcttatattaaaattgtaataatcatatatgctaagtctaacaatcttatattaaatctctaacaatcacttctttacgtcacttgtgtgctcgaattccttcgatggctaagtaccacttccgcttgagggacgacaacgacgtcttctctgcaacattaccaagaaaatgtattattctaaacgggccaagttacatatatataatcatatatgtattaccaggaaaatgtattagtctaaacgcgtccgttctcacacttttagtacaagtgcattcacgttcgtaagcgcttcgttcacattcgttcacgctcgttcgcgtttgttaacatttcgttcaagttcgttcgtgttcgttaagcgttcgttcacggtcatccatgtatcgttcacgttcgttcgcgttcattcatgtttgttcgcgttcgttcacgttcggtcacgtttcaatcatgttcgttcatgttcggcaatgttgggcgcgcgcggaaatggcgcggcagcggcgtgacggcacggtggcagcggcgtcggggtgccgtgggcc

SEQ ID NO: 63676 - DNA, 3175 bp, Oryza sativa
cagtgcaaaaaggaacaaaggtaaaataaaaggaaagtaaaaatcccaagtcctgcgtacaaatctatagttcaagacatacacatcgccttccaaccgaggtcgagttgccccggtgccatgtcttattcgtggaattctatgtccaagtgcatactttgcgggggtaaaattttctacacgtatgttgccaaaatttctgctaagtttttcgtggccaactcgagaaaattcttacacagccagtctataaatactcacacatttcacaaaaaaatacttgcaacatcaaagctacacaggtagaatcatcgaccgtaagtaagtactactcctacgtacattaagtgtgagcttgattaactatggaggtatccaagctggccattgctttggccatggtagccgccatggcactcccctcccaagctcaaaactccccgcaggactacgtgaggctccacaacgccgcccgcgccgccgtcggcgtgggtccggtgacctgggacacgagcgtgcaggcgttcgcggagaactacgccagccagagaagcggcgactgcagcctgatccactccagcaaccggaacaaccttggcgagaacctcttctggggttcggccggcggggactggacggcggcgagcgcggtgcagtcgtgggtgggcgagaagagcgactacgactacgcctccaacagctgcgcgcaggggaaggtgtgcgggcactacacgcaggtggtgtggcgcgcgtcgaccagcatcggctgcgcccgcgtcgtctgcagcaacggccgcggcgtcttcatcacatgcaactataagccggccggcaacttcgtcggacagaggccttactaagttatttatacacacgggcgtacgtactggctagtactacgtatagtagtgaataaataaagacgtgaaaatgtaaacaggtcagtgtctgatccacgccttcacggtccataccgaggattctataaagcgtcatgtcgtacaagtaaaaataaatagtactccctctgtttctttctgtttcaggttataacacctattaactttggttaaagttaaattgctttaaatttaactaagtttgtagaaaaaaaataatagcatttttaacctaagaaaaatttattatggtaatatattcaattattaatttaatgaaactaatttgatactataaatattactatatttgtctacaaacttaatcaaacttaaagtagtttgattttgacgaaagtaaacacgctttataaccttaaacggagggagttgtaaaaccgtctaaaagcatgtgccagctgctagctgatggtccattccatcgtcgcacttctctaatttgccttgtcagttgtcactgggtaagttttcttttgaattctttagggtacgctcaaagacaacccaaatatataattgttaaaaattctaaaaaaaaataccgacactcatacagtataaataaactatttaacaaaaatcaagtcaaaacttaactcacacatcgagaaataaaaatctctagtacaggatagctcatcttaatcggacggcaagcctcatctgtgtcagggagaagtcctgtcacgaaccaaaggtatcgtatttgttttgatcgcaagcgcatgcatactgttgtgagtattccaaatgtatcgtatttgtttttccgaaaggaaaacggcggtgtaaagagaaagttcatatatttgtaatcatgcatactataattgatataccatagtctaaacaggattaattgataacaatgataattgggtagtgtgatacaggagattcatctctaataaatatagactaggtagggtagtgcagaaggactaaagagagctaaggttcatatgcacttttatatgaacatatttagtatacacttgatatatacatgcttacaaggctagtaattaattctacgcatccaggtgctactgaaagatcactacctgctgatctgttagcgtggttattgcattttacgaactcttatgtcatacctagacaaaaaggaataaaaaaaaggacagggttgtcaccaccagctatctacctcacttttcgtagggcatacccgcatccaataccatttatttaacctaagcaccatattttatgttaataaacaatgtcactaattcacccgggacacataccatttggatggacaagttagaactagtgcaacccattaaaatcattggacaattaacgtagtatagatcgactagccaaatcaagcgaagcatataactgaaatgtaaagtattcataaaacacgtaagtaaaatagtatatgaactatgtacacaattaaataaataagataattcctttattacatctctagtcttacaagaagagtaacgtactaaagacatatcagaataaactataggacggaaggctgtgttcttttcccctctttcccaactcacttccctcattttccacacgcacgctttttaaactgctaaacagtgtattttttgcaaaagttttctatataaaagttgctttagaaaatcatattaatccatttttcaagttttttaggttaatacttaattaatctcactataatcgtgtgctttgttttccgtgtcgggaggcaaggttgggaacttgccctcccgaacatagcctaagcctagctccactactactagagagaatacagtatatggaatgaaagaattgctcctttaggtgtgtattgtgaagtgagagagctcctccttttatggttgggaaggtcggtaactcccataaccgtcattgagaagccaccaaggagcaccacgtggagggtggagatgagagggagtgatggaggatcggccgaaccctgggcccacccctctcaaccgcctttcacaagggactgacatgtgggctcctatgaagattaaggatggtttggccccacattaggttagttttaagctgcctagtgggcccatcgatctgtgtacacgcacgtgattcgctggcggagtgtttccttgcatgccgactcatttctccttcacttcagtgtttaatacctacatccatagtaattctccaagaaaagtggaactacattatttataactaatatacacatagaaaatattagttctctctttatttattga

SEQ ID NO: 63677 - DNA, 1061 bp, Oryza sativa
ctgttgtagattgagttagaatctaaaaattctctcctaagtatcttgttatgatctcaagtgagcctatttttcaaaaacaaaaaagcatgcgcgcgcgcgcgcgtgttattagcacaaatcatctaaaaaatatcttaaacgaagaaaaaaaaatttataattgcttcaggtattgaggaataagggcagctatggcagcagcatttcattttatgcatcttacaatcattttcagtttgcagtaatcatatcgaaaaatcttttgtataatttagagttgtttgtactagaacaataccctcagactcagaattaggaaaatggtagatattccaaactaattttcagaaaagtatcatgattgacattacattgattgcagcagtttattgttctttccagtataagatttgcaaaacattcttaaatatgtgataatcaaaattatgatggcttcaatttataaataccatatgcgcagaatatattagctaattaaagattcaatactataactgttgggatacgcgtaggctacgatagcataaatcaaaattttctatcgcgtaaaccaggaaacatgcaagtattagatcatagatcgttaccactcaacgcgctgtgcagcggaagaagacgctgagaagtcgaaggaactctcgcgaagtagcgcgcgtcgatgtagaggaagtagtcgatcgcactggctcggccttctcctcctcgtgcgttctcttcgccgtactcccacgccaatcagcaccgcaaaccagcggcgcctctaccagtatccacacgtacagggacggaacgccacgtgcagatgtgctagcacccgcgcgcggctagggttttgctcgggtagggaagtgacggctagggtttctcacatgatgcaatacctccaccggtcacacctctcacgaatatataggatccatcactcgggcctccaaggcccgtaggactactatttggatccctatccgaattaaactcatattagatctctatccaatccccttatttcggcccattaagtggggctgcaggaattc

SEQ ID NO: 63678 - DNA, 15862 bp, Oryza sativa
aaaccagtcacacttaaatagagccacctttagatcacgtatcactgacatattccaactctattatctcctggatagtgccatagtagtcaggcccttggttatcaaaccaatttgctgacacacaaactccactatttgtcgttgtcctcgttaatttcttttgttcatatggttgtgtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaagccaggttggaaaatctttctcatgcatctcttgtaattgagttgtagtgatgttcctgttttgttgtttcatctccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacgtgatgtgctctttccaagagtgcgatatgggatagagaatatagacagccagtcagtaggtgctctgaaaccaccatcatcatgtctagggacgcgagtgtgctttgttcgcacatgatcagcaaagtacatagaaataaaattagagacctcctgtaccctatacccctctacaattgaaccttcgacacgtgctttgtttcgaaccctcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatttgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccccgtgctaaatttgatgcataaccatcagggaatttaagattcttaacccattgcagtaccaatttcttctgtgccttatctagactataacaagcttttggtttcacccatcgacctatagatttttgttgcatatgaagttctttgtgattgcatatattggctaatcaaatcgagccttgacattatctttagtcctctttgggatatccatcaaagtattccatatattgtcaaacacattcttttcaatgtgcatcacatcaaggttgtgccgtactaacaactcacgccagtaaggcaactctcaaaagatagatctttttacccaattatgctcctttccaaaaccctcaatctcttgatttcctgccttggtaccaaatgtaatttagggagagatttaacacaatcatacacttctgaagatgatcgatgaataggtgggccatctttctcctccttattctggatgaacttgtcttttgcacgtctaaaagggtgtccctttggtaggaaacgcctatgacaatcaaaccaacatggcttgcctccaacttttagccaaaatgactttgtgtcttccatgcaaattggacaagctaatttcccgtgtgtgctccagccgcacaacatcccatatgcaggaaagtcacttactgtccccataagggcagctcgcatgacaaagttctggttttttgagcaatcatatgtcacaactccttctgtccaaagttgcaaaagttcatcaattagtggatggaagaatacatctatgttctttccagggtgcgtaggccctggtataaccatggtaaggaaaatattatgtgccttcatgcataatgctgggggcaagttatatgggacaacaaaaacaggccaacaggagtaaggggttgcagtttgattaaatggcgtgaatccatcagttgacaaccctaaacgcacatttcgaggctcctttgcaaaattagggtactttgaatcaatatgtttccatgcttcactctctgctgggtgagttaactttttctttctgctttcattgttgcacctctctgattcaagcccatccttgtggtatgtcatgtgtgttgcagtgcctcgtgacatgtagagcctctgtaggcgtggaatgattgggaggtagcgaagcaccttctgtggagtgcccttcttattctcagggagttctaacccttcaatataacgaggcccattacatgttatacatttccttttgttagcatgctccttatagtataacatgcaatcattcttacaaacatcaatcttttggacaggcatacctaaagcttcgacgactttcttgcatttgtaaaaactacatggcaaatttgcatctggaggcaacatttctttcataaccttgaccagctcatcaaagcaagctacagacatattatggtctgattttattgtcaacaaccgagagactgcagataattgagagtgttttccacacttctcccacaatggcttgtctgctgcatctaacatatcaaaaaatgaagctgcttcaacatttggaggctcttcaatattttgacaaaaattaggccctacggcatccaacaccatctcatctatatgatctgactctccataggcattacctccttcattcatctcattgtcaatactgccttctggtgtctcactggtatcagctccactttcaccatgtctactccacacatggtaattttcagtaaatcctttattgcaaaggtgcatttgaactattcttttgtcatgcagctgtccattcttgcacttcgtacaagggcatctaacccttttctctgcctgaccttgtaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaatattagatgtagactaataggaaatcttcttttaaatacaaaaaataattgctcccagataaatcattattagtgataacttgaacatattaagtagtacatatttctctataacttgtttactctgtctacacttcaatacaccaaaagaataaacaacatgtgtcttagcttgtttaatttactgaatttttgcacacatgccaatggtttgctatcagattgcacaattattaacactcaaattccatcgtactttcaggagacctgaattttctaaccacttaaagcaatcctgagattgcacaattattaacattcaaattccaccgtactttcaggagacctgaattttctaaccacttaaagcaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaaccatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcctgggatacaatcacaaaagatgaaaatcacaggacatgacaaaattctcacaggggaattccatcgagcagctggtagacacacattaatcaagatgttacctgaggaggaaggatcggggcacggcagagcggcacactccgacgaggtaggagtgctgggcctaggtgtcaggcaccgggctacaggaggtgccgcacctgaaggctcggagtgcgacgggggtgccgacctgcgtcgaggcaagcacgcggcaggggattgttagcgatcatgcgaggaagaaaacaaatgaagaaaattgggtgctacaaactcacggaggggcaaataaatttctccaatcagatgaggaaatcacaattagaccggcaaacatggggagtgggagagatgggataatgggggtcgatgattttggggggaatgccagaaaatcgcaggaaggaaaaagatggattgggacttgggggtttttttcgtgagagctagagagcccttctttttcttttttttttgagttgacggggtttttctagagggctggcaggtttttttttttaagtacgggaaaacttcctttttttcagggagtgggatgtggctgggtcaaaacaaactccagatattccctcattaaaaaactaactcaggataaaatattgcatcaaaaatttatacatggtaatattatttataaaatatatgaaatctcgtgttttctattatacaaaaattatgtaattattttcaaagttacatgaccataagagtaaaatataccatctttaaatatagattttgcatcctttatttctagataatcaatctagaatttttttatttttttcaatttttataacgatcgttgctaagggagtagagccaccagtaatgacataagtgtggtaggcgtgtacaataataccttcgactaagtggcggtcatggagcttgacgacgaagatagaacagtggcaatgctactcaacctgtcaaccatggagacagtgtatataagacctcggcaacgacaacagtggtaatgtattgattagagggttggcgtgatggcgacaacaagtagtagctactagagtgttaggtagtagtgacaagcatgctagcatgggaaaatatccctctagagtagaggtgccaatgtactgataaatttttatacggcagatacaacggtgggagccttctctcgtttgcatgacacttgttagatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatattttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagatttttttttacagaaatcaattaaatatatttttatttttagataatgtttaatctatttataaataaaaacaagctcacaagatccatgcatggctagcgtaatactagcaattaactaactgtacaatttatattatgtaatttatattacaaagggatgctttatttcatacaatcccaaggaccatcgcctatgccttggggatgacgatattctacaagggtacgttcatgacccttgcaaataaacattattagcaaggaactagagtgatggtagcagataaggatcttctgcaaggctatactattgcaaggggaaatactcttgacaataattacatttcttgtagtgatataattagtgtgcttgtgcaggtgaatgcgcaatgtgcttcttttccaatgccactcattctcaaactaaaacacaatgacatgttttgtgttatgtaaatgttacaaaaccataaaaaaagattacaaagaggtaacatgtattgtttcggtttgactggacagatagaggaagcttattgatcaatgtaaatttatgttagtgagcaaagggagacaagcgtatcaaaacatggtaggtagtagtaataagtaattgtttgataggaatttgacaatgctaaggtttgtccaataaaacagtactaaaagtaaccctaagcctacctcatgcctagctaccagcaaaagatacacactgatagagcgggtcatcaatttaacactaggataaagccaccgctttttacccaaaaaatagtatgaatgctaatatatatacagatgatcaggctcagggtcattcattcgtggtcgactggaatttttactgtgcggttacaacattttcactgtcattctgtgcggttacaataatttcattattaatttgtgtggctataacattttcattgtcgatctgtgtatttatacaaatatcaacgaagcgaattatcgaaacaaatcctttgagaagtcaaacactcttatagcttaggtttattgtgggttggggggaggtaaatactgcctggaggatagtcggacgacgacagctgctacagatgagagagggactaaggatcacgggagactaattctgatttatttcttaactagaataatatcgatacaatccatcattagatagatggagggaagaacccaatctcatcagcactggtttgacaaaaaccaacattgatgagggtttcccaccgtaactctcgagatcgttcatgcacagtatataccaggcacagatgggaccacatcagtgccaggccttggttacaaccggcactgaaaagttgccgacccatctgtgcttggtaaggccctaacatctacactgataagtggctcatcgcgccccctccaacatacataaattggtttcggtgggaaaatgtaaaacatagacaagcagtaataaacttggagtgaaaatatttactgatgcatgaaaaacaatggccggccatctccttgtttagtttcctttgcgtttggatagttgtgaacctccttttaactttcttaaattaattaccgacaagcacctaccttgtgtcagtgtattgatactttctctgtcttcccctgccctatttatatgcttcctgatggctttgtttttctttctttttttctactattcatgatctcgatgtcatctactatatccatcgaaggaaaaaccatgcaaccctgatacattctcctctacccatctctctctatgccaaatgaaacaactgacatttttgttgttccagaatatgttcacacatactgcaccaaacaggacatgttactagatcgagttcctccattcgggaatgggtggcattggaaaagaagcatatcgaacgtcccagctctactgtatattaatcaggtcattgacgaggccagcatccaacgaccgggggcagtgtgccagagaactgggttgatcgctgtcaagttggtgttggtgtacggtatctagctgtcagtaaccttctgctaccagagctgatggtgggaacaactggaagcagaatagaccaatgtccctcagtgattgccagatggttatagaacatttggcagaatccattaggaccctgcgtaatctaattttaagcgaaatcatgatttttcgtgttaattttgattgttcgtcttatttgaagtattttttaattagttttattgttatttttttgattagtacttttattgttatttttcttgttactagaagatatagtactttatacatgacttatgtgttctaatttttttcaaaaaaaattcaaataacatcgacgattaaagttggatacggaaactcatgattgcgtttaaaatgggacagagggagtacttacatttgtcacgtcacttatgaaaaggttttactccctccgtcacaaaatataaaaacctagcatcgggtgggacattttctagttgtctagattcgaagtactagaaaatgttctatccggtactaggtacttatatttttgggacggaggaactatgtaattattggtagtagagagtgaagggatagaattatgtactacctccgttccaaaatgtagcaacctagtaataaactaagagcgtcataaaacaatgtcacattattatttctgctgtcataattaattaccattacaaaggtagccttaatgaaatatggatgtcatagtgaagatagccttattcttttgtggccaaactagcacaccactgaaagttacttaaagtcgagctatttactactggcaagaccatattcttcaagaataactagacatgacaagatgtttaatttctgaaaaattttcgtgtgccagttattagcgtggctcctgtgggcaccccacgtatagcttcattcgtcacgccaaaaacatcatacagaactcgcttaaaaacaccaatggagttagctgaactccaccgattacacgtagctcaacgctagtcgtatgctaaatcagacagcaagatcggctactgcctgctgcatggtgcaaaccagaatgcctgcctagctcgggcatgggcctcatcacctccatatagatcaaatggtagatggccggctagtgtgagcccagggcattgccctactgtgctggttcacttgggtgctggccttatcgattgcttggcaaatgttcatgattgactggttactcgatgtgtttttttcccaatgacaccaattcccaaatgaaccaaacactgctgcaaaaataaaagtaccaacagaagtgtttgttatcctagaacgcaatggatgaatagtagatgagagagagcatatatagaaaagaaaaaaaagctacccaagcatatatgctctaaatagaagaggggagggaaaacaagaagttgtcaatacaactagcctatgatgatgtgcatttgcgtgactactctacacacatgacacatccgggttatgtgatatgtgagagtaccaatacgtatctcttaggtttcttgttgctagtaaaaatttgggtcaggatgagtgatagtatgaccttgatacaataaatggctacatttgttacaatgtattaccttttatcgcccacttatttttattgatgcacatcctttatggctcatggtcacatattttataggtttttaaaaaatattttaatttgtgtgaaagtcgttcaacctttattaagtgaccatgaccttttcattggaaggaatgtgcatgtctgtgtagcaatgttttttctcaaatacattaacaattaaatgctacaaacaaaattaatcacatgaatatacattttgattatgtcctggatatctcaatcttaactaatgaatctttagttaaaggatgaggtttttttcttcctttctttctttccactcctagtagcttcatctctggaagtctcttgaatgtgttcttaattttaccttctatctaatccaacggtccaagattcattcactctcttttatcttgtagtaaatccaacagctaatatttgctaaatgatgtgggagcgtgatgtaggagagcatgctttggcaattaagcaacaaacatttcaaatcatatgtcgaatgccatatacattggtacgttacgttttttaattagatggtgagtgttgtaatctacgttacccagatacggggatatggacacggatacatgatacggtgatacagggcatacaacattttccaaaataatagtacgtaatgcatggcagtaagcgtgtgccatgtgctacaaatttttttaggcagttttgcacttttgccaactctcatctgaattctttgaggctcaggcaacaaaatgaaggctagtgagtactgacacctacataccaaaccccacctctgtccaaggtcttgggccttctacccctgctcctagctgcctagataaataagagctggttcaagattggctagccgtaagcccgagggtccaacccactgccgtcaatgacgtcatacattaaaatatggaggtagtacttaatttcttcaaagatagttcagacagatatatgtagggtatatagaggaaactaaacaaggggatagcattttgttttttcctgccttgatgagtgattcaattttgagtgttattatgagttagctaactccaaaagttggcatgcaattttgactagtattccaaaagtttcttttcttttcactcatctgtggagccttcatgcatcctttagttttgtttcatttctaattctccagtggggtccctcgccaagttcttctatcttgccaaaaattacatacggagttgcagtggtaactagcttgttggtacggcaagtctaagataaaagagatgccctgaaaggaaggcatgtctagtgacgggatgcagtgtatcctggcctgcttgcctgggcagaaacattggcctcacagcccacactaatctacctgagaggtaataaaatgcagtggtgtgtttctctcccaatgccacctactctcaaatactaaggtggtgtttggattcagggacttaactttagtccctatatttagacactaatttagagtattaaatatagactacttacaaaattaattacataaatgaaagctaatttgtgagacaaattttttaagcctaattaatctataattagagaatgtttactgtagcatcacataggctaatcatggattaattaggctcgatagattcgtctcgcgaattagtctaagattatggatgggttttattaatagtctatgtttaatatttataattagtgttcaaacattcgatgtgatagggacttaaaagttttagtcccatctaaacagggtctaactcatatgtaccaaatgtgcaactgtagtacgtgtgaaaactatggaggtacttcgttgctgtaccagatctttcattggtacctaatgaaatggaggtcgccattggaggttgctactttgagcttaagtttgaggtggaacaggctactcaagacaacaatgtggctacagactaacgtgaaattggatgatgatggctttatagatggccaaacgggccgtccggccctacatggcccatgtatggcccaataaggctcgggttgtgtcgggtcggcccgaaggtacgacagcccatggtacttcttcatagaataagtctattttcggggctgtgtcttatatgactagaacaagtttattttgtatatctcttctctttggaccttgccttatatggctgcttaagtatattttggatccctttactatttttcttcaaccgtgccgtgccgggctagcccaccgtgctaaggcatcaacctaggcacggctgtcaagccgtgccgtgcttgggctgcgccgtcgggccttgggccttatggccatttatagatggctttaaccaagatgggaaagttgatgtgcagcactgagagttttaaagataaaaaaaacacacgaatatgttgattctcgaggggacatcacctgcttgtttgcacatcatctaaataattatcaagaaatttgtagaaaatattaacaagatagattaatatctgataaatcactccaaatacatgcaaggtcaaatttaatttctacaaattgccaaaaaaataaatttgactatgaatatacctcaactagacagtatttttttgcaacttttggaagttgatcaattttcacttttatgtttatgttgagttctatcttgttgatatataaccatttggataatatgcaaataatgagggaatgttccctcgagagttgcgaatccgctctcaaaaaagacagtgagacaaccttgacatcatctctacacaatggcaaacagggacttatgaccggagatgatgcaccaatagtgcaaactaatatggaattagaagaaaaggttcttcgtagcttggcaaatgacatcttggacatggtagttgaaatgttaccacaacaacaacatgataacctctcggtccatctcgctatggtggaacagatgcagcagtggaggaggagacgacggaagaaacagaagccgccgccggaggtgtcctgcagcagcacggtgaggaagctggggtcggattgccgggtcgtgcccatcgtcgcctctagctccgggcacggccggtagtagttcgccgccccgcccagcccgtccttgcacccggcgtcgaggccgaggtaccccgcggggagacccagcgcctccgacagcagctcgaacagccattccccgagccgccgcggcgtactcctcagccacgcccctgcacggcggcgggatctcctccggcgaaggcccctccggcgccatctccatgaacagcgtgtcgcgccagttggccgccggcggccggaacaggtcgtagttggagctgaaccgaaccttgctgccgacgtccctggtgtagtatggcgcctttgcctccaggggctcctcgtggaagtaccgcaccgctgcgagcatcgcatccgtgagctccttggcgacgtcgtggttgaccacctggaagaagccgaccgtctcggtggccaccctgacctcggcaaccaccctgccacggtcgacatccgccttagcgaggtcgatgagcgggatggccgccgccgatggcgcggcgatggggaggcactactacagaaaagcatttcagtgccggttgggagaccccctattgtgtcggttttcccaaccggcactatgttagcggcactaattagggagccagcaccaatcccattttaaaaaccggcacctttgagacttctgcgagccaaaaaaaacaaaagaagctcgagcatcgaactgttccccatcacccctagacccgtcaccccgagaccatcgatccgaaacaaaatcacactgtcaccatcgattcatccaagcatatccctcgaagcaaatcacagaagtttcacacaaatcacagatgaaggaatcacaaatcaatccatccaacacatatccctcaacaatttcatagaaagaatcaccattgccgctacgtcgccggatccgtcgcgggagtcgccgctaccactgctccgcccgccgacaactgacgccggatgtggctctgcccgccgtcaccaccccagccgccgtcgaggccggatccgtcgtggggccgccatcgctccacccgtcgacaccgaccccggccgctgacgccgccaccactgctctgcccgccgtcgccacccaggccgccgccgaggccggatccatcgtggggccgccaccgctccggccgccgacgccgaccccggtcaccaccgccaccactccgcccgccgacgccgaccccggtcaccaccaccaccgccaccgctccgtccgccatcgccaccccggccgctgccgaggccgcctcgcccaccgccgcatccgccgcgggagaagctgccgacgacgacgccatatgcggggaggaggaggggaaactgagagagagagagagaggcgagagagagatcgagaagccactagctcgtccttatccttatctcgtcctgtggggcccgccggtcggctcgatttgggtgccggtctttttaaaaaatccagcacaaaatgtaataggtgtcagtttttatttggaaccgacacctattattgcttaaaggtgccggctttttgcgatttcaacccacggaggtgggaaaaggcctataggtgtctgttttagcactaccggcacctatagtggcgacacatatttgatgttttgtagtagtgagggggtcgggctggtggtggaagaagtcggggacggtggtgacgccagcatcgacgagtctcttgacgccggccttggtgtcgtcgaaggcctggaggtcgcggaggcggtcgctgctgccggtgatggtggccatagctaagcctgcagaaacaaggcttggaacgacggtaagttggtgtctgagagctccaacacttgtatatccctcaatgaccagaaaaccattccgtttaaaaaaaaataggggctttctacatatctagtgacagaaaatcccacctcctaatattcaaattttggaccattgaatatgcttcaagattcatgcagacccctttaaccctaactcctctcctcctcccgcgttcagatcacaccgccaccactcctcccgtcctcgcgcgatcccccgccaccaccgccctaccgcccacctctccaacggctccccgctaacggatctggaaccaccacctgtgacctcctaaccacacgcttgctttgcccctaccgccgacgccggctcaccaccctcctccatccctgcggcttcggcggcggcgccgccgcctcgccacctgccaaagtccaccgcccactgccggtcctccgtcgtccacggtcatccctctaagccccgaggaaacccccctcttccccttccccaacccccctcctaccttgaccccaaccccaaaccctaacccgtatgctccctgccggagttggagtgtcaccggcactggagaagaaggagagccctccagagttggaggagagaagccggtggcacgaatcttggcatggatccaatggtccaaaatctgtaagatttcatccctaaatttcattcgaatgacagatagcaatcccgaaaataataatcacaaacatagcatttttctttattctatatccgtaactgttttcaaagtgctgcatgtattttttaatatttagtcacagtttgtggtttacaacatatagttaaatattttctacccttttgataggcacacaatctaccaccgggatacatcgtcgttctcgattttgaacttttaaatggatgttacctcgttgtttatatgtaactcaaataattatgacaaaaattaaaaaaagaaaaagatatattaccatgtgatatatcagtttataaatatgaaagttcaaattcaactcctaaatattgtaacgagataaaacaaattcaactacagctagttaacgtggtgcttagtggcaagacccgacaacgacaataatgtgtcgccgaacagtcagtaccggaatattataagacccgacactaatgtcttatcatcagtaccgggtgaattagcatgtgtataacctgaacttgtttttttttttgtttttggtgtcaagtttattcaaaccggcattgatgagggacacccctcttacgtggtagtagggctgtcaacgagccgagctcaagcgatctcgtctgcctaggctcgagctcgatacaagctcgagccgaacctataaaatattcgagctttaaggcaggcttggtttgaactcgagctcgtttttagacaggctcagttcgagttctaccgaacttgatttttaagtaaaacaatatatatttcaaggataatctttaaaaaaataattaatttcctgatcaatataagaggaaataaaataaaataaatatatgacgtcaatataaggcatacaaataatatatttgatcttctaatttattgaatagcaacaaaaaaacacatattattaggcccgttaaaagctcaacatcagcccgaca

SEQ ID NO: 63679 - DNA, 1351 bp, Oryza sativa
ctctatataaggacttcactttctcacttcactcacacacctcaagcaagagctctctcatattctctcaagttagtatagtgttatctagctagtggagtaggaatacagtagaaatctaaagtctggaagccttcggaagagttcgcgtatggctctagtagctttcctttccttttttgtaagctttgtactttatttagaatactcttctttgtacatttatggtattgaaatactttccgactatatgaatgcctactttaaattatgttcatgttatactgaatatgctgctagcttatctagaagatgctttggtgcgggtataatgtttgtatatgcaattactctatgtcatgacgatgatattaaagtagtatctggtagtttagacgtggtgtctagattacgggatatcattatttggggttatatgctgcggatgagaggtgggccgctgatggtgatagctcagtacgggtattcctccgtatttagccccggttgtatggtcatgacgggctgttgtaaggaacttgacagtcagggtggcttctcgaagtactaggagggcatcgaatagagggtattagctagtatatcatataactagaatgtatgtatactatgtgtactagaagtataagaatagattctctttctcttttctttccacttagctaggaaatttagtatgagaataagtagctactgcttgtgtgtgactctacccttggattatcttaacccctacttagactttgattttcacaagtaacatataaattattagtcaggttctctctatatgatcttcccacgggataaaataaatacgatacccttggaatactctcaggtgaaatggtacaatggtatattcgtgcgcttgcggatgaactttgtaaccataatataccaggagtatttctccgccattgctgggaattatatttctggtaatgtcgttaagaaatatcaacaatcggcttctccctatccaactcggtatcagccgatgcagacggtagccgatgcgtactctgattttgagaacaacgaactccttccaaatccgcttcggcttcaactccaaatccaatatatgatttgcgaaatttggttgtgatttacttacttaattacaaataaaataatagttcaagcaaattgaaaaccagatgttatttgtttgccatatagaaggatatgtgtgtgttaaaatggtgcaatttaatttttttatatagtaaaaatatgtgtaatatggatcataaattatttacttatctacttataaaataatagttcaaaaaattaaaaatcagatataactttgttagttgtt

SEQ ID NO: 63680 - DNA, 570 bp, Oryza sativa
agtgatccggtccgaggtgtgtaccaacctacctccgcatccacttatcattgttcgttactcgatgggcagcccagaacttcatgggcccatagggcagttctgaactctcgggccccatcgagcccacatatataaatcatataaacatgaaacatgtcactttgcttcacacacttgaaagctaatggccaatacaccgaaaggcatgcagaagtttaatcaattggagcaatatacggccaggttcgacaaatcgattgtgtggatgggcgaaactatgtcattcttcttgacacaagggggttaattattatatcaattttaaataagaaataaccataaatatatcgatatacccattatgaccataaacaggtccatgaaaccaaacacatgaactctatcatgtgttccacccgctcatatgcggtgtcaacaattcttagcatatagccataaatagttccataagcatgttttcatatgcaatgataataatatccatattaaatcgatagcatgctaaataattaacattttgtttaaatgtttatcaaattttatcct

SEQ ID NO: 63681 - DNA, 1043 bp, Oryza sativa
cttttaaatataagtgatttatatctgtccaatctatcccaatcacttagtttaaatatattttgaagcatagattatatattgttaatatctacagccgagaaaataagtttagttctttatcttctatatacttcattgctgatccaaattatattgcatcggcttgacattagacgatacctcatcggcaatccagccgatcggctatcagttgtagatttaactttggtttctttgtttttttgttggttgcaggatcaaaccaactggcacgctcaaaacccgaaagaaaatatttggatctgcactagagtaaagcgaatctcttatgccagtatgtgttttttgcatcaacaattactctattttactatataaaatttaaaatacgtaattcaaacatataccgaacaacaatggaacattaaaaaattggtaatatatattacatcatcttaaatcattctacattgtaaaatttaaagaaaatacaaagccattaagtcactacgtatgacattttaaaaattagaaaaattattgaaattaaaagaaaattcaaaacatctaaccatcagtttctacataaatcaatgacctattaatattattttcaaccgttaaaattacttttagaggaaagcttaagccacgacaagccacatattaaaaattaggaaaaaaatcttgcaaatctgagaaaaacaacatataaacatcagctttcacttaactcatttataaaaaatataaaaataaggtcaactccacctcccccctgatgtgctatccaatcatatattgtttagcaaacatgcaaaactacattagatatataataccaaagaaaaaaaaatcccaaatatgaatagtcctagccactgcataaaaaattcgaagggacacactccattgtccttttacatgtcatccaaattgccataaaaattataaaatgatttaacaacacatattttaccatcatacatttttttgtaagcatgcatagctaaattaagaaaaagaaagctagcttgatg

SEQ ID NO: 63682 - DNA, 12695 bp, Oryza sativa
cggttggtaacatgtttagtcccgggtatttgaaccgggactaaagatagcgatctttagtcccggattcgtagtctcggttggaaaaccggaactacaggggttctaaaccgggagtaaagagcatttctctaccagtgaatagtacttgcgtaaaaatattttaaaagcaacataaaagtttatttcgaaaagaaaatctaataatgtcattctaacatatcaacgaaattacatatttttccatatcttagccagttaagattttggtgttttgtttcacggattgtaagatatcatttcgttgagaacgtatgaaggtaataattgcatgaggttgttattcaatttattggattactttatttagtgacattgtagaactaattagctatgcatctttgtcaatctatttacaatactccatgatttatttaggtgacatgcaaagggttacgatatgcatgctaaaataatattatttttacaagtcgaaacatagtcaatatcagtctgtcttgaattgtttatttaatcttaaataatacaatgatgcgaacagattaagaaattgaatatatgtcgtaggcactccggaccttccattatatttgagagatgaagtgaataattcaagtcatcaaacaagcataatgaaacatccgacgcctcgagagagaaatattggagacattgctgagcccttagattgccagtcaacttcagcctgatatgtgcccgtcaaaccactcgaaggcggcgaccagatgtgttacacattcaggagacttgacaaaaatggctaaagatctacaacctctcaaatattcctaactcatactcatgtaaatctagttcctaggatgtgcactagattcacactttcatcttaagcatgattatacatagcaaacacaactaagatgaaagaaacttaagacttacaacaacttaataattacataggccgaccggccaaatagacttattagagaacagcggaagcttgactaccctatcacaagcacaccaactaggagtttaccccattaagttctcatcctagaagaagcaatcggaacccgcatcactcaaagactaagtctaaacctgcaaacaaaaggttttatcaacagcaagagtcactacattaaacaagttaatgtactggcaagcacaagtcaatcctaccatactacatgtaaggcatatattcaaaggaaggcaatatgtagttcaatttcagcataaagcaagttttgtttcgcaattcttttgtaaaggagttgatgcttcaattaacaaagacaagttttaagtttcattattaacttcttcataattccatcataatcaatctcttattgccatacttaacaataagtcataatgtatcaccacacacacaactcaacacatttatcaatttcaaaccaatatcacatgatcacatttttaaaacatagtctatactcatgacacatcaccaaagcactcatgaccgtgagcacggctaattgattagtttaaagaactctgcagagtttgtacagctttacccacatgatatgaactctctagtttgttttgagtttgcaagactccaccacactcttcatgttgaatgtgatctagaggccataacgaagcctttacactacttagagcctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacacgcttagtcacctaaactaccacgtcagggtaaataggaagctcctctgaattatacgaactcatacacaccggcctactagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcacaaatacccatcatattaattttattccaacaaggtttcatgtatcaaaatcatattttaattatagatggaatgagcatttacatagttctaagcatggctaagcaagtagttgcacatagagcatatataaaaccatttgagcacaaagagtgtactctaaccatttctaggggttcaaacagcaagaggatcaattattcaaggtaggatatgcagcaaatatgtcataactaccttaaccaaattttaaataccgatataggctaagttcacatgcaactttgcaaacaaacattttcattcctcaaatcatgggattcaatgtgttcaaaggatgggaggataaaacttgccttgatcagataaatgttagcacctaatccactccttcaccgattatgcaattatctagataaaggacacgatatgcaattaaacaccgaaagagctgaaaatccaaaatgctctaaaatgcatgatttatgcacagtggcttggtactgatctaaaatgaatttaggtgaaagaatttttattttatcttattccattagggagttatgaatttttagaagttttatcggtttatagtaatatagtcttaggtagtgttatgaaatacttttgtaaagtgatttttattagattagacttcacaggggtgtagagatgtgttttctaagactaacacatttggtttcaccatttttggagttataatgattttcttatagattttacaagttacaacgtgtttttggtatatagtgttttatatgttcatgacttttgagttataggttcaaaatatgctaattcctgtttaagttgaacaaaaggaataatttggttaactaaaacatttttatttcacatgtttatggtctttactactatggttcatattttataaactagagatgctctaatctaaactagcaatatattatattaacctagaaattgtcatatgagctaagttcttctaagttttagtggatgaggatggaactatggcttcactggtcaatcagtttttatttaggtttaattagacctaaagtgtatatatacttatacatgtttatgtattacttaaacaacactatgtgtttaaattcttatttcactaagttaaggttttgatctatgttctctacaaaaggtgccaaattttattttactatgttgaagataactatttgctggttctatggaaactttgttcatttcatttggactaaaaatgaattttctacaagttttacaaattaaaggttgctctatgttagtaaatccttatatgaatatttagagacttttactacacagtaagtatataatcttatttcataacatggaaatatgtgttttggtgatcctacagaacttaagtttattcaaattgaagctaaattgggttctacatgaatttctaaagtttagcttatctaaaactaatcattttagatataatagttttagaggcatttgatgcaaagtaagtaattacttttatttcacctaatcagagagtgcatgatgatgaatctgcagtttttgagtttgtttcaaaatgagttgagatgaattttctatgtattttataagtttgtacatgttttatgtatgacctatcttagataaattttagagacattatttgtacagtgagtgtcaagttttatattcctggaataaagttcataacttcaataatctacagcaactggaatcacttcaaaatgagctatatttgattttatatagattttacaactttgtgcatttttctgctaaacatatatttgtttgggcattttcttaattattcttcagattttaaaggatggggtccacatggctgtgagggaccaatatgcacaaagactcttgaggtttctaggaatcaacccgcagtcctaggcccatatgtcagtgtgtttctacaattgtaaacggatccctgcacttaatctgctttagatagagcagagctagccatggctgagctcgatctcgagctcgccagcggcaaacggtggctcgtttgaggttgaggtcaagagataaaatgaagagcaagctcttgtgattccattcctctagttttcttggttagaggacatcggagtagcgccgatggcgagtgtgagcggcggtggttcttggggtgaaagtgcatgtgtgcatggaagtcgattccgaacgaaaaggatgcatgcatgtggtcttctagccttcaggatgctcaccgtgggtcgagctagggttgtcgaggtcttggtggcagcggtgacttgtggaacggctcggcgacggtgctcctcctcgggtgaacgacgacggctcgaacgggacaatgagctgcttcaagcaagcatgcacgagggttgtgaggtcaaggagatggtatatgcgcaaggaatcgaacaatggctcaccgaggcagcggtaatcgatgatgacggcggaggcgattctagatcggcgccggtaaagaaaagatgcgttctccgagtccttcacatctccggctagggttcttgaggcgtattgaagaggaggttgaggcgatgacgatggcgcagcggcttcctccgaggtggtcgagaatggccggacgacgacgatggttgaagcggcggcgctccggtgcgtgctccggggcgttgtcggtgtggcttgtgttcccggcgatgcactgcacgagaggggtttaggtcaaaagaggaaatgcttggcattgtgtggagagatgggaacgcaaaagagatggaggtgaccttgactcaacggagatggcgaaggtcgtcgtcactacaaccggcggcgaggttgaggatgacagagaggctgaggacctctccctcggcttcttcagctccagagtgatgtgtggagttgggcgactcggtctggaggagatggaggcatgactcagtgacttgaaggcgtcgacatgtcgtcaccacgtgtcgacgtgtccaagactcggttggctctcgatctctccctctttgtgtttcttagtcggctgaggatgagggacagaggaagggcgagctggagatgctgccaggtggggccaagtcgatggaagctaggctaggaagagaggtatgggtaggagtttggatagacttagtttttggataattttcggaattatttctttcccctaagtttgcaactcaatatcttaatatgtggaccagaagaattagtgtagattttactggtggtagatctttatatctagattccattttctttggttgcacataaaaataatgggtagacttctcacagaaattaaacaaacatcggctattagaaagctagattgaatttttaggaggcttaaacagaggaggaaaattctagaaaaattatatttaggcatgataaattatctagtatttgaataaattattttgcatgttcacttatgagcagttaaatgtacttttggatgaagtatggctttagccgattaaaatttaatttgattccttttagttttctgctttgactgattaatttgtggtattaaacttagttattaacttgtaccaatattatagtgaattgcttgtgctaaacattgtctatttaattttttttccatggtttttaacttgcacataatattttagagaattaggattactttactttgtatatgtgttcctacttcataattgcacctaatattgttacagggattacattaaacttcttttgggctgagaagatgatatttgagtttaatattaagtccacatgttatcacccaagattaactataggtttgtttagtaattttaacccttttagtttatgctcacgagaccaattatgaaaagcgagaccataatccaaatgcacaagggactcgagcctaggcatgcattatgcacatgtatgctcaaatgcttgatgacatttctagtctaatgttgggaatgaaaaggttttattttgttctcaaattttaatcatgcaatggtttaagttggtcatcacctaaattaaaacggaaatttttggctctcaaaaattggagaagttaacctctaactattttgacaagaaattttaagtcctagaatttcgggtacgttacaatatgatttgattgtcatgattatttgaaatacttatcagaaattatggtatggtattcccaaataaagtactgtagagataaaagggagacgtgggggtgcctacatgccttggataagaggatggttcacgtgggggtggatgaatacagggaaataaaggggagtgagaggaaatcgagtggtctaagataatgtgtccattcgtttaagtgaaaaccgacgatctgagagttttgttgtttttatgactttctcaactttttaaaaagtataatagaagtcctaggagggctcggatgtttaatagaccttttggtgatagatataaatatgtagatagagacatatatatagaagttgatatagatagacatatagatatggatatagacatagtaatagatatagatataaatttagatacaaacatagatatagatatagatataaatatagatatagatatagagatagatatacatgctggttgattgattgattgatggacaaataggtagatgataggaagacgtaatagatatagatatagatagagatagagatatagatatagatacagtgaacgtatcctacgcacaaagtcttctcgtgtacacgccgtacatatcaactagcaaatttcacaaaaaaaatagaaaaatttggacttttacttttaatagcaatacatctatgtgtaaagtctcatattcacattatatttagggaacaacaaaaaaaagactgaattttaatacatttatacttttcaaattgtcaaaaaaaattgatacggctaaaatataatgaatgaggttatgaatttacgcatcggtttaatactattggctgtatagttttgttttaaaatttctgataaaatagttcgttgtcgtgcatgatgtgtacacgaaagctttgtccacaagatatttttcatagtcatagatatagtgtatatatagatatatataaagaaacatattgatagacggacaaatcaatagacatgttggctgaatgattgatggatagatagatagataagcatagatagatagaaagatagatagatagatagatagatagatagatagatagatagatagtttagaaaaactgcttgacctcatttgttagataaatttcaaattcgtgccacataggtccttttcctcacatgcatgcctcttctatctgttgaagacttcccctctccttcttaacatcaaatcttgaacatacatccattggtcctgtgtggtgcaactagttggagcaatggagatagtaggtgagtgcatctacaataatccccccgtgctggttaccccaagcaaaccaacgcccaagcttgctctgtacctctcaaacctcgatgaccaacgcctcctccacttccccatccagtacatctacgtcttcaccggcacccttgacatggatactctgaaggtggcactctctagagtccttgttgactattacccactcgctggtaggttgagggctagcaatgagcacgatggcaaactcatcattgactgcaactcagagggggttctctttgctgagggatttctgcccggcctcactgctggggacttcatcctagggcatgccaagcctcataagtcttggaagaagctgctctataaagatgagcagagctttgtgtgcacgccaccactagtcgtacaagtaagtacttttatatagttacttccattcatataattaattagagaagtctatgaccataccttatatatttatcatacgatgcagatagtctatatatggtcatatatatttgcttcgttttttgatacttacaaatattggtaggggtgcaagtgggtcacccgcgaacccacttatagatcaaaataaacgagttcgtagattagtttagcatataagtgggtttttacgggtagccgcttgcacccttaaatattggacatcgagtaacacctgccaagagggtgcatgttcgatctagtagatggttggacagagaatacgtcacaggttgatctaacgggttgtggggatgggacatgaagttggacatatatatacacaggacggaattaattagaattgttcagatgggtgaaacttgtggtgtgtatattactagaagttggggacgattcgaaccattatatgtagctgtatgtatattagccgaatgacagggatcggtcgaccggcgggggagcagaaatcgggcgctccccccgtcccctgccccccacgcgcatgcatgccacctggccccaccacagtctctacccccacctgcaacaaatcacccacatattttggaaactctctattaagtggatttggtttattttttgtttcaccaaaaatattttacctagtgtactcacaatgttttactatgtatagatctaatgttgcagtgaactgaaatattccattgcaacaaaaaacccatatattttggaaaccccctattaagggaattcgttttattttttgttccaccgaaaaatgtttcacctaatatacttataatgtttcactatgtatgtaccaaatgttgcagttaactgaaacattctttcactatttgctgaaacattgtttttatataaggtgaaacaacacccgatttaaacgagtgaaacattttcgatctacttagtgaaacaattccgatatacctggtgaaatatcgtgcaacatttaaaaataattcaataataagctattttttttcatcggaatatatccatgtgtggtcttgttttggagatttaattgcaatgaatttaatggtgcaatcggatcatgatttggataagtaatttaagagaaaaatctgtttaaaatagctttgcacgtaaatctgacgctgacgtcatgctgacatccgtgcccgattttaatctcctcccatcgggcgcccgagctggagtcacgtccggtatattaccaataaatttccattaaattatatgcataatttaaatcgaacttctatacatagtgtattgcaaggaattggatttgtacatctcgagtgcaggcaccatcatttgcttctcactgacctcaataatctagcaaattttgtggaccaaaatatattgatctagtatataaagacatactccctccgttttataattttatattaatagaaaaaatatccgtgcgttgcaaagggtgaacgttattttaatcttattattgttatatggtttaatcaaagtgaaatacactgtgggaattcgcttggatatatatgttatttttagctaatcatgagctgcaattagaaatccatcgtctcaagttagcctgtgagtttttttaagagatttcttataagactcctaaattttcaaaagcgaactaacttaaaaactgactcaaatacggatatgtactttcaaaagaaaacaaacttaaaaaactgactcatacacggatgacgtaccaaaatactggtaaaaatatctttaatttttataatagtagagataggtcattttgacttttaaatttaaacttcttcaaaattttaccaaatttatagaaaaatagtgcaattattatagcacaaaattagttttattaaatctaacattgaatatatattgaaaaatattgctatatttttctacaaatttagtgaaagcgaaaaaagcttgacttaggaaaaaagtcaaagccgcttataatatggaacagaggtattacaaaatagtcaaattcacttatgaataatgccggcgctattcattgaaaaaaaatgtgtctttggtttgatatgtgtattggattaaatttcatgttggatggctgtggagtgacatacaacattttaatctatattctgaatttgttttaatttagaattttctgaaagacggatgagttgatgtgtatttaggctgcaaatggacctatgtggttgaactttcatgtttttcgtaaagctattagcagtcacatgcatttctttcgcaacggaaaaaaaacagacatgctatatttatggcgacacaccttgatcacagtcggttaatctgaccgttgaatatcatgtagattcatgctacactattgatgcttaatttaacgaacgtttgattcgcttagtctactacaaccctacaaccctactgctcctgttattcattagtttcccattgaatttatactaacatctcttttatttatatcgacttacgtatgtaattttaagacttacattatatatacataaaattacatatgtaatttagggatttacaatgtaattatatgctgataattttttagaaaaatatgatggcataaatatagggagttccagagaaaatcattaattgtaagtcaatgtgacgtaacctggttttcgtatccacgtggcacggacatgttcaggtaactcacctcagctgcggtggcaccatcctctgcaccgccatcgcccactgcgtctccgatgccttcggtgccgcgcacttcctccgtgcctgggcgcgcgccgccatgtccgaagactccgaactcgcgcatcccgccgtcgcgccctgccacgaccgccgcgccctcgcgccgcgctgcaccccgcgcatcgcgttcgcgcacccggagtacaccgctgccagcgggggcgatgacgcctccgccgtcgcggaggcctcgtcgcgcctcttcgccccgccgctgtcgccggtttccgtgaccttcacggccgcgcacgtcgcgcggctcaagaagctgtacgcgccgtcggcgtcgcctctcgagcagtgcacgtccttcgaggcgctcgcggcgcacgtctggcgcgcgtgggtccgtgccctcgacccgccggcctcactccccatcaagctcctcttcaccatgggcatacgccggctggtcaagcccgagctgtcgggaggctgctactgcggcaacggcttcgtgctggcgtgtgccgagtcgacggccgggcagctggcggcttcggcgcccgacgcggcgaggctggtgcaggagaccaagcagcgggtcgacgacgactacgtgcggtccgtgatcgacctcctggaggtgcggcggggctgtttgccggacttggcggcgaccttcacgatctcctcgctgacgcggcaagggctggaggacatcgacttcggggcggggacgccggtccactttggcccgcttaccagcgaggtctactgcctgttcctcccggtgatcggcgacccgcgcggcgccaccgcgcttgtgtccgtcccgcaggccgccgcggacagcttcgagcgttgctgccatgatggactggatgacgtggacgtggaagacaagaatcagctgcctaacataggagatggcatggcatcctaaaatcctaggcgtttgaatgccatatctcttctagaaacaatatattcatatgtctctccatttggctccaaaataataaaataactagtatggtggtccgcgcagattacgcggctagtatcattatattttctctcatataataacatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagactcgtcttttaattttttttaattccgaattttctgtaaattatatttctatatattatatttctatatagactctatgctcttcttccaatattatttatttttatttttgaattttcatattatattatatatacgtgttagttattaattattttgaatatcaaattttagttatttgtaaattatatatatttctatatggactctatactcgtcttttaatatttcattttttaattccgaattttctgtatatagactctatgctcttcttccaatattatttatttttatttctaaatttttattatttctaattgtatttctatgtggactctaaacccatctttcaatattctttaatttttagttttgaatttcagttacttttaaattgtattcctatattgaccttaaactctccttcccatgtttttcttaattttaaattttagttatttgtaaattgtattttcatacggactctaaactttacttttaattttattatatttattccaaattttagttagtttaaaattcctttatggactctatattctacttctaatattccttattttttaattccgaatttctttttttcttaattgtatttctatatggactctatactctacttctaatattccttatttttaattccaaatttatattatttcctaattgtattcctatatggactctatactctac

SEQ ID NO: 63683 - DNA, 18393 bp, Oryza sativa
ttcctaattatatttctatatagactctatactcctcttctaatattccttatttttaattccaaatttcagttatttcctaattgtatttctatatggactctagtctcctcttctaatattccttattttttaattccgaatttcagttattttctaattgtatttctatatggactctagtctcctcttctaatattccttatttttaattccaaatttcaactatttcctaattgtattctatatggactctagtctcctcttctaatattctttattttttaatttcgaatttcaggtatttctaaattgtatttctatatggactctgatttttctttttctccgattaatgtgagaatttctaggccatgagagcgaacgtagagactcttttttctattcctttaataatataatagatagatagttgtggtgccctagcaaattacctttttttttggcgtagtacaacagtctcacatttttttaagatgtccagcaactttaaaagtcatgtagtaaattttaccataaaaacatactagaattttggtagaaatgaaagtgtaaattaaataattgcaaaatagagaaaaatataaaaatgatcaatttcaatagaccgcaatgagaatagaatgagcgagatagactcattgggccaactttcctccaaacctccataccttgacacaatgagccatattctttacgaatttcatataatttcaaaaaggaagcagtcaggggcatcacagcatgttatattcaggtttaagcattactctgaaatagttcagtgatttactatgatgccaactgattatgtttgtgcctgatatgtatgtatttgtttaccactgtaaaaattcaaaactaaaagtgattgagggaaaggggggggggcggtagcttcagacatgaccagcttttatattggtaatagcattcagaggtcaagacctgttgcatgattctatttgtaaatttttgtccacgttatctgaaatcagcgaagaatatgggtaacacatttgttgttaatttaggaatcattaagtgaagaatatattatttccacacgttatgttcttctgtatataggattgtcatctctcatctttcttcatgcgtttagtaccaagtgttgatttaattgggtaattgatccattcaaatcaaataaatttcaaggctcattatgctaggaatttgtgtatattcattctcttatgggatatcagtgggacgaagagttttgagaattaatccatttgattaatgaattggtaacctatatcaattactcctaattgatggttggttgatggttgtgtactggatgatggttgatggctagttgatgacaatcagtcactctattcctcttcctattctattggttaacatatatcaagtacttgatataggttaccaagtactctcctaattgatggttgtgtagtgaagaatagttgatgacaattagttactctattcatcttcctattccatgactatcttactcttcatctttcatttctcctataaaatgagaatggatttgatctcatgcgtgaaaagagatatacacacttttcatccacttctaatgcggttgctgccacgataatctcatcccgacgagtgtgtgcacatacgttgggagattaggcctccgaaaccatgcactgctgcgatgtttgcacggacgagcgagagatcaggtttttggggagcgcaaggcgcgactactcactattcgtcaatgtctacttcattcatcaccatgtcgactgatggaggcgtaaacggtggacatgtcggtggcggtactggaggaggcgagaacgacaacatcaacggaggcaacaacaacaatagcaatatctcattctctggagcattctctaggtatattactctattcaccttagtgttaaacatgttgctagatgatgctattactattactagcatgttcatgtttagcactataactaaatcatttcgtttttcacatgtcatgtttattatcttgtttttctagattaaaatatgtcaaattatgaccatatttccaacaatccaaaaacctgataggtctttttcggtagttagctttgccgcatcactaaaaccacatgccttcgatggttcagactataagaggtggaaagcacgtgcactattgtgtttgacggctatgcttctctgtttcttggagcaaaccgagtgaaccgcctctctctcctaaggaggaggctatgttcgagtctgcggattgcttgttccatggagcattgatcagtgtactagctgacaatatattggacgtttacatgcacatgccttcagcgaaggatatgtgggatgcagttgaggccaagttcggagtttccgatgctggcagtgagttgtttgtcatggagcaattctattactacaagatggtcaattattgttttgtagtagagcatgctcatgagatttaggcactggcaaaggaatttgagaataaaaactgtgacttgccgggcaagtttgtggcgggtggcattattgcaaaattgctaccttcttaatcggactgtgccacttctctgaaacactggcaagagttcggtgttactgatctcattggctctttgggtgttgaggagaaggtgagggcaaaggacaaccccgataaaaagatcaagagaggttctagcgctaacttggtgcaaaagaagaaccctaatgcaccccacaacaataacaagaaagtcaaacgtgatgtcaaactaaaggcaacaaccaattttaagaagaaatgcaagggaaaggcgaagggcaactgctttgtgtgcggtaagtctgggcattgggccaaggattgtcctgatcacaacgacaaaaagtctgcaaacatggtcattagcgagggcgaaggaacatcggggtacggtaaatttttacctacagttctctctattttccactcacctgattggtgggttgatacttttcgacattttaggtcacgactacggtatttgcatggtttggagatcgttggtgccagggtatatgcgagattgaagtaaaagagatagagacaaggatttttatataggctcgggccccttatctaacaggtaatagccctactcatgttggtcatagccggtattgctctatattcattagaatcacacaagtacaatattttggatagcctatctagctgtcatcgacttggcggcatagataaccaacacgtagtcgacaacagggtagtcttcctcctcgagtacaaactcgtcgagatcagagatagcgctagattcctcttgtcggcctccgtaggcaccatattgggttcgtccaggctaatctctgatgtcgatgtctgacggcgtgtgttggcttctgtgtctcgtgtccattgtgtgtctctgtatctcccctctcctcctagggggtcttgtatttatacccatagatgtccccttgtccaagtcgaactagggagactaatatggatacaattcgagtagtccttgttgtttccatatagaactctactcatccttccttatccggaactccttctatatacgagatataattctgtataagacttggtatatgatgggccccgctgagtttagtcgattactattgggtatgtggtatccataaccatgacaagaaggtggagcactgttatttgtggagtcaagagaaagaagttacagggatagcgaagtctctttattatggtgagcttggtgaaggttcatcggggtggcttgacgtaagcaacggaagaatcaaccactactacagaaaagtccattggtgtcggttgggaaccagtcgtaggtgccgggttttccaataggcacccagcaggcggcaccgatgacttcagccatcggtgctggttgtagaaccagcacctataataatgtataggtgccagttttacccaagaaccaacacctacaagaatgaacatgagaaataaaaaactccaactcagctcaatcaagccgacccaagcacatcaagaacataaagaacacattaacatcaagacctaaaagaaacctcgccctccgcaccagccttctccaccactgccgccgtcgtcggatggaggggaggagaaggagggcgccaccgccgcctcccctcccgccgtcgccactgagagagggagagagtggtgtagtgagagagaggtgagggagagagagcggtggatggaggaggagagagatggagataagatgggtgggtgaggaaatgaggaaagagggggttgggtgggtgtggtgatttttcaggtcttggctcgatttttcaggtatcggttttttaataaaaccggcacctaggtgctggttttaaaaaaaccgacacctatgtgtattgatggtggtttttatttagaactagcacctgtaattgctcaaatgcgtcggttctatatactttaagccagtagaagtgggaaaagatctataggtactggttttagtacttccgacacctatagtgccaacctctatgtgcatttttgtagtagtgaactcaagtcctaggacactgagattcaagcaagtgacagattcaggttggcgtggtatattcgtcaaggtagagtttgttagagtttgtttcgaatatatatacatataattgatcgattacagtttagaacttggagttatactagatacaggaatagagtaatattatatagaaaagagcaagacgcatcgatcgtggttttgtctttatttcaatccaagctgaagtacatcatttactcacttatttgatttgactaatgttattattactccctctaattaagacataacacaaacacacagcgcgtgcatgtaacgagcgagggacgatgcatgcgtgctagacacatatatatagcttgttgcaacaacgtcgtatgatcagtagggcctgcggccaacgatgttgccacggggctcgtagttgcagatgatgaagatgccgcggttggcgtcgcaccgcacgcgggcgcagccgacgttggtggagtcgcgccacaccacctgcgtgtagtggccgcacaccttcccggcggcgcagctgttgctggcgtagttgtagtacttcttctcgtccacccacgaccgcaccgcgtccgcggccgtccagtcggcgccggcggagccccagaagatgttctcaccgtacggcccgcccgagtgctgcagccggcagtcgcccttccgctgcctcgcgtagtcctccgcgaacccctgcagcttcgtgctccagctcatcggacccacgccgacggcggaccgggccgcgttctgcggcgacaggtagtcctgcggcgagttctgggcatcggagcagtgaaacattgtagcggctaccacggcgagcacgaacaagctgcagattgctagcttggatgcctccatctctgcttgtaaacgtagctgctttcttacttctgtatatagctggtacatgcatgcagaggggtatttatagtcgacgtgtgagagaattttcttcgttttgcatggaaatgttggcgaggcgtgccggtattttccttgtgctggcaaagaattctacgaacaggcgatggtactgcatacttatctgcagcctactcgattctgttatttagatgaacgtacaaagctccagtcaagtcatggcatgtttaattgatttgttggatagagaatactgtaacgtgtaccgttaagataagaacacgtatatatatgtttggactctcagctatagtgcttgggagccaaatattggaccgctccggccggtggtgtgctctgaagaatttcgcagagtactggagtatactagccggatggctcttgtgtgcgcatgcacgtcacattctggcaggaattaagttaagacgagagatgtatctatacgtatcatggaaataactttcgtgatacatcatataagactgttaagcaaggtttctcaaggcatatgtctgctaatgagagaatcggcctaacttgatcttttttgggagtagaccgatttggccctggtcattcaagcaagccttggaccatcatggtgttttattttggagtagaataagtctatcactagaaaatatttgccgcgcattagtatatataggctagctcaattggatggacccagtgcactgttaattatgaagtcaggtaaataagaattgataataactaaatatgtatatccaaaacaaaaaaaaagagctacataatcacaaaattttacattcaacttacccgataatctagttttacataccatcaaactcagttgcttttgttactgacaatgagagatcaactttgtttctccttataaaaacaatatgaggttcatatcaaatatgttttccttacaaagatattacatgatcaatactttgtgattagcatcaatgatgaaataaggagatttaactatttgtaatgaatagaaagtaagacaatattttcagtgaggataataatataacttatcattgaatccaccgtcttgtgatatctcatttactacagccttgtttggcatgagcattgctctctcactgaattgtacagtggttaaagtcccagttctgcacctgcatttctcagtcccagcactctatgtcaacttaagaaaatgtaaataaggaacagaaaaaacatgtgttctgaagaaacggaacataacatgaaacataacatggaacataacataacattaacaatgtagccccttgaatttgagctatggtagactttaattcagattttaatatctaaaggataaggcagtgactcggttatcagaatataacatgaaacaaataattttgagagagcataatacaagtatatgtgatctaaaagaaatgcagcctgttatcaagacaaagttctttgtgactatagggtagcccaagcagaagttctggttgtgatcttcattcatgcagaggtgaaaatggaaagcaaagaaactctagttttaaaagcaaaatagaaagggcaatttctttctgctgttcttataggtcaaaattgtcccactgatgtgagcatagtagaaacgatttcttggggttagttttgctagattactccgtgccataaaaaagataaagaagattttataaacaacttgacaaatgtccataaaattagcatcaggtaagcaaaaggttttggatcttaacgaacaatcatgtgctaactttttttaactaatgctaactaaatttaagctcaaaatgccttgctatgttttctttttctctctttctttctttttccttttgcagattagtgtagcagctacctgaccataggtgaaagcatcgctgctaacaaagtatacagataatgaaatgatttggaggtcatttgatcgatatctgattgacgtcctcaaccgttgacacatactcatcagattataatatacatgaaggttacgggtcattaatctgctgattgtatgcatggaaagcatgaagcatcatgtcagatatggaaaccttgctaatagattaattgaactcagaaaaaatgcatttttccagatcaattaagaaagtgtagatgagtcagtattcacctaaagaaacgagcaccggcattggtaacttgtgtgcatctccggtgagctttattgcctctttgccagagaataaacaaaattgaggatgacggtggatgaaaggctgccgccgtctagctcgttcctccacagcgaggtcagggagaaggaggcctaaagatgagcaggaataaagggggaaaagctgcagcagctgtggattaaccagagaccgtcgggggtggtcgactggagcatctcgctgaggaggatgtcgtcgtcgtcgtgtcatcgacagcgtcgccgctcagcccgtgcatgtcgtccgaggggagcccagaatagggatgggcaggaggcagcgtcggcgctcgttctgcccggatctggcacccttgagctcgtccgatgagggactggtggcgtggcttggatggtgcagcggtgacgtctgaaggggatggataggaggcggtgatggggaggagaaggttgccgtggtgcctggcatgggaaggagatcaggagaaggatgcagcggcggccggcagcaataggaggcggagcgatgaggagggggaggcggcggcgtttcgggatgggaaggggcggataggtacgggccgtgttacgggataggacacgtggcacggttttatcatatgtaaaattgcttccagttttagccacgtggccaatcaacggtaagggattggacccaaaaatcagtataagagatgcctccctcaatacttgctcctgattgaatagcctccctcaaccgcaataccaggtataatgtctccccactcttcaaaaatctgaccaaatcaagtcccttggctgtttggatagcggtttcatcctatgtgacgctcatgggatccactgtcagtgataaaaaaataaaaaaaataacgcccccacataacggacttcatatatagttgagaacttgtgagtacaactccccaacagagattggttcaacccgtgcgcacatagctgaaacaacttcattgtatccttcaccaagttgagttacgatatactggattagatcttcttcgtcatgtggacaaccgctagccatcgtcatctcctcggcaagggactccatcttcgcaaagtactctgggactgatagggggttcccttcatggtgttcatgagcgcaattctggtgttgattgatcgtgcccgggtgtaagttgagtacatcacttcaatcacacctgatgctttagtcattatctcacacgtcgcaacttgcatatggacatcccttgatagggacgagagcaagtaacccatgacctattgattggtcttcttctccgtcttgccatcggtggtgacggagacctcaacaatagctaggtttcttgctggcattaatgagatgcccttggagtcaagctccttggacagcagtgatgatctgcaccttctagaacacatgattcgccttcccttatttctttgaaacacagtggccttgaagcggattggtggccattgtgtttgaggatgacgacaccatgaggatcgccctagatggatcgacactctgataccatgtgagttttctggatggaaacgatcgcaccaatcccgcgcatcgcctttgtgttaatatagataggaacaacacctattgtgtcttacagagatatgcgctgatagaatcggtaggaccacaaaatcaggaaaggcgaccaatgatctatatgttctgctattatcaggtgtgaccaatgatcttatctaacacttaatcgtgactgagctaggttcaggttgttcttcaaattatccagaagtctaactgacaatggcttagtaaaaccatctgcaacttgatcactagatgaaacaaaatcaatttgtaaaagtttatgacttacccgttctctgatgaagtgatagtcaacctcaatgtttttttttgcatggaaaattggatttgttgataagtagttagcacctagattgtcacaccaaatattggttgcctgaggacttataattcctaactgcaagcaaggtttgcatccacatgatttttgttgtagcatttgcaataaaattatgctctacacaacaagatatataccagattgcgcttctctggcaatgtcatctggagttcaattattacaatacaagtttattgcagcgcatagtccaattaagacagtatgacataatatacaagtttgaataatggaaaaaataataagacgatgagaatttgttgtagtgttgttaacaatggaattttgtatcaaactcggagaagaaggaacaagatcgaagcggatttggtgcaagatcaagttggttttgaagtcggactccgcatcggctagacactgtatcggctgcaaactgagcttaagtcgataacagttgataaggttgatagccaatacagccgatacggtataacttgggctcggtttgcacctagattaagataaccgtcgttgccaattagagatagaactcgaataaggtaattgtatctaataattaggatatttaagtcagttttgttagagatttggcaagagaccaccgtgtagtcttgtttgtatcttatttttaggaaaatttgaatcgagtccataatggactaagtttgtactcaggcataaatatgaaccccatagcattataatcggatggacaatctaatacaatttcggcacaacaccaccctttttacttttctattgttcaacgagtttatacttgtcatggttatttgcatcggcagggttagggcttcgacactctaatcttgtcaatgtaagtacctatctatcatatatcttagttaatctagtttgttagttcaatttatttgtatcagctaagattcgttttagggtttatgccgatatcggctaaattgctttaccagattagattaactaaggtgtctaccaccctgaaattcagtcaagggcttgattgtctacatattatgtttattttcatactttgcgctgcatcagccccagtcgtgcttagaaccataacctctagcctgccttttgatttccaataagggtttcatcggggtttcagccgatgagttatctagatattgcatcggcttataaagattatattcaagttagatttagccgatcgcgacaaaggtttcactgtttatctattcgttttgatttaatgacatcggacttctagccgatgcatgttttaaccttcggatcaatgcttattctatcatattgttagccaattggtttctactggattatattgttgttttgttgcattatcatcagccgattgtctttgtttacatcaagtgtcagactctacatcaaccatatagccgatagctcaaaatcctatcgctatcggttggtatcggcatcggccggaattactccaccggcttgtcagccgattggctcattgatctactatttgtatatcttgtcagttataggatcaaactgactggcacacccgtatcttatcaacttttggacctgcactggagctaagcagatatcccaggccgttgtgttcatcgacttagttcgcgccaacacagttttggcaccataagctagctaagcgcggattttttgtcaacaagtgtacaataatcccagtggtttactggattccttttaatatttattattctattagaacccacgttttggcatggttatgtattcatggatgttgctctattaataactcgagggttagagctaggtaaggctaaactggaatctacagtgggcttttattttgtttagaggatatcctatcttccgatatagttggtactcactaaggattatttactcctataaagcaagataatacaagaagccacatcatcaataattttaagtcattagatcatattggtacaaagataataaccgttggatcaagaagctatacttattcattcaattcaatcatttattagttatccattcacctccctttgctccacctcattgtgcataaaaccatgttttccgaatataactcaaattattgtttaatatgtgtgttttattttattatgcacgataagatagcatataattattaggtatcgttacctaaatctatttttagaaaaaacttgagtgaagtagagagatgcaaattgtctaactataacgatacccatattgcacatgaaaataatattcatatattataacaatacacaattgcgcttggaaaaataaagcatgaattgtattgtaatagcatatataagacatatataaatccacattattatatattttataaatacatagagttacacctaacaatttaaactatgattttgtttgacgataaaactacaaaacccgtggcaaagacgcggaatgccaactagtttatcatatgactatgtaacatgaggttctattgtctcctatagtgatgcacgggcattttttaagttaaaggaataaaaaacttaagtgttgaaacacgttcttcttaattagaacagaggtcacaaaaaccaagtggactcagaagcaacataacactcattgctaagccgtgggcaacaaaaccggaggccatggcatctggtactgaaacacaggctcactcgcactaaaactcgcaacaacctctaagttgctgagacgaaaggcaatgtagcggtcgttcaggcgtcgtggcgagtggaggcacatcagcacgacgccggcgtttacggcgacaacgcggcacgctcgatcataatcccatagcatatcagcagcgtcttcggtcgacgtcgtcagcgatgtttcctgttcttggtccagcacccacgcgcggccgccgcatccagactttccaagaagccaaactctgaggtgccattttttcttagacaacatgaccagcctcatcgttcctctctcctccatgttgaccaagcacatggagccgtcgtcggtgtcgccgacggcgtacgacgggcccaggaggaccccgggcggaggcacgacttcggggaaccccatggtttcggcgtccagggagacaagactgttaggagagccgccgcgtagcctcttccagcagatgcgacctggcgcgtgcatggctgaataacgtttcactttgagaggcagcggcatgtcgatgtcgctggtgttggtccacgggcgagcgctccacgcacccgtggaggagtcgtacacagccagtcgctccatgtccagccgttgatctcctcccgaggcgtatattactgtcgtactacatctctgcatggtgaccacacggaacgacgacgacgacgctgcctgatcgccgacgcggccagggatcaagaagctgccggagttgtgatgaaatgcccgcttgttgccatgccgcggtggggtgagcttcgccaggacacggcgggctacagggtcgaaaacggtgagctctcgttggtgtcgcaattcctcagtaggaggcggccttggtggcagtcttcaacttcaaggcggcccatggacgtgacgggagtgaggaagaaatcgccatgtcggacgaccgcggatagttcggggtcggagaaggtgggctgcgctggttggaacaccggccgcgaagagcattcagtgtagtagtagtggccgaggagaggttgggcttggccggggtggagggcgtggaagcggcggaggaaggcgggggacgaggccacccggcgccaccgcttcacagcgcaggcggcgcgagccagcgacgggactgacggcagccgcacgaggaactccgcgatgacatcgtcgcagaacgagtcgacggttgtgggcgatgcggccggcggtggatcaccggaaaaactggagggtgatgccttgcgcttcatgcctcaatacacggtgcgtagtacggcatgacacaactcggtcgatcagatcgctctgggactcaggaaaacttgacttcatatatactataaatattcttccttgcagagaaagagttcgttctggattggaacagagctctcgtatctatcgaaactactaaaaaatattggagatatatggaaaactcaatttatcccttaagaggatatcccatcatttttcatgtcaactaaaaagtcataaaaaaaatttagtagaatagatcaatatgtgatattgtcacttcacaaatatgcaaattcaaattcaacttatacaagtagaaacaaaaataaaaaatttactatgaaaaaaaaatcagtagaatagatcaatatgtgatatgtcacttcacaaacatacaaattcaaattcaacttatacaagtagaaacaaaaataacaaatttaactataaatagagcggtcaaatttattgtttttgtttcaaattgtataagtcgaattttaacacgtatgtttgcgaaaagatatatcacatattgatctttcctactaattttttttaaaaaaatttgatgactctttgaacgacatacacaaaacgagggaatgtctctttgagggacaaaattccacttctgagatatatctgctattttcaaaacgaggggatgttccctcgagggacaaaattccacttctcagatatatcgctatttccaaagaaacaggagaaaacttgcaaataccatgccttcaaattgattcgttccttccatcttccgacccgtcgtcgctgccgtcgccgatcgctttacgcgatgagacgcggcaggaaacgcaagcgcgccggcaagccgacctgcctcccgccggcggacgcctcgttcccttcaattgattctctcaacgacgacgtcctcgaggagatcctcgtccgcctcccgtgcatcgcctcgctcgcccgcgccgcctgtgcctgcgcgcgcttgcgagcgatcgcctcctcgtgggcattccttcgccgcttccggacgcttcatccttcgctcctcggccacttcgccaccgacgccgacgacgagtcagtgataccgaccttccaccccgcacgtgcccagtttgatggttgctccgacgccgccgtacgaggcggcgatttcttcctcacccgcgtcgacgcaaacgctgggtggcgcgtccaggactgccgccacggccgcctcctcttcgccaacgagagcgatctcctcgtctacgacccgctctcgcgccgcggagtttccatccgtcgaccatcgtggtacccctccagccacttcacccactgccttctcgccggctacggcggtgacggctgcccgggctccttccgcgtggtgtccgtcgagcacaacggcgagcgcgcggcgcggggcgcggtgtacagctcgtgcaccggcgcgtggcggcgcggccggtgggactacgaccgcgtcatcaacccgaagcgccccagcgagtactcctacttcccggggatgcaggcggcggggcggatctactggaagcaccgcgacacgacgaagctgcaggtgttcgacgcgggacccatgcggttctcgtacgtccacctccccgagggcgtgcacccgcggtccaagtacgccgtcggcgaggcggaggacggcgggtgctgcctcgtcgtcctcgcggacgcaccccacggcacggtgttcaaggtgtggcgcctcaggacagggaaggggtcgtggccgtgggcgtggacgtgggagcttgagaggcggctgccggcatgcgaggtgatagggaaagtacaataccctccgattcgccacgtgtgcgcggtggtcgccggcgtggtgctgatctgcttccagaatcacgctgggcctcaccggcacatcgcattctggctcagcaacatgcaggtggaggccacgttcaggagcgctggatgggcttaccctttcctgatgccatggcgccactcatcacctctcttgttgccttctgcaaaattttagtctagcaaatacaaactgcgttgctttttctcgataatctgagactcacaaagccatgtttggccactctttcacgtcataaatatgtgaggttttgttaaaacttttgagttttttttatcttaaaaatacaagtccatatgcccatatgggtgcatttttttaaaagaaaatataggtgcatttaccacaaggtataacgagatcggtggaccatcaacgagtttgattggagaatcatttaacagatttactaaaaatgttgccaaattttcagcttgatttcagtgagtttcttcgcctgttggatcacacattcattctttcaattttgttatatatttgcagataaatttgctgctaaaaatttgatagatactagtataatttttattttgttttgtgttcatttgggctaatctctttaagatccagaagcctttgctagctggctctataaagtaaatatttaacctctccaagtgctaaccggccggatggctaaactcatctgggcattgacgaaggccgtgttgagttcccaactaaaaacttcacactatcacatcgaatatttggacacatgcatgaagtattaaatatagaaaaaaccaattacacagattgcgtgtaaattgcgagacgaatcttttgagcctaattacgctatgatttaacaatgtggtgctatagtaaacatttgctaataacgaattaattatgcttaataaattcgtctcgcagtttccaagcggaatctataatttattttattattagacaacgtttaatacttcaaatatgtgtctgtatatccgatgtgacacgcaaggccaattttttttttgccaacagggtctaaatttggccacgatatttcattggccaaacccacatcgacggcggccggcactaagctattccatcccattgtaggacagtgtagttgtcatctcattcagcgccaccgttgatccaccccccctcgcttctctgacatcgtcgctcttgtctcttcgacaccggcaccctgatcaggcgcatagttgactcagtttgtatcattgacatccagtgccaccgtcatcccttgtagcctcccagtcctcccccataccgacttggccttaaaagtttagatgggaataaaacttttaagtctctatcacatcggatgtttgaacactaattataaatattaaacgtagactattaataaaacccattcataatcttggactaattcgcgagacaaatctattgagcctaattaatccatgattagcctatatgatgctacagtaaacattctctaattatagattaattaggcttaaaaaatttatcttgcaaattagcttttatttatgtaattagttttataagtagtctatatttaatactctaaattagtgtctatataaagagactaaagttaagtccctatatacaaacactacctcacaacctttgccttcaactgttcccaccgccaccgcaattttttattggctccgtcactcctactgttgcatccttctcaaaattgcacgctgctgatcgaaggttgtcctgcatcgccagcatacgggtttttttttttttagataatgatcgccagcatacgggtgggtgggaaaaacaagagaaaagaaaaacactaagacactaacaagtgggacccaagaaattggagagtgggaggttgaatgactgttgaaacaaagagggttcactttatttttcgatcttgcgaaataggcaaaatgaagatcaatattttgcctcggtacgaaatagaccaatatttgacagggctcttggagagctctaaactgttgattcgatgttattttgatgaaaatacctattacagtacatatttatagcacttttatataattaaaatgtagtaatgtctaacatttacaaataactagtttttcaaagtgagcataactcaattgattaggttttttaatggagccagtcaaagaaatctttttttttaaagtaagcgtagctcaattggttagattctttgtaatggagccagtccacccaagttcaaatcctacatttaatatggtgctcacatttacggctaattatttttttaggggtaggcaacgtacatgttggcagcgagacacctgtggtgacttcgtcaatctcaagatatacttgcccagtcattcggaggtactccttctggtagaatgtgcgacttcgtcaatctcaagatataccaatccagttattaggaggtactcctccacgtagaatgtgcgtgtgtacgttcataggggtgagtgtgcatgctgtcacgcccggaatttctatccaaaattccaaacgcttacatgtgtgtgaaccctcgtccaggaatcagccgaggcacacaataacaaattgataatagagtacaattattactctagttaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcatggtgagtatatgacatactcagcaagccacgcagcaaatatgcaagtgcacaggataacaaaggatggcatagtagggtttcatttgcacaaacagcatttaataaacatttcagaatttaataaaacagttaagtaataaataaacaatattaatccaacgctatacaacataccctgttgtataggcccaacc

SEQ ID NO: 63684 - DNA, 8828 bp, Oryza sativa
gtgtgagactaatcacaaaagacattgttagacccgcccataaccgcgggcacggctattcgaatagttttactctgatcagagatgtaccactgtacccacaagacacagccctacatcatgtcaccatgtgcctcaataccaccacggtacctcggaaaggagctgtgacaataccccttgcataacacaatccaccgcagcgcaccattcctggattataaatcacccccttataaacaaggcatggactccccagcgacccccgtgggcttatctccgccacttctcagtctggtactccgcaataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttaattggctagtaattaattaaccaatcacgattgaccatcgtgaactatcattaagccatcattaattaatagtgaatcataagttatcccaatagtgtgctaatgtttctaagcatggctaagcaatcacatataatatctagctgaaccaatatgtatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacaggatcaacatgctcaaagggttgtttgggatctgtgtgacttgccttgctggccttagaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaagagatttattgcgtcagcggctagggtttgcggtggaccgggtgcacggcagcggttcacgggaacgaacggccgagatcgatccatccaaaacggacggccgagatcgatcgggtctacggcggctcacggagacacgacgacgatgacgtcggcgatgacgtcaccaccggcggcggctcgagcttgcaaactcgccggcgaacgacggcgcggcgacgcgaacggagggcaccagcacgtagagggcgacgcggcgaactcaccggtgaccaaagaagcggcggaggagcaacggacgacgtcggcgacgaggtcgaagcggcggagaagatcgggtcgacggcggcgacggtgctccggcggttgacagcgacggcaaaggagcggacgaggacggcgacgacttggcgaccatgatggcgatcttcccgagcgacaacgacgaccggaacggcggcggcgcacggctggagcggcggcgacgacggcggctcaaggttacacggcgctagggcgcttccgacggcgagagatgaaggcgagggtggcgacgggtagcggcgggcttggggatccttttataggggcaagaaggcggcggcgaaggcccacggcgaccagcgacgcgaaggaaacatcggggttcggaggaaagagaccgatccgatttgacctcgaatccacgaatttccaaacgattttagccggtgattccaaaagagaaaaggtagaggagatcccgaagattgtttcccctcaattgatttcaccggataaggaaaggcgcggccgaatttggaaggagacggcggcggcgcggcactagggtttcgggcggcggcggccggaggttgacgacgggtccgacaggtgagccccacctgtcagcgacagcgcgctcgcgcgggcggctgcggctgcgtactgggccgactgggccgagggagagagagagaggggttttgggctgactttcggcccaaagccaaaagagacttttaaaaacctttttcgatttaaattattcatgaaatgcaattccatttattaaaaatacttccttagctcaaataaatcccagaaaaatctaggaattatagaattaagcgaagtatttaataaaattttatctggccccattttatattggaatttattaattaaaattagatcttctcttctaggcttttaaaataaattctaataattccaattaaacaacaatttatatatttaggatttttagggtgtgacacatgcgttgagggcacttgcatttgtaccatgtttttttataaaaaaatagaaatctattttttatttatgataaatatggcagcataaataagaaatgcttagtctaaaaatataaaaaatggtgagttgcctcgaagagtataatactcttcgaacaaaattatcgtaagcatcacgatcatattagattatataaacttatttagttttaatttattctattataaagtcggtgattaaaaaggctgctctaatcttactcttaaatatccatttatgctgtaaggaatttgtttttcgagaaatccctgtccattgcgaggatgtgtcattcccacataagcggccaatcaattttttctacgtagttttttttttgatctttctacgtagaagtatttggtttggataatgtttggctgctcggtttattttaccagcctcagttcttcggcctccacgtgttaaagatgatgaggctgggaagggcgccctgctgctactgcttcaccgagccgcaccccgccggcggcgtcgcggccgccgtcaggctgcgactgctgccgcctgcccgcgccgcgaatacctcctcagagccggcggcgcggctgagggcggttctcgagcaggtggacgaggagctgcggaaggggaacgacgaggccgcgctgtccctcgtgcgcggctcgcagggggcggatggcgggctccggttctttggcgcggcgaggcaggttggcttttgttgtcatgtaatatttgtcctgatgttgtctcgcgattattagcagctgtgatgatgatgcattcacccgctctgctttcgttcttagattggagcatttttatgtgcatcttaaactgatttggcaaagaattcatgagccgagagggcgataggatatatttagtgctgatttcaactaatgctattcataattttgcctaaataaaatgaagctttagccttttccttttctctacattttgatcttggtagtcttttttttttctactgaaatctatatcaggtacctcaaagactttatacattggatgagctgaagttaaatgggatcgatacttctgctttcctatctcctgttgatctgactttgggatcaattgagagaaatctccaaattgctgcagttctaggagggctctctgtatcagctgcattcgagctttctaaactccaagttctgtttctgtttttgggtctactatctctgtggtcggtggatttggttagttacatcataatgattctttccaatcatctaaataaattttcatcattatatggccttttagatcatcgactttatgacttgtagctgttgatctactgatttattcaagtccatgttatggttaaaaaatctccattgctaatttattcaaggagtatttaatcatctgtaactgtggaaatatgaagtctaacatattgttccattcatacagtaatgtgctttcaatcgatgatcttgagcttttctataatctctaactgaaaaatcttagtattacttgcatacacttcttagaactctaattcatttttttccttgagctcatttcatgtacccaaaaaattaattgtctattaatgtcatcttatcatttgtcccatgtcatgaccatcagacaacccactgtttcttgatcttacacaactacagctttctaggtatatttcggtggtggagtgagaaacttgattcttgatacaattggtcacaatcttagccagaagtatcgtaatagagttattcaggtatatatatgtcatccattcttatttacatgagcttaagttctgtgagtttagaaaatttgacaatgctttcttctaattgattaaagataattcgccatgaacccaagttcataaatgataaaatataaatgtttacccactttgttcctttaccactgttggatacaattttttaatttattagtgtacaatatagtcacagttaattatggcatctctagtttatgttgttttgctgtcagaggtatgagggttcaaattttggaattgtggttcagagagaaaaatctaccaggattacaacgattaataagtgtgtcagtttgatgatctgattaatttcttatcaacagttcttagtataatctatttatgttggtgagtttatactaaaaactcgggaagtccacattagaatatatttgtaaattggtgcattaaatgggtgttaagtctgaagggataaacatgatcattcccaataatttacttggttgcagagccaacatggctggcataattttaaggaaaactaactgttgcctctataagtctgcttcacaggctttgatgcctggtataacatagatatgtatggggaaatgttttactatgagtacattgcgcagctttcgttgttagatcaagctttggcaaagtgattagcggctgaagtagcagttctttttcccccttcatttcatattttatcataaaaaaaactcatagtgatcaacattgtaaaaagtaacatgggtatttggaccaaatggtgaaggaacacatccaaatagcttacttccagcaataaggcggttgaatatcttcaaaacaacagcttgaaatatggcagaaaaaatgaaaaattccaacctattgaatgctgacgttgtggtttattttacataatctaagctaacatccttttatgtaaaattttgaagcacgaagctggccacttcttgatagcgtatttgcttggggtccttcccaaaggatacactatcacaagtttagatacattcataaaaaagggctcactgaatgtgcaagctgggacagcttttgttgactttgagttccttcaagaggttagttttcttatcacctccatttttaccaccactattttggaaaatgatgatatcttattgtctgtaacctttaagtttcgagatgccctgtttctatcctctagatttgtgaagtgtatgatgcacaatcttgtgactcgctgttgctgttactctggtcaaaggctttcttcagacaacccccctatcgactagtttgtcatggatgtacaaaatggtgaagggtaattgttagagatattagctattctagcaaaaccagagtcacagtctgaaagcagtgtactgataagaaccagcattacctatccttttttctccattctcttttgcccataataaaggatgaaatgttattgttattgcatttttatgacgcagttaataatctattgaacacgaaaaagtggatgaactgtatcaacataacacatctttaagcatatggtgaacggctgttctgatataaatttctgagcaggcattcagcttaacatgagtacatgacttctgttttatgccatttcttcctggttaaaacaaagagttgagaagataaaacttgaagtgtgtcttgatgtttgaatccttcatgatgcttatgttacagtaattatttatagtataatgcccaccagttcagttcatcatattaaaaaggaatgcaataatcatgcaatgccattcatatgttatggtttaaaaagtattgccattatgtgatcgcaaaataaatgtagtgtgcattttatattgttattgttctacgccttttttccaaaaaaaaaaaatattgcatgttatatgcggactaggctaataattatcttttatacccaggtcaattcaggcaaactatctgccacggtaagggtttctaatcaacattatcttgtataaagcatgtaaaatagactgagatgtgattcgttcagcttcaagacctattgttggttggtgataatccttggattatcttgggggtaaacacttgtcggaagtaggtcagacagcggcgacttttggtagaacggtgctaggtggaagagtgcactgattgagggagaaacacatctagaatagctggccatggaacggattagagctgaagtttagaactaggacccatttattcatttataaaagtatgcacaaccccattcttacatagttatggaaaggaatatataacagtgtaatctagtcttatatctctaaaataacaaaatgaagatgctgctggactaatgtgcatttctgtttgcatacatgaacaatgtcagaactcaaaaagagtccgtaaagcatattctgataaaaatatatttactttaattcaaattcgacatgattttttccatttagtgttgaataatgaaagtaacatcgaaataaaacagtctttattgattcaggagaaatttcaaggccttaggcctcccagtagcccccaagaaatttccatcatccatttaatacataaggcgtattatgtgtagatccattgattaaggagtggatggaaccaagagaaagggaggagaatttacgaatttacgttatccttattattcaacaatttaaatatcttgaaaactggaaattgaacaagaaaatcattacatataaacgcaggttagatgggatggagtaaagtggggggaaagaatgttaacgtcaataaatttgcacacatcttacgttttgaaattagagaagactatatgcttcataaaatggggtactttgtcaataattgatcattccctttttgaaagctcccttttgcatagttgtatgcatattactccctttgtttcatattataagatgttttgattttttttcttagtcaaacttctttaaatttgatcaaatttatagaataacgtatcaacatttgcaacaccaaccaaacaaactatcaaaatatatttaatgttagatttaatgaaactaatttagtgttatatgatttgttacatttgtgtataaacatagtcatagtcaaacttatagaagtttgactttgaaaagtcaaagcgtcttatagtataaaacgaagggagcaactattataacattgtaacttaatattcaaatgagaacatttgcaccatagcattcagtgttggtgttaagtctggatttttttctttttgtgatgatgtttgtgatgaacagttgactatacgttggatctaatggcagatgttgaacaagttctcatgcattgccttggctggagtagcaacagagtatcttttgtatggatatgctgaaggaggactagctgacattgggcaagtatgtaggcatgggtagtcgacagactctgaattttgatagccattgtggaaccacatcaacattgtttattttatgcgtccttttttttttttttttgcaattacagctagatggattgctcaaaggtctaggtttcacccagaagaaagctgattcacaggtgagatgggctgtgctgaatactgtacctgcactgcgtcgccataaaaaggccagatcacagctcgcggaggcaatgtcctctgggaagtcagttggatcttgcatcggggtcatagaagagaatataaactctgaggatatttagttagtgactataaagatgatggaaaatatagatcacatatgtacaaactttcacaatggactgtaccttttaacttgggctttgtatttagtctgttagcaggaaatacatgtcaaaatcatggtttttattcagtttcatatattaaacgtttaagtctacgttccggaggtgggataatgatattttatggtggatgcttgatgatatatactgttttttatgtttttgctatgaaggtaatgaaaaaagtaccgtttgtctgaacaatttgtattttctgattttacgtaaagacatgaaggggggagggaaaggataggttcgctggctggatgcataactgccatgattttaattcaatagtctctagagagttggtcagaattgtgttccacagcatggcttagagcagagatgtaccataggtctaaaaattacttagatactacatccgatttaaaatatagtaatttttagctatatatttggacatacttctcagataagccagaagttattatatttagggacggaagtggtagctaccatacatttttctcttctgataggtgctatactccaacgacattaatgggagctcctgttgcatcgacggtgttcatcaatttggtcaggcaaatctcctgttgcaaaatacaccatcaacgggagtatatacaaacgatgatctctttttccctgcacgtttctcacgctgaagttcagttgaagttttttttttttctaatcattattaacaagttcttggatgtccttggtaatcactatccactggagcacagagaagctggcaccgtagccaatctctactcgtattagacaatcaagactaacagaggagatcaaacaaggtgttgacgcgaaaacctgtgtcgaaaggttcacaggaaagtgtacttagtagatgaactgcaaaatttcaagacctaaattat

SEQ ID NO: 63685 - DNA, 577 bp, Oryza sativa
agaactaagtaaaaaacaggtttagtaaaaccataaagaagagggttcgaaccttggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgctaaagaggttggcgctgagccgacggcctatttctagatatagtttttggtgga

SEQ ID NO: 63686 - DNA, 641 bp, Oryza sativa
ttttgtggtatcgtttgtgtctaggctcgcgtctctagtacgttctagcctaggaccagcacggtacttgactttgaaccattattcaactttgcattctctcatttgagcatttgcattctctcatttgagcatttgctatccctttgctacatatttaagcctacccagagctccacagatctgattgcagccgtacagcaagtgtttgccaaggcatcgatacatccaacctccattggggtgcttggttaagtcggtgtacatcaccattccgcttgctttagtaagaacttgtaagagcttggttaaaagcttgagtgtgtgtgatatttgagctgccactacctagtagttgataggagcgtgcatatttttgtgtgtttcttggttgctactaaccatggtaggattgtgtaagggaatacgagaacatcgacttctacaccttcgacgagatatgacgacttctccatgtgatgcatatgaggtacatgactattattttgaacaagtgcatctaagttaccattctatgatgggaagtatgattcttgtgcatacattggattgggagctagtagtagacaatgaaattgatatatatgaattttctgaagctcaaatgaataaagctgcta

SEQ ID NO: 63687 - DNA, 644 bp, Oryza sativa
ggtccatttgcagctggtaatggacaaaatcagagtaaggatggggggctggaaaaacaagctagtttatcaaagcaggtggaaggttcttgtgcaatcagttctcagtgccattccaacctacttgctgaccgttcttaaaccaccaaaaggattcctagatgatgttgacaaagcgcgacgaaaatttctttgggccggagactaagaaagcttgggcaggaaatgtaaagtgaattggcagcaagtatgttctctgacaatacatggtggattgggcataccttgtttggagaagttctcacgatcgctgaggctacgttggctctggtatgagtggacaagcccgaaaaaaccatggataggaaccccgccgccctgtgatgacactgatcgtgctctgtttgctgctgccaccaaagtatcggtcggagatggacgaaaggcgaaattttgggaatccaactggataggagaccagccgctgaaatacttagccccaaacctcttcaagcactccaaaaggaaaaacaggtcggttcttgaggcaataaccaatgatgcttggatcgaagacatccgcggaggggtgacaatacaactccttcaggaatatatatgcgtatgggaagtgctccacaacg

SEQ ID NO: 63688 - DNA, 1023 bp, Oryza sativa
aattcggcttactggatccttgaaataaatgaaacaagggtttgttgaaaaatagttctaacttcggaccaatagaaacctgttacctaacttctcatatacaacttatttctccatgctttagttgcttaagagctctgcagaatggtgattccgaggagttccatgtgaagctttctaactccaagatggtatttaatttcatctgtggttcacttccctctgttggatttattgtgaatctagcttctaatacttattattttatccccttttaggatcttgtgctggctctttcaaatgctagcaaggagagcacaaaatacatccattctactgttatcaaactacaggtactggcttgttatcttacaatgatatacttgttgtgatacttggtatgaggtacattgttactctcttttgttattttatagatgttagatcatcttactatggcttgggacctacgatggaaattctgtctcaatcagacatcaaagtcttatgttggaaacaaggatttttctccagttccaactgttcctacaaggatgcaggtttgtttcacatctgttgtagtcatatataatattttggctagttctctcattattttgtttgaaataaatgcgactcaatttacattcagatttcagatgtaagtttgggaactgttgtgtgtctatatctatttatgtaacctttttaggttgccatgtgcaagcgttcgcgaaaaaggttgccatgtgcaagaaatacccccactgtttcacagcattatacatgtaacactttagcatgcattgtctgttcttatggagatagttctgacatgaacttctgttcaaaatagacaattggtttccttcacatacatgtaacactgtcaaatgtgcatcgaggttgatacagaccagtcactgtcttatattgacttttgtatcctcccactgattgtaaatcactttggatgcctaagatagtagaatagctacatgtacatgttctttttcattcccc

SEQ ID NO: 63689 - DNA, 601 bp, Oryza sativa
  unsure (1)..(601): unsure at all n locations
ttcatctgataccggtactccttaacagttaaaagctgcctaagaattatgctgtactctatcagaaagctgggagcatcttttacaacctcccatatatgactgaaaagtttcttagcgacggaaatcaaaagtaacgaccgccctgcagagacaatgaacctcttgtttatcgtcatacagaatgtaaaatattccacttcaaagcaattgaaaaggatgtttgcatatctggttaaacgcgaagcatactgctgggtgtctggcaagtggcaagtgagaagatgcataaataaacaagagtacatgaaaatcaggagcatcccaacaccaaaggtatgagcattactagcaggcatgcatgaaagagaatgcctgagcacctcctttcagccctcagcagtattctttattggaagttccacgcagaaatttacgagtgaacattaatgctgtcatgttggagtagacatttgacaaanaggaacggatgcggataaaataaacgttaaattgggttaggaataggtaggcaagatgagtcggggtaatggtacacatagcataagtcatggaatgtgcaagtagctgcaaaatgtgt

SEQ ID NO: 63690 - DNA, 1852 bp, Oryza sativa
aagttcctagactctcctcttctttgatctagcctcagagcctctaaccatgtaatagtgacgcagatggttacatgaggttcctaccctctgttctcatatcatacattcgtacccaacaaattaagtactagtagtactggttttaaatgatcagtccatgtagcctttccagtacacatttagttcttaatcggccttgtctttttaatatttgttgataagtcatcttttaatattagtgtcccgttggggacaaaagagctctatagttctagagaatttgccctgtttcctataaaatccatgtaaaacaaataggactaaagttgcccatagaattgttatcatagctttgaaactgggaatcgctcgaaccagcaagcccactggttcactggtttcgattggtggttcctatataataatattatagtggtttggaaaaataaaacctaaagtaagctgcctttgttgataatattacacatattggtttatatatattgcttatatgttgtgaattatctgtgatccatgaagttcatgtcctgcctttacactccagcttgaagaagctaaactgctgagagctcaagggcagcatgatatggctataaatcttgggaaatacattctaaagaaccatcctgataagaagaatgtatcagatgtctatcgattagtcggcaagtggttggctgaaacaagatcgagcaagtaaccatttatttttactttgtgctttgcacttgtttcatgtattgagaactgttctctattttctgtttgtgatatatgtatatatatattgtagttcaagaactatcattgatgactacctaaggcattccgtagattttactgaattgcacaagtgcccagacaaaaagtacaagtctaggcagtgccgaacatatttccatctagcgcattacacagatggcttattcaaaagctatgaggaaagactttcatccaacgaatggcaagcagctctgcgattaagaaaatacaaggtaaggaactaagtttgacagtggcatcatatcgatatcgaacttgaaactgtatatctcaatacattttctatttaatgcagtctaaggagctggatacactgatgaaaagacttaaaagttcatcaaaggtaagcactgcattttttcatggtgtctgaaaatgtcaaggagcatgggcactgttggctactgcatactaatccttaaaattttcagagtgaaaagactgattactcagtgaaaatccaagagttacagaaacaacttgcacttgacgaagaagaggcagggaagattcaggtgtgcatgtgtagtttaaagtatataaaatatgcctctcatgatgcattcagtcaaattttcaatacgcctatctggtcacagacctatccaacatcgaggtcctgactccaacttaaatatagcatttgctgctatcacaaattcatcacgcactatatcaatagtactaaccagatcaataaccatatatccacaaatattgtgcttctggccacagcaaccacactgttcatttttctatgtgtgcatgatgcggtgttctaaaaaaatttctaacaaaaacacctggatgatattttatgccttcacagtgcacacatgccaaatttagcgctaaaattcaaaaaagcagcaaggtaacaaacattattgccactatcatgcatcattctcctgtactactcttttcagttatccagaacctgcatcatgtgctattgtcttgtactactccctttttttttgtcatcacaagtatttaatatcgacaagttggaccttgaaattatgcatgtgcatagaattac

SEQ ID NO: 63691 - DNA, 2024 bp, Oryza sativa
gtatttggatttagatctttatagacataagaattttgagattagctattgttgaagctacacctggtcgtgtggttgatgtcgtcgtagacttgtagttctatggtacttaaggggagtcagtttgatgtatgttctggtactggcagggcaatctagatatgaccctgtgacaggctaaattctaatgttcaatgtttgataacaataccagtttctaggtttcgttaatcattgatatttgtttggagtaaattccccaggcatatactacaagtaacaagtatgtaatgactctctagacctaggcccttgatattataatctgccttcataattgaataataaaactctgtaaattatccaaacatactctgttagccatgaaccaaatatcactgcaagaaatgtatatgtggattaattttttaaaaaaaacattcaaagaatttatgcatagctgatgtattctttaccttttctgatggtgcttgatttcatccctgatttattcttggttttcctgtatatgatatttgcttggttgaattggtgagtcttaagctttactggatctaacatgatttgctttcgtgtacaccaggtgtctgtaatcatgcttttcacttccattgcatcaacaggtggctcaagactcgccaagtgtgcccgttaagtaattgcagttcctgtgtatgatttccttctggagttaagtatggtgggtgtgtgctgatcaatagcccttgttccatcttgcagataacagtgaatgggaatttcagaaatatgggcactagacaccaactgctgtctgcgcttgtttgttgccacggctgcgctacaaacacaagccgtatcatctgccgaacagctccatcgttagcttcttttgatgccttacatctatcgctggacgtttatcgtgcgtacttgtcccatacagggattgtgtttggatgatttgtagagagggtactgtatggcataagatccttcatattaatgttctgtgggtcacatatcaacttgctattattgtattcagcggttctctctctattttgccttaagctgtggtaccattttaagtccagtgcttgcttttgattgcttttctgagctttccaggacatggaatcgagcctgtgaatgtcgtcggccggtttatcctttcgactaataatttaaattgtccagtgttggttaggaatggagtatcagattctggcggtttgcatgctgtttggtcggcgacgtgccttatcctgaagatttatatatagtactttgattgatgtcaagaaggaaatttctttaagaaactttttacaaatagcgattggtagaactgattaacaacatccacggctcagaaaaggaacgcaaacatatttgattcttccctaaattaatttgccattgttatttttacttgaccatccgtcaaaatttacatgaatacacaacgcacggacgaacgatttattcatgtgaaggcatgatttacatccttaaaattctctcgcatctagatatagctagagagtggccagctgctgactatgcatggagctggcacggcagtagtgtacaatgctactgtaattttgtattgctacaagtactagacaggtacagggctgaggccagtggatggctgtaggctggcagcatactccctcgcccacagatcataatgtatgatctcctccagtgatggccttgttactagctcattccgatgagcgtcgcatgtcagctccaccaccttgaagatgtccaggtacccgatcctgcaaaaacataaccacaatcatctattcatttgcttatatatatgtaaagtttatctgacgggaaaatgtctacttgcaaagaaatagccgcggaaacattaattcaccagattaaataacttgcaatgaagttttgtcagccattcaccatttagaaaacaattcgcccttcgacaaaaacaaaccttttattatgcaccaatggataccattttggtacttacc

SEQ ID NO: 63692 - DNA, 543 bp, Oryza sativa
ttttgtgtgagagagttccacccaactctactcccatttaagctgaactctgaaaaaggtggagctgaagttggaactgtaccaaacaggcctgtagtataaactgatcgacatctgtgacaagtcgatacatatacaagggcggaagcaggaatggaagtgaaatacaattcacagaataatttggtccatggacgatattgtgtggtaaaggttagtgagggtcaagagtctattgcagcgagtacaatagcagattataagtcagttgtatgcacatgtggaggagagaagtgaagagggagaaggaaagcgggctacagatctgtagccagcagcagcacggaggattccaatacgttgtgtgtgtagtatatgcttataggtaactattgtatgaataagttattagattggttataaatgaattggagtttgtagtagttggttgtagtattaaacttgctcttactcaagtaaggaagtaaaaatttacgtctttgcccctgctcagtgtaaaattgacccctgagcacggtgatg

SEQ ID NO: 63693 - DNA, 10885 bp, Oryza sativa
tagccagccaaggcgaggcccacgcgcgtgcaaggatattcagaacaagttcagttaactttttatgttttcgtctgaattcagatccgcgcgacggaatcagaatttctcggtcaccccgcatgtgtatcatatggttgggcgacgcgagcacgcagatctaatgacattctctgttgcattatcttattcgttcaaagagacattgcaagactgacactattaaagaaagagagaaaagaataggaggaaatggaaaaggaggaagaggtggagagtaactaaatgttaaccatatatcccctctatgatacgatgtctgtggcatgcaggctaatactataatcaagcgtgattaattaattagtagtattgctcgccttgataatttttggttgttaatctgatcgtctcacgatttcctcgatcggcttgcttttggacgcagggatgaggaggcccggaacagccaaggaaagctcgtaattccacatgcgcgacacgcatgcatatcgatcagtggtggaggcccaggcgaggagcgaccagagcagcatgtgggtggtgcatgatgtatgcatggtccatgcatgcacggattatgatagatgatggtatctgcatgttcgtcgttacgactggaacactcgatcgatatacgctttataatacatgaaactcgcacttcactgtcttgtgcggttcgtttttttttaaaaaaaaaagtatatgtgtcctcctatccgctgatgggttgttgctcgtttgtgctacaaagcgtacactcgtacatacttattcttttctaaagaaaggtctatatatgtacatatatacagcaggggttgcatgaaaatgggatattattgtacatgagaataactgtaggatccgagcccacatatcaacatatgatggtttttttaagtccgtcaattttacggtgttaccaagcaaaatgatctggatatatgatatttgatattatttttttgacggtgtttgagatgcaactttaataacaagtttttattagaattaaggataaaaatctgataatttcatgagattgtggaaacccatttcaagatagatctgcagaacacttacaagttttaaattttaaattcattaacagtttaagtgaatattgttaaaggcttgctcaattgtctagtcttcaatttacatgtcgtagctaaaatttaaattttaaaacttattccctctattcaattttaaatgcaatcatgattttccgtgcacaacttttaaccatccgtgcacaacgagacagagggagtataatgatcagatagcagcttagtgctagagtactacttgtagtatcatatatatgtcgcccagtttgatttcatttttccagtgagtctttgtctgatctgaaatggctcatacattttgtgatgctcgtggtcacagaaattttatacttccacgtctcggtagggaaaaacaactttactcaaattttgatgtaatcacggacgttacagaaaaacagcacacactcatatgcactcctggagttacaaaaggaacccagtgacaaaaaaaatcatcaaatttaattacaacgcgaagaggaataaagtactcgcacacatcaaatttaattactactacttcgtattagaaaatcaccaaggcaaagcaacggcatcatatcatttcagtgcagcgttgattagttgttcggtggcttttctcctccagacacattaggatctcttgatctaatctcgacgcgctgcaaaagtaacggaattaatcctgtgagatgagcacaatggtgccagtggatttgcactacgactgtaaaattaatcaggcagtctgagaaattaacaggggcatcctacctgcacagttgacagcttggtgggttccttgacgcccttgtctccggcgccgcggccgcagccggcgacgcgctcgacgaggccgagaaacctgtccttgagctgagcagcgaacttggccatgggagttagcttgcttgcttgcttcgatctggagctcgcaaaattcagtgtttgctgagctagctagctgctgctgatcagtagctggctcgctgcttgctttgcctgcttgctggatgcctggatcgattgccgagcgtcctatttatacagagaacggtcgtgtgtgtcccggtcaccaaacgcgtcagctttcacaggaagaatcgcgtattcagattacgttgctgcgcttggtctgcatttttctgatccacatcattccgatctatgcatgcggtctgctaattctatggtctcatcatgcaaaaatcaaaaatcgattgcatgggatcacaattagttggcgaaatcgcattgttaatttgttgcagcagtagtactcatgtctccccggatctttggggtcacatgagcaacgtcgtattgccgttgttcacagctgcctcgaaacagctaggaatcttcgcgattcctcacgtgtgacacatgcgtacatgcgtttcgcattttcgcccgctgtaaaaaaacacagcccatggacttgtccgaaaagttcggggaggattaggccggggcccacgtactgttccttttcctcccgaactctcaatctgagttagaacacagttttttattcaagaattggggaaattttagaaaagaaactgtgagcttctagatcgaaaatggactttttttttggctaatgatgcgtgttcctttcctaaacaaaggtggatgggttataaggtcaggtcaccctcgaccgacccggccggagtgcttttttttttttgggatccaataaaagtacaataataatttgaaaaagaaagcattgtaattatgtttttcttgcacaattatgaaaagtgcggctgctagctctcttttgtaccagcacagatcgatccaggctattaaaagttaaaacgactggaataattgtatgagatgatgattaattgtttaagatgttgtgtctgtatgaaaaacgagaccattcaacatctttttatagattgtcattatgcaaaatttatttggagagcagttcagttctcatttggtttataccttcctggaaccatatctaatatgtttgatggttggcttttgagggttgacaagaagaagagtaaactcatacttgtaggagcatctgccatatgttggactctgtggttgagtaggaatgatataatatttgacaaatcaccatctatctcatatttgcaggtaattttcagggcaacatattggctccggtgttaggcacagctgcaaaagtatgaagatgatggagagcttatgaaggttgcatgtcgcaggcttgagacgacagttatgcaactttttgcaaactatggatggagatttacaaatagacttgaataaatgtgtactccttatctctgtttggtcttttattttgttgggtgtgtttaatttcattatgaactacactcttcgtttgagtgatacattataataattggctgtagttttgatgagcaaaggccgaaatgttcattccattatctaaaaaaaatgtactagtcactctgccaaaaaagagaggaaataaacaaaaaccccgatcaccgcataggtggcgacggcgaagttaatgggcagaaatcctccaggcccacggctgagacatctatgggctacggcccaatagcccatgtagcgtaggcttgatcggctaagatctggaccgtcaggccatctgatgggccgaataaaaaaaatctgataggctactatactttttctgaaaaaaaaaacgcatggtacacagctcatttcatgtcagtacgtatacagattgggtatctgaatcgatcatgtacgtaccacggagtacacgtactgtacatggtttttctactccacgaaagaaaaatcaaatcagttgctctgaccgtaaggcagttgttgtacatgaagcggcgtcacatcaagtgacattgcactatgagattcattgccgtgcattcggcttttcaagaaaaaaaaacatttatgtggatggagatgcaatatcttctcgatctagaatgtgatgcatacacacatttataattaagaactggctctaccaatttcgttagctttacagcttgcaactactagtaatacatttgggggaaccatgcattcatatgcgttgtgttattattcggtgtgtactaaaagatctagagacataagcgtatgcatgctctcatagatcgagtaatctgatcaagaaagaaacaatacacacaataaatatccaactgagataagaaactttctgaatgacatcagacacagatcagttatgaagctcggctcgtaaacgaagttccatagatttcaacaccgcagagtacgtagttaatgcctgcaactacgtaaggagctgggtacaaccgtacaaattaagtagagaacaatcaaacagcatgaacaaacgaaaaataaataaacagaagctgcttgccacatgacccattttttgttcttctatcctagcttggttcaccgcgtgaaggccagcctctctccagccggcaacaatgccgctcgccggcctctatcagcaatgtacatggctccagccgacactgctagctacctgcccgagcagtagtgagcacttcatctcctgaaacctatatacatcatttgcgcacgcgtgcatgaagtgaaagacataacctgaaaaccataagccgaagtaaattcagaagtacatgcatgtttgctagacaagaacaacaatcgcaggaactgaataattaatcaagaactgtgtgagatcgagattattaccagttgttcaaaacatcaatcaggattgacgaggatgccatgcatgcacctactaattaacaccaatgcatgcagtaatagagctagatatccatgcttgcgcatgaactcacatgatacaagcaagcatgcatatatctctggccttctcaaacttggatagaagagaggagaccaggaggtagcaggccggaacctctccctctctggtcgcccaagggctctcgcactggagttgcaagtgattttatagccggctttgcacagcacacacgcaggcagaagagtgatggggttagtttaatcaggtgaagatgcatgcatggctagctagctatctcgtcgttttctctctagctagccccctgcaggagcatgggcgctgccatgccatattgccatgccctgagctctgactcgtagggagatatcatggatgcatagcagcatagggcttgtccttttgacgcccagaaaagacccaagaatctctccagcgcttgttcaattccatgcaaaaacctcaacttcagtgcaagatgcggcacatcatatactccatatattaataattaatctctcctcgcccaatgtatgtgattagttacacagcaaaaccgcggcagctgatacatgtgcgtatgtgatgctacaaaagtgcgttggcggtatagggttgtgtcgtataggtccctaaactctcaaaatatatatccaggtcccagaagttgtcaaagtgtatcgtctactccagaatcctacgtggcgctgatgtggcaacgccacatggacgtaacatgtccttttctttttctttcttcttttctttttcttttccgttttcttctcattcttcttttttttttctttcttctgtacggatcacagagaaaggagaagaaaggggacaaaagagaagaaaaaaagaaaaagaaaaaaattaaatgtcccatttgtcagttaaaataatgccacgtcatgttcgtgtggcatgccacatcagcgccacgtagaattctgaaggggttgtggcgatttgggatctagatgacacactatgacaagttttaggatttaaatatgcattttgagagtttagagatctaaatgacacctttacaagtttaagaaccgtccgtacactttactcttttgcaaattaagatgccttcatgtgcaggtaatttgtctgcatgatgcacgtagtatatatgcacgtactccacgagagatgtgagatcgatgtcttccaagtacactactttaccgtcagcatcatatcacgaaggaaaatctggagaagcttttgacatttcattttagctgcatcgatcatgcacccgtgtgagtcctgcatggatggatggatggatgggatgctagctgcttgcactttgcagggtacggccggcccagcagacaggcagggagacaggggcagcggccggcaacttaactttgccgtagctagtgcatcgcacgtcgcgtttagtaggctttaatttctgaatctaattaagctttgcataatccaatccagtcaagcacagaaacactaacaaatcgcagtacccaaaagccttcgccgctaactgcgcagtcgtcgagacgaagcgctgtttctctcgttattttcaacccaagctgtatgtgctcatgtgtcccgtctggttgtgttattgctggggatattctagtttatggaactgcgtgacgctgtagaagtaaattaaagagagtggattttaaactcaggaaagaatgttcctttggtgtttacatgtcgctaaaataaatacaaaaatagaaagtgtatgtattaacacgtgacatatcatctcacgaacaaataagttagaattcaacttttacatgttataaaaagaaaaacaaatttaatcacatgttaatatacttttttataagtgtcatataaataacgagtgaacatctccttcagagttttagaatagtttccccgagtaaaatgtaagtaaagcactgaccaaaagcgcgcggcactgtacaccagccagtattatgtgtgcgccagtcaccgtatcagtattcagtatacgccatgcatgcatgcatgcgacctactcctaggtagctagcccatgcgtcatttgcagcagatgagcaggggcagctatagctgctgtcttttggcctctgcatctgcagatgtagctagagcctgcaggttacgtgtcaacggcgaacgatgtggggagccatgcgcggggctcatatgagttgacgcctaggtgttgttagtttctgtactaagatgaaaatgaagttaactcatggaaaacaataaaattattagggtataatcaattattacaaatttaagagaaatggatttatactacaatatgatataacattgtgtggattcagaaaattggttcgatgataacataatataaatatcggcgtcataatatactatttatgcttagctagatatagtgttatcctagtcccttcgtcccataatataagtgattttgatattttgcttgtattgtttgaccactcgtcttatttaattaatttatgcaaatataaaaaataaaaagttgtgcttaaagtactttggataataaagtaagtaaaataataataataattttaaaattttttgaataagacgaatggtcaaacagtgcaagcaaaatgttaaaatcccttatattagaggacggagggagtatataaataaacaggttaatcataagtttttgtccaaaaatgatcggtgtcgcggcgacacctaaacattgtagatctaccctttgtgtctgtggctctgttgcatgcaaaaggataaaattttgaacagttgaaatatctgaattcatacttgacatgtaagagaataccaaaagaatattggatagctttaaaattcgtgtattacccaccaacccaaaccctttctctctttcctcctctgtctcaacattatcacttctccaccgccccctctgctagacccccttctccaccaccatcacttaatcgcgctattggctggcctcatgtcacgccccgaactagtgccgaccggaactagcccgtgacgctccaaattaacctgttaatcgataccagtcccaggaaacagtgctggtatcacagggagacagaatatcacagcaacagaggtctctttattatagagtaaaagtacagtcatgttgggctgcggacagatcccgagctcacaactgcattacaaaagggaaacggaagccacggcttggaccaaacatcacaggcgcgacttgggaactaggccgaaaccctaaaactcttcgtagccggcttgctcctagaagaactcctcatcagccggatccgcttcatcttcttcagcaactgggggggattatttatatagagcaagggtgagtacgggagtactcagcaagccaggggaaataaggtgtttaatgcaggcttcaaagaaaggctggtgtttttgcaattgattttattcgaactcttttctgaaacaactaagtgagtgcttctcaaacgacatggatgagacagtgcgtctcgtccgaacggagtatgtgcaatgtatcagtctttagaattgaaacaaggttggcacccggccaatagcttttcaacggccacccgggccaacaacttttcaaacggccacccgggcctagctgatcccatcagctacagatttttcaaacatcgaacctcttttctcaacagcaatttcacaagcagtagtcaaacaaaactacgctaggaatcacctcacatccgcccatgaccgtgggcacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccatatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcacaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaagggggcatggtatcacaattaacaaaggaaggatcaaatgcaacaaattaggtagatctgccaatctgccttgcagacgggacaacagattaagtgcgatcctatcaatgcataataattttcaagcaacataattaaatttcaaatataggctcaagatgttcaaaggtggcttgccttgctcgagatctggagcttgatcctcgtaatcctcgcactgcgggtcttcgggctccggaactacacgcgaaacgggacaactcaacaaacggcgaaaataaagacctattaatgacctctaagcgtgccattagatagatctcgagatttgaggaattttggaagttgaacggagtcaaacggacttacggttaggaagatattgaatttctaagattattggatttttggtctaaaggaaaaggatttaattaaatcctttttggaaaagaaaagaaaaggaaggagggagggattatagacttttcctcgggcggctagggcgcggcccaagggaaaaaggagcggaccggccgagctaaatgggccggccggcccaaggcggcccaagtgcgcgcgcgcgggaggggaggagagagagggccggtggactgggctcaccacgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcatggctcgcagtggaacgcgcgcacgggaggggctgaccggggtcggcccttcccgtcctcggctgagctggcgacgacgtggcgcctgcgtggctgccacgtgggctggcgggaggtagacgacgacgccggccggaacggacggcggacaacagcggcgagcggcggagcgaaccacggcgatacgggcaatagcgagcacaccgggtggttgcacaggacgagaggagacgagccaacggctcggattcgccggagggagttcgtcggcggcggattgcggcggcgacaaccggcggcggaagaagggggaaacggcggtgaggtcacgaggggctaattcccggcggcgagagcatctacgcggctacgggaatccgatgctagcgtcggattgggcggagctacgccgagcgaggccggcgacgagcgggtgctacggagctcgagcggcggcggcggcgagcactcggcgagcgacggcaagggtcggggcggcaccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcgcccggagtccccttccgcgtcctcgaacgcaccggctcacccggcgcttggcgaaggacggcggaggcgagacagagcttggaagacggcggcaatggcgcggacgagaaacggggaggaatgggggaaaagggaagggagggcgcccggggcttatagggggcggcaatgtcggtttggaaaccga

SEQ ID NO: 63694 - DNA, 1205 bp, Oryza sativa
atgggccgagagaaattcggcccatcgaccccgggggaggcaaactagacttttgcggagggatttgatttggaaggatttggattcggaattgaactcgacgatagatcggggattgagatcttgagagggcacggacactagacaacaagcgaagaaacaaattttgcaattagggtttttaagagataatttttccgctaggcgccacgacagaacgggcgctacacctcaccagcactagaaggcactaacggggctagtgaggcccattagacctccctctataggcctccgtgcctctctccacctcaagctgacgatgacgaggtggcattcctacctcgccgtcttcctcattttcaatagttccccgccattagttttgctagcgcatcacacgtacgatcatccccataagttaggggaactacccccttccaccttgacctcatcctgatacctaactcggatttgctgctgccatcgttggagatcaacgagcttgtcagggtgggagaagaaggccctcatcggtaagccaagagttttggctaatcagacaaagttggacttttcccttaagctaaagaaaaaccattgattggcttaattggcttgatgaggattttctgtggctggtggtcatcagcccaataagcgattcaataggctttagctgaaaagtctcagcccaaacatccatctgacgaggcccgaaatgtatgttttagagaagagtgtacgagtctcggagtatattggatggtctagaatctgtaatataggggcttcgattttctatcaaatggagactattgtaatatcccctcatgtgtactggtgtgttgactgttggctgatctgatctttccgggtgtctcgagttgttaaagatgtttcaaatttagctagtgatcgtgtgattttcatgacatacctgtaaattccattttacgttttttacatactagcattgtgagatgttaattaacagtttaaaattttcaaatgtgtatttgtggccggaggtagcaagagattttaaaaaaataaacagagatggccatgcacgcgcgtggtgtattaatttcatagcctcacgaagaacacggcgagctccgggcagtcgccgccgtgcgggctgatcatgtagagcgactccgagttcctggagccgatgatgtgctcgaagctcccacgca

SEQ ID NO: 63695 - DNA, 16060 bp, Oryza sativa
cagcacggcgatgtcgtcgtcggtcgggtctcgccgcaccgcgtaccccaccttcttgccgttgcaggacatggtccacatggactcctcgagcacccacccgtcctgctgctcgcgctcgcgcctcgagctggcgccggcgccggcgccgtcgccgccgtccgccgcgcgcttctcgctctccagcacgatgcgcgcgccggcggtggtgccgaggtcgcggagcagcgcgtgcgtcgggagcgccagctccaccaccagcgtcggctggcaccgcgggttgtcctgcagggacagcgcgatgcgggcgtcgcggtagccgaacagcgtccccgtcatgcgccggcgcgacgccccggcggcgccggtggaggccgacgccacgagcttcgacatcagggaggcggaaggggacagccgcgacggcgccgcgatccggcacgccgccccggccggctgcagccgcccgcaccccggcgtcagcaccgggagcgaccggcacatggtgtggaacatcctcaccggccgcgacggcctccccggcctccgccgcacgggcggcgccgcctccagcgctcgtcccgccgcccgcaggaactgcttcttgctgccggcgtcgtcgtcttcggcgtccgacgacgacgacagggacgccggcctcatccttcgtgaaccgccgtcgtccaccaccacggcgtgatcggccatatcttccggccgggccggggaagcgagcgagctaccggagttgccgccggcgctgctcgctccctcggcgtcgcgatcgatggatggatcgtcgcgggggcttcgtgatgcgctgcgtgcccatcgggagaaggcgaggggagaggcgcttttgatgcgggcgaagctggagctcgcggcgaggcgaggctggtttgggcagtttggcgagtttggttggcgtggttggcgggcagcaactggcgccaaaacagccggcacggagaccggttcggcggggcagttgcgcgcgcgtgcggtgggagttgctgtttttgcggttcagatctgcattctgcttgagtctgatgggctttagagttagagcccatcatggtttgtgtgtgtacgtgtgcgtgcgtgcgtgcgtgtgtatcagcccaaacgatatcgctgtatcagcccaatccgaagggaaataagcgattcggcggcctaactttcacaatctttaatttgcttcaaattgcagtttgcagagggcaacgtgatcattattaattcgtgactttggcaggacaggacgaggttagtactgtctctggtgcagctgcagtgctatcttaatgtcttatcaaatcagtgatgagcttgaattaatagggaaaaagatttgagaggtcgtattcgtggtagggtcttccgagttaagggggtgtttagatataagggtgtatagttttgacgcgtcacgttgtatgaggtgttcggacattaataaaaaaaaccaattacagaatccgtcagtaaacagcgagaagaatttatcaagcctaattaatccgtaattagcaatgtttactgtagcgtcatattatcaaatcatggagtaattaggcttaaaagatttgtctcataaattagtcgcaatatgtgtaattaattatttttaagtctatatttaatactttatgcaagtgttcaaacgttcaatatgacagggtgtaaaatttctgtgtgtgaactaaacatggcctaatattagtcccagtttctaatgtgtagtttcgggctttcgctggagctgttctcggattgaaaaaggaaaaatcattagcatatactactctctccgtcgtaagatataaaaatcggataaaacattttctaatactacgaatctggataggcgtctgtttagatttgtagggctaaaatatcctatccaatcatagattctaatatattagaaaagaagtaattacttatatagtatgaactattataaatctaaagatttcccaaaaaatacttttatataagttttttttaaaataaaacatactactacatgctaataatggataacaagtaccgtttcgagttgttgaaaaaaacttgatcatgtcttcgttttgcatgaactactaatttcgcaaatggccatggttttgttcccgctgatcatccatgtcttcgttcgcgcttgttagacattattgtagccttctttagctgcttctaaatgtaacgatgcatttctctcacctatcaattatcagggcaacaactagataatttgctgacaacattctcgatcagaaaatcgatttcaggtagctagcatgcttacatcgatcttgtagacctgtactccagattcctcagccagggaactcgacaagtaaacccggacaaactatctgctcggaaggataagaacattacattagattacagaatcccagcagtgttcgttaaacaataattaagaggagatgctgaccgatctgggtaacaaccagaggagagcctgagaccgcataattaagtaggtcatcactcgccagttccctccgggcaaagaggcaaagtcgttcatcatacctccagttcacgttagtctacatggtacataccgctatcaccttcgacgtttttccaaatgaatccatggaagagatcatcgatcgtcggtggcgatagcgatgacaacgagctgtacacgggccattatagctttcgtttaattctttttctcaatgaaactattagattttcttgatgagcatgcatgtgcgctgcagttttcctgtaggaatgttccaatcgagaagaaaattaagtgctccggccggtcatgaaaacataacgttttagatatgctttttaatataaaaaaacgtcaatcttcaaaaaaaaaaaggatgtatgaaaattgtaggggtagattgacaaaaaaaatttcataatactgtatcattttaaaaatatagaatttgggagatgattttaaagattatgccgatgtctgaaatgttctgaaaagcagtatataggccagactagactagaattctagaaaggttatagaaacaaccattacaaaattttcattcatgatttgatcacctcacccaactctgtaaaaacaagaggaaattaattaccggttggtagatgtctgaagaagacgggatcgtcttcgttcaaaaagaagagaacgagatcgtccgtgacgtgggttattgccggccagctgaaatggaatccggctggtaggtgagctggggagatagattcatagatatccttgaatgcctcgcagctgctttggtgcgaccaggcagtcaggcacagagacgctgtgcatgttattaactgctcctgtattcgtccgcatcaacattcctgttcagttttcgcgttgcagtagcaggtgtgccttccagctgcaccggcaaaggtttcattgctcaattgctggttagttacaaggctaaccctagcttttactgataatagcatatatatagctaagtggcagatattactggctcttgtaccttcttcaaaaaccacaacaactgatgagtaatctgcttgcagatatgcagatatgctttgtaaatgatatatttaatgaaattgatttgaaaatatattggatgttggtgtgagtgcatgtgactaatatgggtcaagttgtgatatatgtatctagaaaatttaagctgattcggtaatataatgatatcggtttctctaaaaaaattagttttgtttgattatgtttaggtgacttgagatcaatcttggtcaatagtgatgaggaccgagactaaagctcagaactaaagctcagagagaagctgaggtttgacacggccaggatactatgtgataaaattagactagatttaagataattaaaggtcaacttcgatcaatagtgggatcgaaactagatttagagaaaagttgagatctatttgatgatacatggtgaatagtcatcgcgtgaaaaagttgtttgtgatgggcttcacatgtagatgtgcaagcgccggagaagtcgtggagaaattggttgagaaaaataggagaaagctaagagatgtgcggtgctgcactgctacagtagcttggtgtgcatgcatgggcgtgcggtacaactagttgatttgggggtatgtttagattactgccaaaaccaacctcatcgaaatttggtaatgttaactttttggcaagttagcataattgccaaattttgattggacggaataaatatgctctatcataatttatatgttaccaatatttagtaatataaattaaatacaactatatatttatgaatttaccaaatattgatatggtctagcaccaatctaaacaggcccttggttcggtggcttggctagctgggcctatgcaacgggagcggctgctggccgttcgcaagcgaggcaacaggcaagctcggctcggccaggaagctggtcaggagcgagcgcagcagagcgagtccgaaacggttgtgttggtttccagctttgcagaaagaatttaattttggaaaatgtaatggattttggaaattgagggatagagttaactggaattagaagttctactactactttatatgggagggttttatgtataaataggtgtgaggttgagactcagagcaattaagtagaacacgaagagagaaaagatagggtttactttgaaatttcgattctagtttgtgggttgagagagaggattgcgttcgatacacattgtgttttttttttcggcggtgcggcggcggcacaagcatataatccggcgataaacgtcggacggaccgagggcactagattggacggaccggcatctacattgtatggtcctaacttcattaggtcaaagatttcttttattaatataatggtttttgtgtttttatcattcagcctttctcaatttctctagtaagtttggtttttatatttgtttcttttgatataatagatgaaaacgcccccaatattcagcagtgtagcattcagcaacctaacactgattctacgaaaatgacgctcctatctcatattactatcctgcagatacgccgttttattcttttatcacattcttcatcaacgaaaatactgtgtccaaatagtaattttcccagcaggatcaatcgcgtcaaattgggggcattcttggcaacattttcatcctcgatctgttccagctccacggcaataaatacggctcatttccgaatgaatcggccgcagagtcacagagaggagtaaataaatactcacgaaagaaagagttcagagaaaaaaaaaagttgaaacgaaagcgaaacagtagctctctcgccgagacgacgccgctgtctccagaagctacgagcatctagagcggcaatggatcgggtcgaggaaaaggaggggaaccgattccaagaaccagcatcggatcggtgcgaagacaacgaagataaggagcaggacaactctgaagaatcatcgtcggtggaccagcgcaaggaggaggaagaagaagaaaaggagggctgtgaggaggccacgccagcggcagcggcggcggcggcggcgccgtcattcttcgcgcacccttgctcgctgctgcagtacatagcccgggtctgcgcctgctgcctcggcctcagcgattctttctgcgacccaaaggcaagctctgttcttgtccctgaacctgaacctgcagctgccgacccgtctcaagaaggagaagaggacatgaagagcagtgtaagtagattgctctgcagtttctgcaaagcatttcgtaatagttcagttaattctaacatatgagatgaaattggtgtagtatttctacatgcaggaggcgaccactcgggtgcgggcagcgcggctaaggccgaagccgccgggcaatccgagagaagggagcggcggcaatggaggacaccatcactaggcagcctgcttcgatcgtcgtcttcagtcttcagttgagctgtgtctacttgttctaagcggcgtgcttgtataaaaatgtggccgaacaagttctactagtttacgtggacttttgaggatctgaactttcagtgaaaacttgttcgagtgtttaattaagtcttttctgtatatcttatgtgttcatcttgccagttaactagtgttcagtctgtgtctcatctctcaactttcaactctcaagtatattgctaatgggtgatgctaagttgttcacggaattgaattggtcgcggtgcagatacgccaggaagaaagaagctaaaagtgatgatgtctgaatttgtgtcatggtatcatggatagatcgaaatgcagtgctgcagcttgcatactcacgccgctctagcatctagcaataacaccgcgcgatgggtttaattagtttgtggaattgctaaagaaaatcccagtccataacgatccactttctatatggtagagtactccgtattttttcgaaactcattttccaagatagcaacgaaatgcagcaaccaaaccgaggttaacttatactactctctccgttccaaaatgttcgacatcgttgactttttagcacgtgtttaaccgttcgtcttattaaaaaaaattgtgaaatatgtaaaactatatatgtacatgaaagtatatttaacaatgaatcaaatgatatgaaaagaacaaataattacttaaattttttaaataagacgaatgatcaagtaaaaagtcaacggtgccaaatattttgatacggagggagggagtaatctttttggcacagatcgagattggataggacaaacaacaccaattctcttccccgtgcactcaggttgaccggcatacgaaggcgcagccctgaactattcaaaactggaggacgatccgttcgatccatacttcccgttgcacttgcacagagaattaaactcacctggccaccaccgcgactccgcgaccgtttgccgtacgggaagtcatggctcctgcggctgcctaacctgcgaatgcttcccagatcggcatgcaggccgcccgccgccgccacgacggggagacgttcgtctcccgcatgcaaatatgcaatgagattattatgggctatactcagtatcaatcaagaagtggccccagtcggagagattatgctgcaggggatcggaagccttttttttttaagcaattttacggtaattgaggaggtaccatgaggtaccactttttttttataaatttggtacctcatgttactttacagtactagttattaaaattttacactaaatttcatggtatctctttaagtaccataaaattgctcttttttttttcgcggatacgattttggacctggcctaacaaccataataggccgaaatttccagccttcacgtcaagagatgtaaggcccgggagccgggacgcgatcgcgaggagcgtgccaccaagtctccggcctcaccagcgtgtggcatctgtcgccgcccggccgggtgcctgggccgctgcgacgcgggatgacgctgcggaaaatttttgttccgcgccactggaatactggattgggcagccacacagctgagagcctgagaacctacgggcttcgactttgtttacagtcagaaaccaaacgatcgacttggtgtgctaccgtcacggataagagccataagtcaccagactcagagtctcacagagcagttgaaaacctgcagggtactgttttgtttactgtcaaaaaccaaacagtcgagccaatgtgctaccaaggacaggatcacagaaaccagaatcaaaatattccaacaactatacgactcggaatctatggagtcgaatgcttagccaattcgccggaccagcgaagaccgccgaccagctttataatgagattgagaagtttataaaacagtaacaacaaacaaatgttgcggtgctactagggaacaaattcccccatcgccacaacctacaacatggtacatgcaaacttcgctgacacgaaacagatgaaatcgaaaaggtgcaggaacaccgactcgaacaccggcatcatggctcgatccaggtgagctggaacaccgactcaaacacctcgcggtcatacagcactggacactggagtgtagtggtcgtcgcgcgtgagctcgtcgatggcggagctgacggcgctcaggtagctgtcgcacgctttggtcttgtccccgtacgacacatccgacaccgtcacgttcctctggatgctctggatgtagctggcgagcggggcgcgatccaggcagacgtacacctcgccggcggggaaccggcggccggcggcgtcgaacggcgtggcgtggccgtagagctcggcgatcgtcttcttcgccacgccgggagagtgttcgtcccggagagacaggaaggagagggagcggagggccgggattacggccgtgtagggcgcccagctgtgcgtgcacgccatgtcgatggacatcctggggctgtagcctgggacgggaggcagcgaggcggaggcggcggctgcggtgcggatgacgcgaaggacgtagcggggaacctcgtcgcggctggcgctcggacgacgaggccgatttgcactggaacggatgggcgaggctggctcagcgacataggcgtcgccgccgtcgctgtagccatccagtgagaagtcactcatttcgcggccgctgagaaagataccaatcgatcgtctggataaatagcgcggcggacacgaagtggagtggacgaccttgcacgccgtccgaagtcaaccgtgttgtgtcgctgacaactgagatgtcaaaacctcgtacgtttcgatggcgcacacgtacggcacaccgattttgtggtgtgttcgataatcgatgcacacactttctagtagaagtatttcttttacgacagagagcgcggattaatacttcaacatagtgattacaatcctgacgaacgtacaaggtcataaatctccaaactgcacagtgctgtgcctaggaggactggagtgatggagaggaattcagcgaagagagagaaggggatctcaagttcatgacatattgacatggactgcatcgccgggagtgatcccttcctcgacagcacacgaggagaacaacgaatcaggccagctcgtgagctaaacgggccgccaatatgggccaccttggatgtttcggtacggcccggatttggacgattcgcaacgcggttcacctctatgctagtcaagcacccgcctgccactcgtcgcggttttactcggattttctaatttcatttcgagagatactgcagaacttccaacgaaatagttataatattagcatgatatcatgggtaccggatctgatatttctggtactaaacatgatacaccataggtactagaccagatctgttacctatactgatattatgatttgacattagtgatacccgtttttaaaaggaaaaaaagatgctaagaagaaacttagcatcaattattaagagagaagaaataatgagaaaacccagcgtcgaggggactagaacgtgggccaacgagagcacctggtagctccggatcgagatccggtgcggtcgcagtaacaactgcaactttagcagttgcggttcggtggatggatcaaaaaccaacggctcagatagctgcaaaatactgttcacaaattactgtaggggaatctttactgtagcgattgctgtagcgtcagaggtgcaacagggttgcaagcagatctgagcctttcacttcatcaatccaacgatcaaaacgtacaacgacagctaaagttgcggtagtaatatcaactgcaccggatctcaatccggtagctccctaccaccgggctacaacctcgttctctaatgatacccgtatgtcagttatctcgttggaatgatatatcgttttgtactattatttttttttatgatgtcaatactaaatagttgaattgataaatatgtacagttattgatcggtcgaccatcgttttcgaaaagatgttagcgattccaattgtttccactgtttacaagtccccgtctagataatttcatctgtacccaaaaggtccgaaagtctaaagcattactacctctgtctcaaaatacaataacttttgactatgattctaaacaaaattgttcagatttatagctaaaatgcttacattttgagtgtgagggagtatctatcatcccgccaccgatgggcagtttaagcacacgtgcactaatcaggattcgaagaaatatcacacacgcaaccgcattctcgccacagataaacctgtgctccacgattaattcggagacgaacctaggattcgtcgcactgtccagtagccactgtgtttccaggattcacaagccaacgcatcaaagctcaccgtttgctcagccaaaggcctcatgtcactgatgtcagcagtgaatattgtcgacgtcagctacgtcgctgtgccggcgacggccgcgctgccgccggagccaatcaaactcacggcgatggaagcgctgtggctccctttcccggtgctgcagcacgtcctgttctacgaggccgccggcttgacgccgttcgacagcgtcgtcgattcgctccggtcatccctcggcgcgacgctggcgaccttcgcccctctcgccggcaagctcgtccacctcgaggacaccggcgacgtcgccattgcctgctcggcctcggacgcggtgaggttcgtggaggcggagtgcgacgccgacgtccgccgcgtcgcgggcgacgaggcgcacgacctgcggacgttcgagcagcttgtgccggagctcgacatgagcaagctgccgacgtcggtgctggccgtgcaggccacgcgtctccagggaggcctcgcggtcggcgtgacgttgcaccacggcgtcgccgatgggaagtcgttctggacgttcgtggaggcgtgggcgtcggcatgccggtgccggggcgaggcgccggccgcgacaccgtgcttcgaccgctcggttatcaagtggccaggtggtgaggagatcgccaggagcgtgttgcgtaagtacgcgccaaacttgcctgaggtatgttacttcatgccggaaattattttgatctcgaggtaacgttcttgtcacttaaatagttgaatttttttaaaaaagatatatataaacatgtgatatatcactccacaaatatacaagatcaaatttaacttttacatctcgaaaaaaaaaccaattaaactataactagttgatatatatttatagtcaaatttgttttttttagatgtagaagttgatatcttgttgtttgcatggcacttaagtagttataaaaaaaattaagaagatgtattaatatgtgatatatcacttcacaaaaataattaagaagatgtattaatatgtgatatatcacttcacaaaaatacaaggttaaattcaacttctatatcttgcaacgaaaaaacaagttaaacttgattatttggttaaatttgttttttggtaagttgtagaagttgaatttgagcttgtatatttatggagtgatatattacatattaatatatatatatatatatatatatatatatatatatatatatatatatatatatatatatatattataaccatttaagtgacatgcaagtaaccctttcgtggggggaggttgctcactttttttttcttttcgatgggaaagtcataatgcattggttagcttaaaattaagaacacgtgcaatggcgtcgcaggtgtccgagctggacttgcttgtagaggaacgcaagcgtttcacccgccggacattcaccgtggacgcgcagcaactcgaacgcctaaagcagcgcgcatcacccgcgacggcgaagtccacggcaaaaccctgcatcggcctccatccagcttcgtcgccgtcgtcgcgatggcctcggcattcttcgcccgatgcaagaccaccgccgcggacgaggacgccggcggcgacgtgttccttttcttcttcgccgacgtccgcgagcgcctcgacgacccacccgtcgacgcgggatactacttcggcgcttgtttgacagggtgtctcgcgagactcccggcgcgcgacgtccacggcgacggggcactggcggccgccgcgtcggcgatacaggaagagatcctcgagttggcggaggacccgctcgccgggtggaatttcatgagcctggcgggcaagatcccctcggacagggtgatgaacgtgtccggctcgccgggattccgcccgtacgacgtcggcgacttcgggtgggggaagccgaggcggacggagccgatcaggatgaaccacgacgggcaggtggcgctcgtgcgcgccgccgacggccatggggtgcaggtctcggtctccttgctccaatcggcacacatggaggctttcaagtcacaaatgcgcctgctcgagttaaagtgatcagacagacagatggtacatgcgacaaactacagcgatgaaaaaatagggcattttactggaaaaaagtattaaacaccacatctaaaagtgggagatagttaaatatctaaaaaaaattaagtagttaaatatctgaaaattttaagctgtagaaatcaagtactatcctattccatccaaaatataagtagtacagtttttcaaggggcttttaactatttgccactcttacgagtggtgcttaacgatttgccactaggcccacacgttatagacacggtgtggcaaatcgttaattgccatatcacaagagtggcaaatagttaaatttcccgtttttcaaataatatatctagatatatgatttttaaatatatatgtgtatatttataggagtgagtgtgcatgttttctcaaaaagatatctagatacaatttaaaaaacacgcagaattagaacgaacggattaccttcgtttttggtttttaaatataaagtaaattgtattggtggtaaacaaactcataaggtgggtgtgattcagtatacaaatttgtagagtaattattatggtacacgaacttgtctggtggtgtttttttattttaatcccttcgtttttctaaccggataaggttcaacacatatgtttagcccagattgcattagagccacggcaacttaatttttttgtctatttggaggagcttctgtcagctgcagcttctcttagaatctctggctgatagaagatctatcaaacagtctagattttcacttagattttaaagagttttagtcgtagaacccagaaaataaattagaaatcaaatgatgggttctccagcacctccagattgtcagcggctgcttatcataacttccccgagcaggacctccgtcggcttgctgggactactcgctttcgtgggcctacttttccaggccgaagaacacgcgcccaagtttgctctagggcccaaaatgggacgagacgagccagagtgccacccgtgcttggagaactgcgcatgtctccagtctccgacaatctgcgttcatgcttcatggtatagccgctcgaccggcggtagcagtagctgagctgagtagagagtactctactactatatcttttataactctaatatacagtcaccagtgttttctttcaaacatgtaataccgagactttccctccaaagactggtctgactgatcggtcagactgaacgatgaactgctgtcaaaccacaagcatccggacggcctgaccatcaacaaatagtcagaaaccaatttagagatttcttggatttccttacttagacgagattttagactataattagttttttacacccaattggacatgggaaaaatcctaggaaacaagtccgcatttttataaatataaggggatcacgaccgactaaaagaacaaccaatcaatcgtcaaaatcaatttattaccatagcctctatattccacaccttccttctccttcctatctatgacaacatctattctccttcaattctaaattgctttatcatctctggtctctaggtctctacggcgttaaatgacgtcctagctgatttgtcgagtctaggacaaaccagcatcgcgttccctctaatagggcttttccgtttgttggttcgatattatcttacaacttcttacggtagcatatctcagggtactaccgtgagattgcacataacgtgttcaacgtgtagacacgtgatttggtgccgacagatgccattttcctacatttcgccttcgacaaggacaccccttgcacggagctagtaacgctcgcattaatatttaattccgcaattagccaacgattcacgtatggctaattattgccggctgctagctgctcctccgtggctccagttgctgctgtgtttacacgcaaaaaacagcggaagtgtcgcaggcgggagagaggatcgctgctaccatctcgcatgtgaaaatagaacatttttgcagtcgcctccttggcccgcctgcgaaaataatctcagaaaaattaaaaaaaaccacggggcaccgccgccagcctcaccacgagcgctgccggcttgggctcccctccgtccgttgccgttggcgccgccatcgtcgtcgtcgtcgcgtcgatgaggagagccggcagccggatgcgagccgtcgtcgtcgcccgtcgtggccagtggcggaggtagcgaggaggaaagccgacggtggaggaggcgagccgtcgtcgtcgttcgtcgtggccggcggcggagggggcgaggagggaagacggcggcgcgcggatctggagagccgtcgtcgtcgctcgtcgtggccggcggcggagggagcgaggaggggaagcggctggcgcaggcggcgaggaggaagccggcggcgcgcggatctggagtgccgtcatcgtcgctcgtcgtggccggcggcggagggagccggcggcgcgcggacgtgggagaggagggagccgtcggcgaggagcgagccggcggcgtcgcggtcgtcgtcgtcgtcgtggccggcggcggagggagccggcggtgcgcggacgtgggagaggagggagccgtcggcggagggagccggcggcgtcgtggtcgtcgtcggcgtcgaggagggagccggcggcgcgcggatgtgagagaggagggagccgacgagtttttctaagtgtgtgtgagagagaggagggggagggaaatgagtggtggagaggagaggataaggatgattagattattttagtaggtaggcggaccacatcgcaggcgccacttaagtgatttgcagttcacctcgatttatattttttaggtgattatttggctcaaagagtcatgtgactggaaaaataaaacccacatcggggaaaatgcctttttctagtagtgtgcgataaaccagcgcctgcgtagtgcagagtccaaagcctcatgtctgcagtgagcatcgtcgacgtcagctatgtcgctgtgccggcgactgccgcgctgccgccggagccgatcaagctcacggcgatggaagcactgtggctccctttccccgtgcttcaacacgtcctgttctacgaggtcgccggctcgccgccgttcgacagcgtcgtccggtccctccggtcctccctcggcgccacgctggcgagcttcgcgccgctcgccggcaagctcgtctacctcgagggcaccggcgacgtcgccatcgcctgctccgcgtcggacgcggtcaagttcgtcgctgcggaatccgacgccgacgtccgccgcctcgccggagacgagctgcacgacctggcgacgtttcagaagcttgtgccggagctcgacatgggcaagctgccgacgtcggtgctggccgtgcaggccacgcgcctggagggagggctggcggtcggcgtcacggtgcatcacggcgtcgccgatgggaagtctctctggatgttcctggaggcgtgggcggcggcgtgccgcggcgaggcgacgccggtcgcgacaccgtgcttcgaccgctccgct

SEQ ID NO: 63696 - DNA, 13961 bp, Oryza sativa
atttaagaacacgtcgaccaccatttgcgtcgtctcaggtagccgagctggaaattttcgtcgaacaacggaatcggttcacccgccggacgttcaccgtggacgcgcagcaaatcgagcgcctcaagcagcgcatcgcccgcgacggtgaagcccgcggcgcgccactgcgtcggcctccgtccaccttcgtcgccgtcgtcgcgacggcatggacgtgcttcgcccgatgcaagaccaccgccgcggacgacggagaagtgttccttgtgttcatcgccgacgtccgcgagcgcctcgaccctcccgtcggcgcgggatacttcggcagttgcctgaccgtgcgcgtcgcgaggctcccggtgcgcgacatccacggcgacggcgcgctggcggccgcggcgtcggcgatccaggaggagatcgccaaggtggccgaagacccgctcgccgggtgggatttcttgaggctgatggagacgctggtccccgtcacggagagggcgatgaacgtgtctggctcgccggcgttccggccgtacgacgtcggcgactttggttgggggaagccgaggcggacggagccgatcaggatgaaccacgacggacaggtggcgctggtgcgcgccaaggacggccgcgcggtgcaggtctcggtctccttgctccgatctgcacacatgcaaggtttcaagtcacaattacttgagttattgggatgacagatacattcgattaattatacttcctactcctcattttaagtgcaactatgagtttctgtacccaactttgacagtccgtcttattcaaaaaaaatttataattagtatttttattgttatgagatgataaaatataaatagtactttatacgtgacttattttttttatttttttttcaaaaaagacgtgcgttcaaagtttggcacggaaaatcatggttgcacttaaatggaacggagggagtagtaattttcgctgccatatggacgagagagagagagagagcatgtttaatgaacagtgctaaatgatgtgtttcgtaaaaatgtaagaagtactccttccgttttaggttataatacgttttgactttggtcaaagttaaactgttttaaatttaactaagtttatagacaaatatagtactagtttcaaatttataatacgttttgactttggtcaaagtcaaactgttttaaatttataatattaaactagtttcatcaaatcgataattgaatatattttcataataaatttgtcttaggttaaaaatgttactacttttctctacaaatttggtcaaagttaaagtaatttgactttgaccaaagtcaacatgtcttataacctgaaatggaggaagtataaaagttttttttaaaaaaaatctattttttcaagtttacaatagttgatagttaatatatactgtatagtaacccactaactttaaagcttaacatacaaacatgccatatcatcacccactagcaataattatatattcaacctcatacaagcatgcaacatcaggtacaatttatttaattatacgaatcaacgtcatgcaaacatatccaattatcactcccttacatcatttccacaacatttttataaatctatctatcatttttataatatttaaattaaattaacttatcaatatgttccatattaaagcgggttttatttgtttgtttcaagataaatattaataagctctgttatttcatgtattttctttttacccctagcttgattgtaacaagaaaatatatattgaaaattacttagtaatttccgtagtaaagcgcggggaatcatctagttgattactactgtgttaatgacccgtcatgttttcaatgctccaataagctcaagcccaacctcgcaattaaacggtggaaaactgcgctaagcttttgcagagatgttctcaatgataggaaactatcttaatcttttgatggaatgtcccctagcccatttgtttaaataccatctaaatagtttgaaaaaactcaataaattgacaatattcatacgacacagtacgtatatcactttataaaatctaaagtttagacttgacccacacatccagaaatcagagtatgaaacagtacagatagtatttacatctggattatcttttatgtttctttggaatgagtttggtttaactttttttttcgaggtggtttaactttttttaagcgatagatgtcgctatatatagactctacattataaagaaaaagagtttcacaaccatttgtgttaagtttaattgaaaaaagtaaataagtgattagaatccatttccgctgaacttacggccgaaagcatgtttgtttgtgcgcgtcacgttttattctgttcgatcacgcgcgccaatcacaaacattctttcgcattatagtacaaaattctgagacttaatagtattgaattctctttaggacgaagtagtttaggagttgttgagtttagggatggcaattgcccatgggtacgggtatccgcggataccgacccagtgggcaggggtggagccaggtgtggggcagcttgggtctgggccctacacctgatagaaaaaataccaaggaatttgctaattttcctattaaaattcgttcaagaagttcatactatagtgattaagccctactcttgacatgatcttggctctgcccctgggcgtaggtgtgattttttacccatgggcacgcccgcccgaaacccgtagacatgtgggcaacagccaggtttcatttttgcttgtgggtaacccatgcccgacccgatacatatgtattagctaatttcgacttatctcttaattcttatacccatttctcttggttcatttgtgatactaactaataataagttgtgatgtaattcaaattattgttgataactaataatttggtaaattgttgattttatttctctttgttaaattatatatctttcgagttattattcatgtgagatccattgggtacccgccaggtatatccatgcccgtcgggcatgggtacgggtatagagttttgcccactaaccttagtgggtagggtttgggcgggcaacgacgggcatgggttcgagcatggttttgctctacccatgcccgacccgacccgttgccttccctagttgagttgcagggacctaatcacaaacacgtcgtcccaaaataatttgtcgaggtttgttggtaggattgaattcttttcagaacgagtagttcagttgcaggggcctaatcacaaacacgtcgcccctactctcgctgtcgtctcgcccattgattttctgatacgcttcagcatcgtgaacgtacctgctgagtgttactacttcttaaaatatatataaaaaacctggttgaacaataaatataaatttcttttggttgaaaaagacacgttccagcattataaatctaaacataaaaatcttaatagtataaatctaaacagattttctacgcagagattagcagtactatatgttcctaatatctcttatattttgattaatcgctctcgcggcagctgatacagccctgctcactcaccaccattgtccattgtgctagtacagcaggggagaggacggatgtcggctgctgtgactgtgcgtgtcgtgggagtcagccatgtcgctgtaccggcgaaggctgcgctgccgacggagccgatgaagctcaccgcgacggaggcgctgtggctacgcatcccgctcctgcaacacgtcctattctacgagagcgccggcagcagctggccgccgttcgacggcatcgtcgactcgctccggtcctccctcggcgcgacgctggcgaccttcgccccgctcgccggcaggctcgtccacctcgaggacaccggcgacgtcgccatcgtctgctcggcctcggacgcggtgaggttcgtggaggcggagtgcgacgccgacgtccgcagcgtcgcgggcggcggcggcgacgcgcccgacgacgacctgcggttgctggagcagctcgccccggagctcgacatgggcgagctgccgacgtcggtgatggccgtgcagtccacgcctctggtgggaggggtggcggttcgcgtgacggtgcaccacggcgtcgccgacgggaagtccttctagatgttcgtgaaggcgtgggcggcgtcgtgccgcggcgagacgccggccgcgacgccgtgcttcgaccgctcggttatcaagttgccggatggagaggcgttggccaggagcgtcttaaggaagtacacgccgaacttgcctgtggtatgtcgggaaatcattttacggatttgctaaataacatgcgagaaatttgaggatgaaatctcgtagattttagatcgtcggattcatgccaagatttgtaaatggacttctttatttctaatcttggtgagcttttttttgtttttttttttgggtaccggcgacatcccaactctttagacgacatacagataacgggttgggttgtgataagatgaggagagaggagggggatgatgatgaacatctaaccgtgcgtgggtgtacccgtggagtcgtcccctccacacacccttccccacgtcctcctatatacgtgcatgtatgtatacgcatatatatatatatgtacaaagtttatacgtatatatataaactttaaagaaaaaatatttcgtgtgtccggaaactgatcgcccatgcccttccctgtgtggctgatcaccacttagcagtttcagaggggaggaggaagacagggtttacatgcgtttaaaggaattgttgtgggtaacagaagatcgattggaaatatacaggaaaatgaaaaatatagaaagagtggcatggctattccaattctacaggaaataaaaacacataaatttaaaagaggtataggtgtttggctactccataagaaaatcacaagaattaattgtgaagaaaacgtttggctataatagataaataggcatttgccttgggcttaaggggattgtaaataggcatttgccttgggcttaagggaattggaaaacatgatcttttatcaaatgttttcagttttccaaaaaaaaataaataaaggaagtaggaattttggaatccatttcttaccatcaaaaggctccaaagaaaaaaaaatgggatttcaattatttcaaattcgttaaaaaaattctttgccttcaaaggagcctaatctgaacgatcattgcacattagtccgaagattttggaatgtttaaatggcaatatcagttgttaacaatctattgtttcgctgcttatacttattagctaaaatttaattttagatttgtttttcaatcactcaagatacttaaatagttttactaataaattgttttattattctttggttgctatttgctagtaagttataaggataagcataacaaagtataagcgaaccaataaagttgttaaagtctactaataccaattattgcatcccaataagatatgcgaatggggtgctaccgttttctagagatttttttaatcctttttattttctaatttcaaaaataaacccattcaaaacttatttacaagatttggaacttattgaccatgccagccggactaacgtagcaaaataatactgacacactggtctaaatagcgtgaagacattgtcttacattgacatgttaggataaaactatcacgctcgttgtagatgatatgtcagtgttgtcttgccatgccaggtaggttgatatggacaaaatgtttaactttaaaataaatttttgatgaatttatttttaaaataaaaaaggtttaaaagtgaaaaaaaaatatcgtttttggatgttgccttgataagaatacgtcgacatgacaaagcaggtatcgccgtcggcggcgccgccatcgagtggagaagaaagcaagtggtactcccgccggacgttcactgtgggcgcggagcagctcgaacgcctcaagaaaccactggtggagaaaccatctttggtcggtcgaccaaatctcacaatagtcccggttccactaaaaaccgggactaaaaacgatttttagtcccggttaaaaaatttttgatctttaccaaccgggactaaagatgatttttagtcccggttcatcccctgtcagatgtatgtcatggggtcgaggatttttagtcccggtttatactaccaaccgggactaaagattaccactttagtcccggttggtaatactaaccgggagtaaagatctcttgtcacgccccgaactagtaccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccatgacttggaccaaacatcacaggcgcgacttgggaactaggccgaaaccctaaaactcatcgaagccggcttgctcctggaagaactcctcatcagcgggatccgcttcatcttcttcagcaactgggggggagattatttatatagagcatgtcacaccccaatctgataccgccgtataacggcacctgataggagcgtgtcgtagggaaaacggcgcgaaccgcttcctacgaaaccgcgatctcggtaccagtcccaggacatagtgctggtacccacggtgacaaatatgaatcatagcaaatccttaaaatagatagaggacttatttaccttaacttaggttgcagctcagaacaacccgagaatgcaaccgacgacacggacgaggaaacaccaacaacagcagcagcagcggaaccaacgaactaacacccaacaccacaggcgacggctgggaaccaggacgaaaccctaatcttcacttcaccttatcttctcttcagggcggaggaactatgtatatatttatatagagcaagggtgagtactttcgcactcagcaagtcacgggaacttaggtgtttaatgcaagcttggaagagaggcaaggttgttttgcaaatcttttatttgaagacattttgaaatcactaagtgatttatttctttctatgtttgggcgaaaagagacttgcgtctcgattcgactttaagagatgcttttcaacaactcatttagcaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactctagacactggccggtgtcagaggttcgcgacaaagcctttccccagccgacccagggttacctcatgccacatagaaggatcaaatcctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattccactaatgcaagttgcaaacaaaataataatgacttttcaattataggggcaattgatcaaagggtgacttgccttgctcaaggtcttcacgaagcttcacgaatcttcaagaaaacccgcgatcgacgaaaatccgataaccgcaactatacgcaaacaatcgaaaacctaaacaaaagaccaaaggaaagatcctatttagactaattattagtgccattaaatagatctcaattttacggaattactggaagtggaacggagtcaatcggatgagcggttgggaagatatggattttctaaggtttaaggattttctaatcaaagaagaaaggatttaataatttattaaacccctttctggaaagagaattgaaggagggatgtaaactagacttgtttcggtggcattggcgcggcccaagggtcgaaggaggctcggccaagccattgggccgacgcgggcgcaaacaggcggcccattagggcgcgcgggagggagagggggcggtccggtggaccgagcccaccacgcggggtcccgggtggggcccacttgtcggtgatacggcccacggtgggatgggcgcacgcgagggcggcgctagggttcgggggaaggcggtccacgcgcggcgcgcgggtggacgcggtgtgcggtgggcccacgcgcagcgtgtcggctctccgtggaccgcgcgcgagggtgggggacggagggaggcggctgaccgaggtcagcttttgacccggtcgcgtcgaggtggcgccgacgtggcagccacgtcggatggggaggcagaggaggccgggcaggctgatccgacggcttacggcgtgcggcgggatccggcgaacggcggcgagccggaaggggcggctagcactggcggcaggaggaggagaaggggaactcattccacggctcggatcaggaagaggacgtgcgacgacggccggcggcggcggccaatctcgctggcatgccgacgtggccgcgcgcgaggagagcgaagggtgcgcgggctcgggcttagccgaaccggtacggtgttgcgacgcgcacgcggtgacgcgggacccgatggtcaccggcggcgcacgcacggcggtgttatgcggcggcggaagcggcgacacggcgcggagacaaaggagaaggccgacggccttggggcagccagggggaagtcaaggggatccccgggggcgtggcggcgagaggaatcgacgcgagagaagccgacgatggcggattgcggcggcggcaatcaccggagagcaaaaggggaaaacacgacgagacgacgagggttcgattcaaagggatgggagcatctccggggttcaaggaatccgttcccggcgtcggattggacggagcggcaccgaggttggctggcgacgagagacggcctccgggacagagcatggcggccggcgagctagcgtgcggtgcaagggcgacgagcggcgattcggcggcgagacctggggcagtgtccatgcgtgttcggggggctagccgagctaccacgtgagctagggagggagaggatgagcaagaagggagaacggagggtggcattaccaagccgagacgggcgcagtgacgagcggccgacggctcgggagcgagctctccggcctcgggccgaggaaggggaggaaggagggtgcccggagtcccgcgtcacgcgtcctcgcacgcaccggtctcccggtgctcggcggcggacggcgacggcgagagcagaggaagggcgacaatggcgcggtggagtaggagtgtgaagtgggagggattgagatgggatggtgagctcggcttcgggttttataggcgcggggtgaggcgatgtcggtttggggcggaaagaaccgaccttggtggtcaagcgctcggctggcggcagcggcggtttcgtgggcgatgcgaaagtggcgacggcgtggatgctttgggcggcgaaggcggtggatcggacggccgaatccgaaccacgggagcgcaggctggcgcggtcaaggtgggggcggcgagctggcggtcatcgacgcgtgcggccaagtcggcgacaggtgatgacgccggcggtgtcgggcaaaaggaaaaaggtgggggaaaagggagctctgctccttgctgtttcgggataaaggaaagggagagggagcgaggccgagggctctgcctccctcccttggacgcatgcgcacaggcggggctgggcgacgcgcggtcacgggcggcgtcagggctgacgcggcggcgaccgagcagctggcctcgagagagcgcgcgcgcgcgagaacgagcagcacggccgaaaatcgaatggcggcagcgggaaaaatcggtgatggcggcagcgctggcgttggcggcgaccggccggtcggccacctcgcgaggcgcgcgcgggaaagggcgaaggcggtggaggttttgggcgacgacggcgggaagcggtgtcggcgcgagagagaacagagagggagcgagaaaacgagagagaaagaagagaggcgatgcctctctctctcggcgcgtgcagcgcacgtgcggggaggaggaggagcagctgagaggagatgggccgaggagaaaacggcccacaaaaatccgagggaggcaaaaatagactttttcagaggagattgatttggagagaaatggagagatttagggtttgggttcgaattcaaatttgatattcaaactcgagggtttagggatgtatcaaggggaattcaaggagaagtcatgggaaagattcaaaaggaatacttgggtatttgttctcgggaacataggggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaacaacaggatttgaattgagatcttggcacaacttagactcgcacacaaagaacgaaaattttcgcaattaggattttgccgaaatagtttttaacgactcacgaaaagcggagcgttacagagcaagggtgagtacgggagtactcagcaagccaggggaaataagtgtttaatgcaggcttcaaagaaaggctggtgtttttgcaattgattttattcgaactcttttctgaaacaactaagtgagtgcttctcaaacgacacggatgagacagtgcgtctcgtccggtcggagtatgtgcaatgtatcagtctttagaattgaaacaaggttggcacccggccaacagcttttcaacggccacccgggccaacaacttttcaaacggccacccgggccaacaacttttcaaacggccacccgggcctagctgatcccatcagctacagatttttcaaacatcgaaccccttttctcaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggaaatcagccacgtcgggggacctccaagctttcatgacaagacatttcgaaaaccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctggtaaactagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaatttcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggaggggtcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccttattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaataaaagaaaagaaaggagggagggaatacagacttttctcgggcggctagggcgcagcccgagagaaagagcggctcggccgagcttaacgggccggccggcccaagaaggcggcccagagcggcccaagatgcgcgcacgcggaggaaggagagagagagagccggtggaccgggctcacctcgcgcggtcccgggtgggacccgcttgtcagcggctcggctcaccgtgcggagggagcacgcggcgcggcgctagggtggaggatggacgtgatgcacgcgcgcggttcgcggtggacgtgggtgcggcgggtccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgctggccggaacgaacggcggtcgacagcggcgagcgacggagcgaaccacggcgatacgggcaaaagcgagcacaccgggcggttgcacgtgacgaggggagacgaaccaacggctcggatttgccgggggttgctcgacggcggcggcaaccggcggcgggagaagggggaaacggcgacgaggtcactaggggctaattcccggcggcgagagcatctatgcggttacgggaatccgatgctagcgtcggattgggcggaactacgccgagcgaggccggcgacgagcggcgcttccgagctcgggcggcgacggcggcgagcacacggcgagcgacggcaacggtcggggcggcgccggctaacttcggggaggctactcgagctactaccgaaagctaagggggggagatggagcgaggaggaagaacggagggaggcactaccgtgcgggacgggcgcggtgacaagaggccgacggcgcgggagtgatctctccggcctcgggccgaggaagaggaagaagagggcgcgcccggagtccccttccgcgtccacaaacacaccggctctcccggtgcttgccaatggacggcgga

SEQ ID NO: 63697 - DNA, 5668 bp, Oryza sativa
tcggcccatcgaacccgggggaggcaaactaaacttttgcggagggatttgatttggaaggatttggattcggaattgaactcgacgatagatcggggattgagatcttgagatggcacggacactagacaacaagcaaagaaacaaatttcgcaattaggatttttaggagataattttcccgctaggcgccacgacggaacgggcgctacatctttagtcccggttggtattaccaaccgggactaaagatcgatctttagtcccggttggagttatcaaccgggagtaaatatttctctcccacatctgatcggttaagtcccagacagatatttagataagattggaacatccggatcccctctcttcctcttctcagatccaatcctcttcctcctcccatcccctctcttctcctcctccccttcctcttctcctcctcccctctcctccctcccatcagccggcccttcctcttcccctcaactccctcttccatcagccggccggcggcggggaggcgggcggcgggtggcgacggcgcggccgcgcgcggggaggcgggcggcggcacgcgcggccgcgggcgtggaggcgggcggcggcgcggccgcgcgtgtggaggtgggcgcgcgcaggcggccgacgggcggcggctcagtttgcttctttttttttttgtaatttgtgtttcactagatgtatatttttttagattttgtgattcattgcatagatgtataatttgtataatctgtgatgtatttaatttgtgtgtagttttttaggatctgtgatgtatttgatctgtgtgtagaatttgtggtgtatttaatctgtgtatacaagtaacttaatatttgggatgttgatttggggatgtgcatcccatttaattcgggagaaaatatagggattaaccctagccattagcaaatcaacaataaaataaaaaaagtatctcgaggaactgtcgcttcccaccaaccgggactaaagattccctctctttactcctccatcttatcgatttttagtcccggattcgtagtgaggttctaaaccgggagtaaaaaatattttttcaccagtgaacgcatcgtccgagacggcgaagcccacggcgcaccaccgcgtcggccaccgtccagcttcgtcgccctcgtcgcgacggtctggacgctcctcgtccggtccaagtccaagacatccgccgcggacgacgccgaggcgttcctcttcttcttcgccgacttccgcgagcggctcgaccctcccgtcgacgccaggtacttcggcacgtgcctcaccgggtgcttcgtggcgctcccagcgcgcgacctcctccacggcgacggcgcactggcggccgccgcgtcggcgatccaggaggagatccggaggatggcggatgacccgctggccttgtgggatttctttagcctgaacagcagggcggcctaagagaaggtggcgaccgtgtccggatcgccggggttctgcccgtacgacgtcgctgactttgggtgggggaagccgagatggacggtgccggcgaggatgaaccacgacggccagatggcgctggcccgcgccggcgacggccgcggggtgcaggtgtcggtgtcgttgctgcaaccgaaacagatggacgctttcaagtcgcgtttcctcgagctactgggataagatgaccgatagttcatgccatctaggcatctagtactagactcatattatgcatatcttattttcctctactgcatggactcaagacaatatttggctggctggctggctcaccctgtttgttatcctttcatggacgtagtataataatgagataatctcatgtttgccgatgtcttaagtatataatactacgtctgttttttaatatatgatgccgtcgattttttataaacatttggccattcgttttattcaatttttttacaaatataaaattaagtcatgattaaataacatttgacgataaatcaagtaaaaaaaagataattacataatttttttttgggaaattacataaatttttttaataacataaatggtcaaacgtataaaaaaatcaacggtatcatatattaaaaaaatgtaaagaatagtaatcagtaaacctgtttttcccggtgaatataagggcaaactactgtcacggttcgcacttcgcaggctggggaaatgcgaggaacgccgattggaaggccgcgtgaactacttttaataaaggcccacttaaaacaaagttggcacaacactattcatttactctgggtgttggatgcgggccaaagttagcccaaccaaacagcttgaagtggatcttgtacttttgtggataggaataagttcatctgagatcccttaaatcgattcctcaccacggacgtccgtcctggaatccatggcgctgcggcgtttcgccgtcgccggccgcgtcctcctccaccgtgtggaatcccttccacctccgcgcccgccgctcgcgttcctctcctccgaatcccgcggccacctcgtccgccgcttctccaccccctcttccaccccaccgcacttcatggtccagtacctcgtctccaagtgcggcctctcgccggcggccgccgccaaggccgccccgcggttcgcccacctcgactcggcgtccaggcccgacgccgcgctcgccttcctccggtctcagggcctcacccgcgcgcaggtccgcgaggtcgtgtcgtggaagccggagctgctgctcagcgacgtcgacgccaccctcgaccccaagttccgcgccgtccgcgcgctcggcctcggccgcgccgacgtcgcgcgcctcttcgccctctacccgccggcgctcacctacggcatccacaccaacctcctcccgcgcgtcctcttctggatcgacttcctggggtccgccaagttactgatgaaatggctcgccaagacgtggctgctccggtacagcgtcgacgccctcctccgcaacctctccacgctccgatccctcggcgtccagcagagccgcatcaccaccacggtgcggatgcagccgacgctgatcacgcagacgccggccaggttccagaagctggtcggccgcgtcgaggcgtgcggcgtcccgccaagctccgggatgtacatgtgggccttcttcgcgctgcacaacgtcagcgagggcagcttccgtgccaagaaggcggccgtggtgggagccgcgggctgcacggaggaggagttcgacgccatgttccgccgcgcgccgtgcctcgtgttcgtgcccgcggcgctgctgcggcggaaggtggagttcctgatggcggaggccgggtgcgacgcgacgcacatcgtcaccaaccccgtgctgctgacgctgagcctcggcaagcggatggcgccgcggtgccgcgtcgtggaggcgttgcggtccaggggcgtgggcatcgggaagaaggcgaacctggggagcgtgatgagatatccggaggacaagttcgtggagcggtacgtactcaggtacaaggaagaggtacctgaactcctcgagctgtatcctccccgactttgcaagggaagctcgcagacacggtgacatttctgcgaggttgtgttgtgttacatccataggttgagcttgttgttaagggtacattattattgaagaagtgtaaaacattcgattctgaaatatctacccatttcgtgtttcacatattgggtctgtaaaacattcgattctaaaatttctgcccgtttcttcgggttaattctaaaataattaacccttcttcttttgggggagatagcaggtgtgagtgtgtgactgaccagtttcatgtcatttgtttcaaattcatgatcaatcttagataatttaatctttttcatcataggttcattgttaccgtcgcttttacacttttcgatttgaggttgctcttcggactttgtgggccatgtggcatccggccattttaaggatggagttccccctggctatattcaggtattcattcagctaaccacaatatgtccaaataatgtagagtaacaggttgaggaacgttcatcaaacaagctgcggtgtgtagtagcagagtcagacataagcagaattggtcagctaacctaatactacatcagcatgctaaacaaatcttataaacaacgcatgcctagtttttcctacttccctccaagagtccagtctccagattactacacgtgacacaaaaatgacattcctacttggaagaatgtggaagtcaagctattcagcctacattgtacagtgccttcgctgcagactgctcattgccctggttagccgaatggttatgcatgcctcccggacaccagggcaaacctctgttctggcagctcataccagctgagaacatatttcatcgttgagtttgaagcactcccgagatgcaactatgcagccttaggagttaattggggaagagtatggcaacctacttggctgcataccaattctgcgcacacttggcatcaacagccagttcaacattcaagatgttggtgccgtagaagggcttggacatgcattcaaccacaatcgacttggccagatcggcagattccgtaggcccttccagtatcacttcatcgtgcacctgaaagacggagctatcagttctgcaaggtgttacacctaacggataaagggaaaccagataatactgcgaacctatcaagaaacaatttaagatccacaactagccattaatcatgcctaattgttttgtacctgcaagagaagcctccaaccgagttccttaagacgagcattccgatctatctcgagcatagcacacatagcaacatctgctgcgctgccctgtgaagttacaaaacactacaatttcagcatagaagagacactaccaagcacaacttttgagttgtcatagacggtaatgacctgtactggtgcattgatagcagctcgctcaatgtgacccctttgaccagaagttgcatgagccatgttaggaaagcggcgcgaccgcccgagcaaagtgtaaacttcacacttctcctgcgctaattcttttgtttcatttgccaagctaaaacctcttttctatccctgtaccagagtttcagggtatcctttgcttccttgacagagacctgccaagggaagaaattatagatgtgcagtgatctttgaaaacagcgacggaaagtacaggggactgcatctttttacattaataggagagcagttgtacaatgcttcaacagtaaatctaacaagtatgactaatggtcatgtgcaagctgtttatggttcccagatggtcagtcaaagcgggtaacaagtgaagtgcgtacttaagctagtaaagaatcaggtatgttcataacaagttcataccttccaatctcgagcaagcccaacaggtgtttttccatatgcaatggagaaattaagcattttagctttccgcctctcagcaccaaaggcatcctaaatcacaaatagaacatataactttatttgattctgcataaatacatgactcttaaaaatactattggagctgtggtaccttcaacaagggcacaggaggtttctcttggccaggttgaggatgccattcaagaagtactttctttt

SEQ ID NO: 63698 - DNA, 8280 bp, Oryza sativa
cctgtaaatttggtgttcttgctgacagacgccctgtttctgtatttatatttaatgaacagtggatccgcccctcgtcacatgatatatgattcccctatcaaaaagtaataggagataaataacattaagaactggacatatagcttaaggttatggtagttgatggtagccactcaagcctaactgctacagatggggtcagctcactgctcacctgtaagggaagaataaagttggatatcaacgagtcaatagaacaaatctcacagagagccgcaatggcatggcatgcttcctttcctttctttcctcctccaaatgcttcatatgcagttccataagaggcagtgtcgtttagatcatgctcagaaatttctgaatcaccactgtcatcatcctctacatcatctgttgtgtaaacaagatcagttggcagtttaccagccaaacttctcaatgcatctccacttactgaaggccagccacttgcagtaaatagatcagttttcagatcttccacaatgctgaaaagttcaatagtacaatactttggagttttcttgccctctgcaataaggcttccatcatttggtactttaatagttctactctttggcaaagtttcaccaggtttgcatctgcacatatattaagagcatcaaaacttctgtgcaagaaatgtctacaagagataaaaaagaaaaggacagaaggttccatttaactcttttgtttcattgatacatggaaacacatattatacctagttacaatccaagacccaaaacatatgaactacaaaagtttctactttctacaaaagtttctactttctagaatagtaggtgaactgaaatctgctccctttttttttttgttctgcattcagtaaacacaacacagggtactgttttattttaaaatagaaggaattattcatgcaagctcaatatatgaagttgatttgctaagcaaggtcaccttctcaataagacatatttagagtttgctatcataattaccatctaacctagtggatgtcctggataagaatgcatagaattatgtatacaaggaccaaaaacatgtatttagtaagagactgcagcagactgagggttgtacctattctctataccaccaaagaacagttggcgaatctgagtatcactgttcacgttcatgtattttgcatcaggacaatatttagatgcccatttccgaaatttatccgcagctagttttcgctgtgcaacagcaaccttttcaatttctgaaaggtaaccacggtcgactagcattccagctgtttccatcttgacaagaagggcaccaaaaggacgccaatactcctcgtagaaatcatacattgaacctctagggcaaccatcaaaagtccagtgctttttttccagcttgcttttcaaactttcataaagtcgtaaggtactcattgaatctaatgaagaataacagatccacatttctctgtcatccctttgtaatacttcgacaggctccatagagataattttccctgcagatccatcctttttaatctttttccaaccaaagatggttttcattgatctctttccaatcttttgtaattcctttggtacaacacccatgaccctgtgatcatttgtaagtccttcaagtgaatatcctccatcaattcttcttgaagagtcccaaagtcgtgcaagatgcatcgtatcagcatgaaacccagcaactttgattccatagttctctatgacatggctatcaaaactatagttgtgccaaacctacatgagaaaatcaggacatctgtttagaaaacttgcaaagatgctagcggtagtagagatgcaatcctataattcctagaagttcaaagaagtatcaaaactttagtcagggattcagaaaaaaacatagcatcaacctaagctgtagtagaaaattaacatgcaagtctgcattaaatgtgtaatataaacattccactgtattgtaaacaatattctagttcacggttccatttatattgtttgtctgtattagtaacacaaaagaagggaaagcagacaaccctagatagtagattcgctacttcccacataagaaaaacaaggacacaaagccacaccttcctgattgaggggtcctcaaaaaatggagcaaactccatgaggacatctcgcccaccatccagcacgtccacccaaatgcatgtttttccatttccaaaatcagcttctgcatcagagttgccagagtagatgctaaagcaaatgacctctccatggctaactggtgtctcttgtttaacatcaatattagctacctgcataacagtgtgctctcctgaattataataaactaacaagaagtcaattggcacaaaatacagaacattttacataatttgattgccaggtaactattgaatcaagatggtaaaagagatcatcattgcgatttcattatttgtgagacctattttgcccttaagttgtcattgatattgtattcactcataacaaagagtaagagcagcaaaacaaacaggcatgcaacacaatgcttcacagcttaagacctaagattggcaaacttgcagaaaaagcaaaacaaacttgcactaaacagaactagatttctcaaagagaagcataagtagtactatttcaactatgaaagatgggatgtggggtggtggagccatgtgttgatcatctcacagaaaagcgggtagacaggtagatacaggtaaactttttagagttagtgcctaactgaaaatgttagtacacgtcatacgatgacaggtgatgcgaattagccactttatacagacataaaaaaatcaatcaatgaggggttttcattccatacctctgtgtcacatgcatgaataaagtttttgtactttgaagtaagcaattgaacaacactcctagctgacttcacattgtcaaccaccagaactttgtcgtacacagtagcaagtgccttcctcgcatctttagactccttggacatgggtgccttagctggagaatcttgtactgtattcttggctgtgcattcatgttcatctccatcataaccatccctagctttgtcatcaaactgcaggcttgtctcgactttagagatcttcagaacggaagcatcagtcttagaatctggttgccattgagtcttcagttcagagccactagacctgttgagtggtttaatgtcatcgttaacaacactggtcagtgctgacacagcacttgcagcttgattcctcgtgttatgctttgccaactccatgttagcatgcctatttgcaagagaattaggagtcattctttctcttacattgtacaatgaagaatagttggaacttttgtgatcttccaaaggttcgtgatgaagaattcctgttcgtagatgagtagaacctttataaatagtgtttcccacgttattcctggttttgatcgaggatatcctcttgctctcctcaagccattcttgtgcattactttgcacattgaagttggtatacactccaattttgaaagcactgttgtctgtaactccaaggcccgagctactatgcgagtagtcctgcctaacaataagaacattcctaatgtgagagatggaaccagaatgccacatgcttaataaccatttgactactatgaacattttatgaacacactatcatttgacaggaagtagcaaagtttagccaaacactactaggtgcaattgttcaagttcctaaaaggcataggacgttcacagcaaggaatacttactcactcatccctggattagttcattattaatccagaacacagcacaaggtttgaaaaacaaatagtatcaacagcacaacgaccaggagcattgggctgaacctaaaccggcatccaaaccatcgcgcgtgaacctcgaatcgaatgagtagtaccactaccaacactcaaccacgcatccaatacgcacgaaactcaccgaacaaatcacaaaatcagcaaccaaccaacacaggaacacagctaccttccgcctccgatgaacggcgagcggccgcggcggccgccgcagcagcggaagggcgacggcgcggcccagagaggcgcggagcacgggcaccgccgcagctgcgcgggcgccggcgccggggccggagcggccatcgctatggagctcaccagccgcctcagcctcccccctcccctccctcctccccctccccctcccgctagcccaccgcacccacacccgaagccaccgggcgccgtcttgggcgactccgacgcggctaccgctcggagcagcagcaggcggcggcggcggcgcacgcgggcatcagggccactcgactcgacgaggaggaggcgggcggcgcggcgcggcgagaggagggagacgaagcgaggagagctcgggttcgcagagtttggagaggagtgggagggggatagaggaagggtttacggcagcaacggcgcggctggaaagcggaagtggaaggggattttcgttctttttcgctacgcgcacacggtggcggccaccaaaacgtttcacaatcttgttgttttgcgtgtctgtgagtggtacacgtcggcaggcagaggtaggtgcctctgtcactgacatgtgggtccgacgaatcatggacccacttgtcagtgacaaaggcacgatgtcttttaaagcagagagtatctcaatcccggcaagcgtgggcgttactggttttttggtgggcttaacgaaagatgttggagcgttagtttagttttgtggactgtctttcgctggagtcggagtcaagcttagctgattggtcgatcagtttcttcatgtcttcaacatgcatgcatgtgctgaaagattattcaacaacaaagggcgcaaggaattataggagtgtaattttttttggaagcttgtgcttttgttcgtacaccatctgtcccaaaaatacatatggagtctatccacgattcaaggtatgaaccacctaggatattcttttcagcttgacagtttcttatcgaaattcacaaagcttcttatctaaaatgaaatttgatcgatccttcttcagctgcccggaaaagaaaaaaaaaacacgatgcatttttacttggcgatctccaattttataggaagagggtggcatctcaatccctaattcaattcgtacgaagaaagtgacccttgaacaaattgagatgctgattgaaagtaaaataaaattgcaggcttataacttaacctgaacaatccttcgaaagctgatttatccgtgcaatacatgcgtagaagaaaaaggaactcttactaaatcaatctagaagcacacagcttttgttagagcgcgcgcgtctccgatacattcctactgaaaaagaaaaaaaaatctgacctgacatcccaaaattctctagctaatgaaccctgcacttctgcagtacacataagtactagctaagctagctaattaacgacgacgacgacgactcttaatttacaaacacgtagcctagctagctcgtaaataacaccagcgtcacggctttgcatgcaagcgatcgaggtatcagctgaaatgcatcgcacgacactgctcgttggtgtctctcatgagattgatcgaggtagctagctggagggcacagggtagcacttgcccttgcacatgcagcggtacaccatcgggcacggctccgcgatggagcacttgaagctcaccatgacgcggttgcacggcgagcaggcgccgcacgcgtgcgagcagtccggcaggctcgaccccgtcgcgcgcacctcctcctgcaggacgccgcggccgacgttgtccccagctgtggcctgctgcgcatgcacgaggcatggatcaaagagaagatcaatatattggttagtttttatatacatgggtgatatgggcgatcgacgacatgcatatatacctgtggtgagatcacaagtgtcgcagtagcgctgatcttttcgtcttgtgcaccatgcaccggtgttactacatcatctgtggaaactaatttaggagatatcaagcaagcacattcggtaagtgcaaattaaccaattgtgcttataaacatacagtcactgagtcgcatactactagattgagaaatgcccagaggtcttctggctagctccacaaggtggtgggctagacgacctgggttcaaagcctcacccctcctaattatttgatattaggtccttccctaatattctagtttttttttttttttttgcatactactagatatctcaacttacaggggggcgatctgatgccatcgccggtggcagcaagaagcaggacgactgcgagtatgagaaggatgcggtggtgacctcgggcgtcagcaagagtagcgtgcctcctcatctcggcttctcaagcagaagatcgagctagctagcacagctacgcacaaagggcatgcaagctgaaggctcgaaggaatcagaggaggacgcaagaacacacgcatatatatatacacacgaacgaacgcgatcgagtatatgtgtgtgcagccattgatgagcgacgcagcggcggcagcgcgcgtctttgattgtgcttcacatgatccccggcacggatcacatggattcaatgacgggccccctgcgtgagcgtgacgcgcccggccgcctcctgcatatgccccctgccgctgccgggttcgcaggcgactagcggcagctcgaggcctcgagactaattaacaccatcgggttcgcctcgcctgcgcccgctcgctctgcatgcacgggaccagtgcgcgcccactcgcccagcaaaccagatacacgcgcgcgtacggcgccgcgacgtgcgcgacccctcgctagtttatccgcgggcacggcgcatggcggtggggggcgcagcgcgcgggagttcgaatcgcacacctgcgggaccggcggaacggtgacactgcgcgcgcatgcatgcgtatgcgtcgtgcagacaggcggttcgtgatcgagcggatcgggcggtggggcggtgtggagtgcgggggagcgggagcatatgctgttgccatgaatgaagtaggtcatttattctttctacgtactgcatcgtgcgagtacgtgatgcgagctagtgctacagttggtgagttggagtactcactgccgacgcatgagagctccgcctgtcgtgtagctcagctctagtcagctcgtcacggcatgagatcagcgtgagacgcagacgagaccagctgcctgtgcgccgctgcctgcccgctgcgcgcggccgggcggcaaattctgcggcagtcttctgccgtctggtctcgcgctggcttctgcggaggaagtggggggtgactaaagtgtgacgttgtagggccaggatttcggaccattcggtggactgaagtttcgcttttcctaatctattcctaggtgagttggggagctggttccatcgaccgtgacgacccaacgaactcacgtaggcccgagctaatcaattagcaaaggttgttgcttagtattggtttgcgttaatcggaagacctaaaacatattttggcaattgttttgaaccatatcaccattggatccgtggcgcaatggtagcgcgtctgactccagatcagaaggttgcgtgttcgattcacgtcgggttcaatatcccgatccaagcggatttcctttttaattttttttctatatgttcctgcgtttctaaaattttctatatttcgttcctcgtgtaagtttcaaaatttcttttccattttctatatttctatgttccctgcgtttctaaagttttctacatttccttcatcgtattaccctataagtttcaaaatcgtataccctataagtttcaaagtttcttttccattttctatatttctatgttccctgcgtttctaaagttttctacatttccttcatcgcattacactagaagtttcaaaaagagtaaagtccatcaccggtccctaaatttgtaccgctgtgtcatcccggtccctaaactcttaaatcgaccgttcagatcctcaacttattcaactgtgtcatcccggtccctaaacttgtggatcactcgtttagatcctccaaattgttcagttgtgtcaccccggtccctaaacttggatttgaatatcatattggtcaaataggacggtctaaagactttatatatttaaaaataattcataacttttttatgtgaactctaatgaa

SEQ ID NO: 63699 - DNA, 23153 bp, Oryza sativa
ggttgcgattctgctcgtccacccaatggctgtacttaatctcaaaacctaaggcacctgcatgtacgtaatatgatgaaaccacataagctggtaattagaatgaacaaaaatgttaaatctgtgctgaacattgtgatcagaaagagcggcacaacaaaaaacctaacctggatcgatcggtcctgtaaatccaagatttggttctcgaaggctcccatttgcatacacagcctgcatcagagcagttgcaaatttgcaatggagtcagtgacacaagtgtaagctgaagtggctgcacaacaaattgttatccgtgtacctgctgcctggcccgttgaagctcttgctctaactgcgctagtttcaaccggcttgtctccagctgttggatataagcctatggaacaccataatcatgccgataatgaggattttgtttttcaaaaatgggaaagctacaatctagcatggtgacagcatgttagtagttaagtacttgtcattttacctttttccgcaggcggcttttccgtgcagcctctctgttttgtgcaagtcttctgaggacctgaataaataagcagaaaattattttatctcgcaagaccaaactgaatttaacatatgaaatggactgtgagttttgggaatttctctactgcatcttttaagaaaaggaaaagagtaataattacacggtttcatataatggagcagagcagagatggttggattgtactgtgtgatgctcaccttgtctggcggcttgcttgcctcctgatcaacatttctcccttcctccagaactacttggggaatttcttctagctgcaaatctcatcaaaatgagtattaaacacccgatcattcaacaggcaattagtagaagccacagctcatagctactcaaaatactagaggaaacaaaattaaatcaaagcggatgtgttcctcaccctattctcaaatttcatctctgcctccatgatcgtggatgcactcgtggcctggccgttgtcaaccttgaactgctcgtgactccacatgccaactggcggaggccggtcgtacgcccccattctgaccggtgccgcgaactgcgtcgacgccgaggtcatgtactccggaggagaggcgctgctgatactgaaccaagtaaaagaggatcagcagagtgcaccctccctaagtgcaaaaaactaaggatcgccacacactacttggagcagcagctgcaacaagctagggaggaaaggaagaagaaaaaaaaggtgattcttttaaactgggaaatggaatgtgctcagcacagcacaaaggttagagatagctagctgtatgcaaaggcaaatatgctctccccaagtgcggccgcatgcatctccacaaaagcttgggggatcaaaaggcgccattttcactggggattagagcactttgccaaagtggcatgcagaggttgacaacatgcgcaacaaatgatgatgaatcaagcttgatctgaaggctgagatgacgttcactttgcgagcgcacttccatcagggaagaaaaaaaattcttatcatgtgtacgagtctaattgtcagaatgatcactaactcaacagcccaggtccgatcagtagcacagtcatcttcagcccaacagtaacagtaacagtctctctcactacaaagaggctgtgatcagagggataattaatactccctctatcccaaaaaaacttaacctaggcaaggatgtgacatctaatatttcttagtacaataaatctggacaaccatttatccagattcgttgtactagaaaatgtcacattctcttctaggtttagtttttttttttgggacggagggagtacgaatcagttgccagcttcaagctagttgcagctagattgttagaaatgatgcgggaacctgtgcctagtcctagtagagacgagaagaatctgagtactagctagcagcctggactgcgtgtgcctgcccgcgagtggctggatgcttgcttgagttcgagtggaacctggaatctggaatcccagcctcccaggcagtgcagtgccggcagtgtgacgaaggaagcaaagcagagtgcgagtggtggcggcgctgccgctgcgagctttagcttttgcaaaggcgcggtgcgtgacgctgagagtgactcgctcgcttcccttgctgctccacggacaagttgccacctggtagctgctgcttctcctcagtgactcagatttgcttcgtgggtcccactctttttttgtggggtcggctgtctgtctcagtcatcatcctcatatactactactaagctattccctctgtttcatagtgcaagtcattatagcattttctatattcatattgatgttaatgaatctagacatatatatcattctagatttattaatatcattataaatgtggtaaatgctacaatgacttacattgtgaaacggatgaagtatagtcaatcctgtgccttcgatgtcaaccaagtcctgaaccagtgaacctgaactgaactccatgggatgtctgtaattgtaactaagattctggtgatctaatcccaagcacagaaagcatgatgacgcagcatctatgatcaatcgatcatgatccatcgtccatggaacccatctttgtctttgtgaggatgatgttacgtgctgcacgaacgggcaaagcagcagcagcaggagaagaagctcactcactcccacacgtagtgggggatttgccgggccagcacactggagggaccttggtaatgtgtcgctcaattattggcggctccactttgcttttgcgctaaaagcgagtgaggttggcctatccagcgcccacgaaaatgcaaaaccggtgggcttcgttttgtctgctcaccctgcaacacctccgaccaccgtggatagctcaaaccccactatgtgtatgtcccaacttatcaggaatagcagtgtgcattgctgtataatggtcgcctcattttgtcgcattcactcccgcatatatgggcatcatatatgtatttactacctatatgttattctaaccaatttggagggattggctctaatctctaatggcacagaaataagctcaagtttctggttagactgaagcctgaaataactatgtaacattttttttagaggaatttaaggaaactgtgtttgctgtagacagtagtgcacagtgcactgctggggaacatgaaaggacagatgatgtcaaggaagaaaaaaggaatgctagattggctaatctttttttctttttcttatgaaactttgattggttagttagtggtgaatggtgatgcattggtcatcgctcaccactttcttcagacccgcaacatcacttggggagggccaagcagtagcctctcctttgccctaaactgggttggagatgatgcaaaatgccttttttttctctagtgcccctgcactattttgccaaattaggacctcgtcttttatttttccgttgaggagtcaactatcaggatcctctacaacaaggatctgacgcatagttcatggctattgccgtgccctatttagaaacagctatgtgcaagacgcagagttcacggctattgccgtgccctatttagaaacagctatgtgcagtgtaaattcgcagtaacctacgggctatgaggaaaccttttgatttgttccaaatgggtggatgtggttgtctaaacaagagaacaaagcagagcatctatgttatactttcagagaattagcacaaggtatcagttgatgtcgcacttctatcttaattggtgattctgaaatctggtagccagcgtattattattgtaggcttcacctttgtctgtcctagctgacatgatctcactttcgctgcaccacagcactagtccacttgctgtaataaatatctattcggtttacatcatgttgtgccacaactaatgaaaatctaatgcaaattgcaatactagaatgcgtaaatggcatcataggtgctaactctctttcgtttgacagcttgttcaacttcaacgtaaaaatgcagcaattctaattgtcattttccatttgctaaatattaaatagagaaaattcagaaataataagggattcggttataggaatacacacctaagcttgtggatgttaaaatggtcttcaagatagccagggtaaagctccattatatcattcttgaattggtctcctccaataataatactgcataaattcatgtgccagagtgggaatattagctgcataattcataaacaatactgaaagttatgcagttgctctagagtgtccagtgtcgcatgaacatggaagaagatatggtcttagaaaatactctaagaaagatatgttctcagggaaaaaaaaagttttcgctcaaggaactttattccaacagtgtaaagattataatgaacatatggtttacgagtgctattccagacttactggagaagcgaatatgatcagttttagtaccactccagcactttgcagtcccattcaaataagaaaagaaacaacgatagacatgacgagacaaaatcaaaaacccttagctatgatgtcttggaagaactaaagaattatcagatagcccacttattcagaagctaaaatttttcagagtccccaagaaaaatcatgtccttctttcactaaacgagtcatcaccgaaggagaaaatcccacctgatgactctgctggttaggttaacaggaaacatattttcctacttcctctctactaggaatgaaaagataaacaagatatgaaaggcaagctgtggtttgatgttttttctttgtcaatcaggtaataaaccctatagaaatgcaagttatcattaattctagcacaacagcacatatagtgaaagccaaagagtaggacttaacttgttcttcaccaagatgacacacataataaaaacagaatcagtgaatcaaatatccagagaaacttagtacctgataaagttcttccgtctaatatggatggcctacaaagtagagcactggaacggtaaattgcttagcacaagagactccacggatgtgctatgtagctcagctccaaaggacaccagttagccagaagaagtgatgcagggttatataaagagccacagctgccctcccttcaaaagaagaagccaagtatgaagagcttttagtatctaatattatcacctgggcctcatgcttaggatgcactaattattcttttcgtaaactagttggatatgtgagaagttgcttgcacacaggaatacatacacacatccctcaccacctaactagtagagccagaaaaagtctgcacatgattctgacagagaagaaagatggtaactttcaggtgtaaaaaagtagcacgcttttaagtctgaggcacagccttggttacttcgatagatcgacacactagcaaaaatcgatagtttcagataacccaggtgattgacagtgccctacaaaagcatgccaggaagcagtttccacacacatttttattacgaaaccgccaagcaaagatggttaaatacaccacatccactgtcaaatactgattaggcagaaagctgcatgcaaggagatttggtttcagaaaaggaagtctcgtcagacaaggcaacactaactcatatgccataactgagcatagttaagagatttagtttgtcacccaaggggacataataaagttgtaaacactactagttagtactccagttattacaggcacagtacaaataccacacaagtaaactgaacttatcaggacttaatcccattgctagagtgcccctgttgcctcatgaaggcaagcaggatttaactaatattcagattgttagctaggcagccgaaaagatcatccaaccaattttattaagagcgaggtaatacgatgaccctataatggggctcatgttagattccatgatgcaattaggggacatcactagattcagcaacttggctgctcggtggaacttcccatttctggggtatccctccttgatcactaaacctcctcaaccttcccaaaaagatgccccctttacacctttcttttttttccctcatcctatgctacttgccttccttcctggttgcttttttggtggtgtgcccatatcatgccctttaattagctatatgatcttgagggtttctgttctcaagaggaacagatcatgctaagcatctagctatttcatttctcaacacaagtaagtagacacgcctagcaagaacttacacaagtaaacatggaggtgaagtaccatgaaattcagtcaatatcaaagtatacacctcaaagaaacaatcgattttcgcataacagtgtctgacaactaactactaggtctaagtcgttacactatttggcaatcattgtccatgatccatatctttcccaaaagcagcaagaaattacaccacacatataatactctgaactaacacaaattaaataaaacaccgaggaatatataatagaagtatgagtgcagtggggcacctcctcttttgcgaattgcgtaacgcttggtgcgtgacgacgaagaattcccctttgccataaaggcgcaaaagaagaagaacctttcgaccccggctaacctaaagttagaagaagagataagataaagcactataagagaaattaattagtgtggtaatcaggcaggggcagcaatgatgcgttattgttaatgttgcaaattcgcaaacccccaaacctcaagatcaaggtcgtggccatggccatggccatgctctctgatggaagcattattaaagaggcccccccgatgtcgccgtcgcgatgcggttttttcttcccctcggcgaggaggagatgaaatgcgccgcaacagtcatggtgggctagggctaaacccgctaacccctcggctgtggctgcggatggctaaccctagccgattccttcgtggcattgccttccttttggcttgattggtcttgcgcccttctttccccaccccctctcgcttttgcagcacccaaccttttcaatcctcatcatccgctgtacgaaattcagcgaattttttttttcgcgaacgcaattcagcgaaattttccgatgaaaaagccagcagatctctattcccctgaatctcactataaatctgatcaggataagaaattagagaaaattacttacctggaattccggacatttttcctggatgattgaacggattcagaaccgggaaaattacttgttcagcatcgagatgagattctctctctcgctcgtaggcaggaacagcgacagcatttcgcagatggcgattggagtatcggagcaataattgtgggggagcttgcattgcacttgctggctgcatcgattctgggccgagacgaacactggctaccacccaggtggtggagtggtgggccaagcttgtgtgtgtttttaccttcggatcaaagtaaacggcagatctctccaccatctgcctcacgattcccaaacaagaaaaaggtcaaccgtctaagagcaggtacaatagcaggctataagccagctgcaaacatattctaagaagatcagcaggctacagatttatagtcagctgtagcacggactccaagacgcggtgtgtgtatgacaggtggaccatgtattaatagtgtagtatgtaactattgtatgaatgagctactagattggctatagataaattggcactagtagttggctatactattaaacttgctcatgggaaaaattgttccttgaattaatttgcaaagtggttttggaatctagtagtacaactttttattgtttttgctagtgtattatgaccgaaagttatatttgtccacgggatgaaatgccggtttgaaaatcatattaaaaactccctctattttttatttgatgtttgaaccaaccaacgtcggataaaaaaacaaaggtcttaatagagacattgtagtttaaaaatattaatggtcaaagtgaaaacagtaaaaaaaaatattgctaaatatctgcaaatggatgttggcggatccaccatagggctttgaggtctcgagcccctattattggtgttgcaaccataggagcccccatagagcctcactgaaattttgtcatacgtccattaaaagaggtgctatagtattgtatagttttttttcagactctctagctaactgaaggatccgcctcggatgtagtatcagaaatcgccaaaattataagctaaccaagaaacaaatcacttgtccggtagcatctcccgatcacagcaaatcttacttctttagctagcatgagttagtgttaggaacttaggggggcaagcgtgcaataataatcttgatcagtagcttagcttgtgacgttagctaactcgctctcgctcggaaccaaggaaaaaaacaactaaagttgctagaccactactaaaggcagacgaaaaggagaggttgggtctccatgcatgaggcattccgtttcaactttttaatttaccaagtgagcagaaggaattagtggtgtatgaccaagactctcacgtgagcagtgcatgaacaaattcatttttttctctaaggatcagaagattcatgtggaatgaggggctgggcaggcgcatggtgataagatattcaattacaaagttagtggttaaaaaatagtatttgggtctcaaaataaggattgatctaatttgctttttgcgtcattgagtatttctagatgagtagatgtggcttaaacgtggatttttttatactttgtaccctttagataacatattttacagatagaccatcacgaaaacttattgcaaatacagatccttaactcgcgccaattggtgccgagatctaatgtgttagaaccagacaccatggcatcgagacccaggcacctggagcatctgcattgggggcggatgtttccaagcgttgacctcgacggtccatgtaagtcctaaacattagaatttacttataaatacttagtttttttgttagctcgataattttactatgttgtacccatatcaaatcgaagacttgtaacttcttacatttaatcctaccaaggattggtgccaaagtaattgacactaaggtataacgtatcgccgctaatatccatggtacctcctgccacaccaggcgccgtcatggctgggctgccagcctgccacgggtggcaaggggtcagctccaacttccttggcactgacacattaggccttggcgtggagttagggtttatatctgcaataaatttgataggttctatttgtaaaataaacgtttgaaatggttgaaaggttaaaaatccagtggcttgagctgatggatagtgatgcctttacttccacttgatatgatctttgtgtagggaaagtgcaggggttaaggagaataatagaatataatggaacccgactattggtttgtaccatgggacgattcctcgatactctcaaagttgctcaacattagattaagtcatgcatgacatcttctgaactaggtgaacaataaacaggctagccagagatgatccccaatgcttgtgcttttgctcattattttttttcacctctattttttctttagaaaatgcttttgtacctctttttgcaaggaaaaaaatattccatacggccggcatgagcaatccattcatattcctaaacctgaaagttgaaagggcagtatagtgttgatatgtctcttacccaatgcatacctgtacattttgttcaaaatttgcatgtaaactcctagccagtgaaattcagatgcttaaaacagtttgatcaacatggaagaaacatcatatgttcagtgccttgtatctgatctgaagaactttacttcaccccggcaacttacagcaatataatacaccgtaccgatttcagataaccattccctggcgaagtatgaaaaacgtgcttgccactatctctctttcagactttcagataatttagtcgtgttttacagagcaccgaaacgcctttgcactatgtgccaagctgatagctggtcgatacacttcagtcaagcacgtaagtctactcagaagggatgctataagaattcagacctcaagaaggagacggaagttcattgcctttaacccatttgttaaaggaaaaagctataatccattgcacgtatcttctttatactaaagagtatatatgtatactgtatctttgctagctacagagttgatcgatacacgcttcgtgtcgacataagaatgcatatcttttgacttcgctgttgcttatgtgagtggtgcatctggagttctcaactgtgctggagcctctcttgaatagacaaggttatcaattagttaagaaattttcaggttatttaaataaaaagattaagagaatccaatatggtgcatgaacctcttggatgttgaaatcagttaggtatgcctacaaaatatttatggacgacactgacaatatgcaaggtccagtatgatcaatccaggttaatagccatacctttggttatacatacaaaatggtcttgacactgacatatcaatatgggctgtgccaacaattatcgggatagcagcagctagccagctagtggcttgagataaattagttgtaccaagtcttcttatattagcaaactttcgtgttaaacatttttttctcacaagttcaaccttttgtctgaataaaagactgtctatcggtttgttcagtcccatttttcctctctaaatttacatggttcttcgtggtcgatacgtcgaggaatcatgaaagataacatatattctgaaggataaaagaaaaaaagaaagaaagaaaggatgacagaagagggaggttctatgtccaacaaagtgtgaattggtgggggcaaccttcctccaagtatgagagagccttttgttccacatttccactcaacagctaagacaataatgccctaaaaaaatatgaggtgccaagacaataatttggataacctatgcaacaaatggagcagtcaatgtcatctcagcctcacatgttctttaatctttatttggacaagcacaaggcaaggtagaggaagtaggtgtcagcaaaacaccttgtacacacgcgagatcgtagctatcctagcttaactgacgcttgcaggatgatgaacagtgtactgacgaacacagaaacacagcaaagcagagttttggcgctgctcaacaaccaccgcagctttttctgattctttctattcatactcctcatcttgtgaggttgttacatgcataacaaacaccagctttgccggatctaactaccgaacgcgccatcccacgctccagacccagctcggccactacaaccgaaaaaaactgcaactacttgaccaactctgaacaaactcaggccagccacaatacaaatggaatccaacgcctatatgctattataatgcaaagaattgactaaaacatgcatgctaacgacaactttattcttggcactcaagattatctatcattctcccccctaatcttgaagtgtcctatccaaacccatcttccttcgcaattccttgaaacgaactcgtccgacaggcttagttaacaaatcagcaagctgatcttcagaacagacatactccactgcaatttgcttcttctccacacactccctgataaaatggtagcgggtatcaatatgtttgcttctgtcatggaatacagggttcttgcaaagattaatcgctgacttgttgtcaatcataagtgttgtttggccgggttctgcatcaagcagctcagcaatcagccgactcagccaaataccttgacaggcagcagtagtggcagctatgtactctgcctcacatgatgatagagcaacaactttttgcttctgagattgccaactgatcaggcttccaccatacctgaacaatacacctgtggtgctctttctatcatcaagatcacctgccatatcactatcactgaacccaaccaactttgcatttccaacttcttctcttccataccagcaacctgtcttgatagtccctgagatgtatctcagtatatgcttgactgctgcccaatgttcacttgttggtttttccatgaatctactgacataaccaacagaatatgccagatcaggtctagtgtttaccaagtacctcaagctgccaactatacttctatactctgttggatcaacacattctccagtgccttctttactcagcttgagccttgcctccatgggtacttgagtgggattgcagccctccatgcccgttttctccagaatttttcctgcataggcactttgtgacagaaaaatcccttctcctttctgaacaacttccattcccaaatagtagctcagaaaacccaaatcactcatgttaaacctctgcttcatctgcaacttgaatgcatcaatctcctttttctgagacccagtgataataagatcatccacatacactcccactatcagctttgagtccccaactcccctcacataaacagcactttcagttgcagatttattgaacttcaaagacagcagtgtgttgtccaacttggcattccaagccctaggagcctgcctcaacccatacaaagcctttctcagtttcaaaaccttgcttgcattggtcttgtcatcaaatccaggaggttgcactacataaacttcttcctcaagctctccattcaagaatgcagacttcacatccatgtggtgtatctcccaccctttctgtgcagctagtgcaaccaacaatctcactgtctccattcttgccacaggtgcaaacacttcatcgaagtcaacaccctgctgctgcacataacctttggcaactagtcttgccttgtgcttcacaatcgcaccagatggatccttcttcaatttatagacccacttaagcccaatggctttgtgccctgccggcaactcagcaagtgaccaagtctgattttcctcaactgatctcaattcttccaccattgccctcctccagcattcatgcttctctgcttccacaaagcttgttggttcttcagtagcaatcaaacactgatcactgtagtcgaaatccaaaacaggttcagtagtggagagaatgtcttgcactcggcgatacctaacagggcctccatctgtttctggcgtcactgaagttggtggtgtgcaaaactccccatttggcgctcgcggtggtgaggacagaacgcccgtcgacaccggagacacgcctgcctgcaccggcgttcctgtctgctcgcccgcatcagcaacagagggcgccacagggctcacaaagaaatccaccgtgaactcttcttcttcagtcgccgcatcctcaggatcacgccacgcccatgtcgccgtctcatcaaaaacgacatcccgcgacacgcagacgcgctgcgccacaggatcatacatgcggtatgccttcgacccctgttcatagccaataaagaccatcctcgtacctcgatcgtcaagcttgcgcaggttcggcttcaccgtcttgacgtagccgacacagccaaacaccctaaggtgttcgaccgagggacgtcgcccatgccacgcctcatatggggtcacaccatccagcgccttcgttggcgagcgattcagaacgtacaccgccgccacaacagcctccccccagaaccgcgccggcagcccagccgccttgagcatggagcgcgccgccgcgacgacggtctgattgcgccgctccacgactctgttttgctgcggggagtaaggagcagtgagctctcgccgcatcccgcgatcggtgcagtagtccatgaactccacggaggtaaattcccccccacgatctgtcctcagagcccgcagctttcgcccggactccagctcaacgccggcttggaactgtttgatcgccgtcgccgcttcatgcttgccggagaggagccgtatccacatatgccggctcatatcgtcgacgaggagcaggaaatacttcctgccgcctggggtcgcaggcgtgatcggcccacacaagtcgccgtgcaccagttcgagcgcctcctgtgctctaaacttggcctcctccgggaacgggagtcgtcgttgcttgcccgcgagacaaccgtcgcacagttgatcagtgtgatcaatggtcggaagcccgcggaccatgttcccctgggccagcctccggagtgactggaagttcaagtgtccgaaacgcgcatgccaccgccatgccgtgtcgccaccgctcgccgccatgcagactggatttgcaatatgcagcttgagtatgtagagataatttatgtctcgttttacctttgcgaggagaagaccattgggatcacggagtgtgcagaccccgccccagatatgtgcgtcgtagccgcgcgcgtcgagacggccgacgctgatgatgttcttgcgcagcttcgggatgtagtacaccgcgtcgagagaccggtgatcaccattcttgcatcggaacaccacggtcccgcgcccctggatttcaatcacagagccgtcgccaaacttcaccgtcccaacaacgccggtgtcgagctcggcgaacgccgaacgcactccagtcatgtggttggtggcgccggtatccagaaaccaatctcctgtcacctcctcctctccaccatcctcgtggtccaggatcaccttcttctccgtgaggtgtacctcctgtccactaggtgttcgtccgagtgtcgcctcgccagcaagtgacacccctacgacatgtgccataagcaacgtcggttcttcctcggcggcttgcaccaggttcgcctctccccggcgttggcgacgtggcttgcggcactgccttgcatagtgaccaaattcatcacaattgaagcactttacccttgagatgtcgcggctgctgttcgcaccagtggccgcctctttgccctttggtgacccaccgggcttgcctcggtgattctgcgcgccgggcgcgccgcggcccttattgccgctgttgccagagccctcctgctcccgctgcttcacacgtgcctgccattgttcctccgtgaggtacaatttgccgccattgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtctgcgacgacagcagtgagccgcatcgcaaactcctccggcgtctccctctccttgaatcgcatcgactcaaattgacgacggaagccctgctccttcgcctcacgcacacggtcgacgccgacccgcatggtcttgatggcgtcccacgccgccttcgccgtgtcatgctttgccagcccgcgcaacatctcacgcggcaccgcctgaaggattgccgagagagccgcccgatcttcacgaaactccgcgtagccgggatcgatcgccgtccacagcccctgtgcctgcaggttgacgcgcatcaggagcgcccaatccgggtagttcgtcctcgagaggactgggaggcgagcggtgtgcgatgcgtctctcccctgagacacgagcggaagtaatgcgccgtctgcgccattccccccgccgctgccgcttgcgccaccgcggccgttgccgctccccccgccgccaccgccaccacgacggccaggcggtgtgtatgacatcgccggatcgttccagtaccgctctgataccaattgtcagcaaaacaccctgtacacacgcgagatcgtagctatcctagcttaactgacgcttgcaggatgatgaacagtgtactgacgaacacagaaacacagcaaagcagagttttggcgctgctcaacaaccaccgcagctttttctgattctttctattcatactcctcatcttgtgaggttgttacatgcataacaaacaccagctttgccggatctaactaccgaacgcgccatcccacgctccagacccagctcggccactacaaccgaaaaaaactgcaactacttgaccaactctgaacaaactcaggccagccacaatacaaatggaatccaacgcctatatgctattataatgcaaagaattgactaaaacatgcatgctaacgacaactttattcttggcactcaagattatctatcagtaggcgctgttttcagaagctgggacagagaagagaacctcaacttgtggagaggaacactaagtgcgtcaccatggctggccttcaattgttcaagccctttaggctggctgtagctgtggctgacgaccaacgcagtccacgagtagattctctgtgcttttgactatgcagggatgcacattattctcttgtgtcttagaggtgctttgaccaggtgcttagctgaagtttggtataagcttagctttgtattattttacacttgcaggttagatacctttcaccttttttacaaattcagtaaagtgaaagtaactatgagaactaagacaaacagaaaaggcatacagaccgctatagactggccgactgggatgttctgaatttctgacaggccatatattgtctgcatttctgataactgaattctgagtcttcaacactaaatttatatgaccatatatctcctgactccattcttatactactaactcaactacgttagtgtctgcttgatttggtatcatattttgccctaccaaaactttcgcaaaatctaattcgagagcactctcgatttagtcataactagcgacgcctatccagaatccagatatgtgttagctggaataatcttactttactatagtactaatccattaagtaagtaggagaaatattcctatcatctatgcttcaaataaaattttctctcaaattactcatccgatttacaattcgattacaccgttgtgttcgtaataattaaatctttacgacaagatctcacatgattatattttgatgaaaaatcacaaattacttttatgatatgtctaaattacttttagatttcactgagttacttcatagacatataaaagtaaatttagtaaagcctaaaagtaatttacatatattatagaagtaacttataacaaaaagaaagtaactttaattaatgtcttttttcattgaacaaattatcatatatataaattacttttatatttgattaaaatacctcctatacattcataatgctctgaggggattacttttattattgtttttagttaattccataatttgtgctgattaatttaatttctagatagagtcatgtttttatctctacaacggatttacttcaaatgacatgccaaagttactttcgttttgttataagttacttctataatatatgtaaattactttttgactttactgaatttacttttatatatctaagaagtaacttagtgaaatctaaaagtaatttagacataatataaaagtaatttatgattttttatcaaaatataatgatgtgagatcttgttgtaaagatttaattgttacgaacacaacgatgtaatcggatcgtagatcggatgagtagtttaagagaaaattgtatttgaagtatatgtgaatggtgtctcttatagatagagtggtagctggtttagacaaaccagctaccactagctgtgtagttacgtcccaaaactttggtagtaccaaaattttaacgagttttggcactaccagatttgatagtatagaatttaaactagcgtgggtaaaagttagtaccaaatcaaacattactttatactaatgaagttgccaacattctggtatggtaaaaattgatctcaatccaacccgcaaagcagatatgcagagagccagaaacatcgtggaattgtgggctgttgggctagcagaatatgcaggccgtcaccaatcaacaagcccagcattgctttttatccatgggccttcagttgcaaaacggcccagtttctcatggaccacgcgccgccgctaatccagccctactattaattcagccacatctcctcgcctccggctctctctctctctctctctctctctctcccgtgtccgcaaccgcaaatccccatttggtctcacctaaaaccctagctcgctcacccatggctccgaagaagcgaaaggcggatccggcggagtccccggtagcctcgtcggaggccggcgccggcaccaaccaccaccaggagacgccctcctcggagctcaagccccgggggaccatctacttccccatcaccgacgaccccccggagccgagcgcagagggcggcgccgagggggaggacggcgccggaggggacgacgatgaggaggacatcgcgaagctgctcgagcccctgtcgcgggagcagctggtggcgctgctccgcacggccgcggagactacccccgcgacgatggcggccgtgcggcgcgcggcggaggccgaccccgcgagcaggaagctcttcgtccacggcctcggctggggcgccggagccgacgacctccgctccgcgttctcccgcttcggcgagctcgaggactgccgtgtcatctccgacaagcaatctggcagatctaagggctacggcttcgtcctcttccgctcccgccgctccgcgctccgcgccctccgccgcccccagctccaaatcggcggccgccttgctttctgccatctcgctgcctcgggtcctgcccctccgacctcccagtcccagaaccctagctccaacaccaacgccaactccggtgcggccaataacgctggttctgcgtcgtcttcacaacctgacaacatgcaacgcaaaatctttgttggtaacgtgcatgctgatgtcgatgttgaccgcctgtatgagtacttctcgcaatttggtgagattgaggaggggccattgggatttgacaagaccactggcaagcctaaggggtttgcgctgttcgtctacaagtcagtggagagcgcccgccgtgcgctggaggagccaacaaggaactttgatggcaaaatgctcaatgtgcagaaggctatagatggcaggaccaagaacacacctgggatgaatgcaaattctaaccctagtggtaccgctgcctcggcagcagctgctgctgcagctgcacagatgactgctcctgctactgctgcaattacaccgtatgatgcatcagcttatggtgctactgccgttcctgacttgggttatgcgcagcaagcggctatgttgggattgggtgcacagcagcaggcgtttgcacaacccaatgctgcaatgcttgccatgatggcagcagctatgcaaaacccagctatgctcgcaacgctgaaccctgcttttgctgctgctgcattgggtgctgggggccagcaggtgcacgcggctggtattccaggttttggagctcagggttttgggacacagggctttgcagcaggtgccgccgcttttccaaatgcagcgggtgttcaagctcctcctggttttcagggtccgcctgggttccagacttctgctgggtttcaggttggccaagcagcttcacaagcgggtactgctgcggctgctgccgccggtgctgctggttatcaggctgctgctgctgggcagggccaagtgcccggaacgcaaattgggggtgctggttttcagggtggattttgaaatcactaggtataacaattcacatcctgcttaatcgcttcaagtcctcatttaccactaatgatttgagttagcttatcctccaaatattattcgcaacttggtgatttgggctaaaaatttctgattgtttctctatatcttagtttggcatctgctggtcgtgattcgttcgtgtggttttgcattcggatggattttgaatctatgttggtgccaaagtattgcgaaagggttcctgctgttggcttttacaatcagatggcttttgaatcaggcaactttgtggcagtatttacagaaggcgctttcttgaagaatttatgttgtttttattgcctactatgtagctttgtccttgcaacttcatcatgtacgttatggtttctgtaatggggtttaatgtactgaaatatctgtattttgacttgttgggatgttatccggtcttattgattatgtcaaatggtttctgggcacttgaaggctttttcttttttgcagttgcagtgggatttggaagaatgtgatattcatagcttttgcgttcaccttggaaatttctggtttgaggctgagttcagctgctatgaccttaagaccttgattgccattgagctttatttctaaatctgcatagtgatctcctgtagccaactagccatgggaaataggtgaaagttcactttgcgtttataatctcttgaaagagtataaattaatggataatgcctcatcagcaaacactgcatctccattggagattttggaatgtgcttttgtttttctgataaagtaagtatctagaacatttctataggattcaagcatagtaatggtactggcgccctgtggacactgcataggcttgactctttctagtgcgatgtgctgattgaaaagtgcatactagggtgtaggtaatgttcatcctgtcataaactcatgcggactttttagcttgtgcttgctgtcagaatgtggtccctctaaatatgagctgttttagcagaaggttatggtctgctgacagtgatctttgctttgtgctgaggaaggatagcattcaaaacattcatacagcccataaccatatgtgttctatttcttatatgcaccataagcgcaatcattaagtacggcagttgaaacctttgctttagagttcttatcctattgtctatagagtcgcaacaactatgcccatccatcagatgtagatctgattttcaaagttgcccccctttccaaatttgtcacaaaaccatctagtttcaaggcttacaacagtagatcaagcacaccaaatggctttacattgctaaatgtcgtgaagttattgtcactagctagaatttgcgcatgatgaagttacagagactattgaggtctccgtaagtttgctacatatcatttccctgttattttccatgtcatggaagaaatctccatctaattgatcaactttcacgttttgtctggtacaactaaatttttgttgtgagaactcgattagtcaattataggcatcattcttgttacaaatgaacataatctttcatatgtggtggtaaaaatctttacaatataatcattactgctgaattgttgtttatattgttggatttccttagtatcatctttcttgaaatggatttttttttgtttcttctagttgtgtatactggcagcagagacgaccagttattatttgatgatgattacatacttcatgtatccaatgggtatattgctttatatctggcagtcactatgattattacagtcttgtgtctatttgccatcatgttctatctccagttctctttaccatatcactgcgtttgcattcttatctttgaacgtgatgtcttgctaatttgagttcttaagcgaacttttcatattttccatgggaccatttcagtataaagactgcattgtggaatctggaaactgttatttcataggggtccgtgattatgaaactttttcttggatgcaatttagcagttctttaacctttttccacacaattctcacacttgtaatattagtggatttgggtatagtagctatgtgggaggtttggattctttatcaattcgtttgcgctgcaaaaatggctagtgaacttaatcaccttttggggccagacgagtttctacaccgtctgattttgtctctatatgtttggtttttaagctgctgttctgcttattgaagcaccttttcactaagagactccaattggacgagggcaccttttctagagcgttcatgcgaattattttttgtggtgatcatggggaatttgtttgtcacttaccatgcacagcatattaatgctctgaaagctgctgtaactcgggtgatgacaggcgaaggagctgtatatgccgtaacatattaaacatgcagtggtatgggctcgatgcgccctctattgaaggaccagacaaaactagagaggtagggactctcttaagcataaaatgttccggacttgaacgtttatcaactgctgctgaaagttcttagcctggtagaacaaagaatcctattctcagttgctccactaatttgccctcctttttgtccaagcatccagcatgcaagtagcctcatactctctgattgaagaaatgcaagtagtctcatactctctgattgaagctttcttcttgatgctaatctgcacttttattttctttcttgctgttcaccttatgtcaccagtgaaccttgtttcctcccctttgtcaattatatccaaccctcctcttatttgttttcttttcaagttccattggtgagcgatgcgtatattttggtggtttcctcggctaactgcaatcgtctaactctgaagtctgaacgagcggagcgggcgaagatgagacttcagttttgtcacagcttgagatttgatactggaactggtggtgctcctgagaaaacaggtgggtgcccacaatgacgttacatagatttttcagattatttttcttttgcaagtactctttactctgcttttcctcggtgaaagcttaacggtcctgtgtctcagctgctactgtagagatactgtagagagtatgtttcatctcaggagaaaaggctgctagtattcaatgtttttcgcattgaattttccctcgagtatgtacgtgtcctgggcaaacgtagtacgtgtcgtgggcaaacgtagtacttatgtgtagagggattatgctgacaggcgcaggagacttgctttgctttggatgtgtccagtga

SEQ ID NO: 63700 - DNA, 13481 bp, Oryza sativa
acgttgccgcgagaacgtgaacgagaacgagaacgatcgaaagaacgagagtgagaacgagaacgatcgaacgaattaacgtgaacgagaacgacaacgaacgtgaacgagaacgaacgtgaatgagaacgagcgaacgaacgtgaacgtgaaatgcaatatatatatgttacttcgcatttatcctaatacatattttttgtatcttgcagaaaagacgtgttgtcggagtcgtccctcaagccggagtggaagagctagccctagaaggaattcgtgcaggcaagtgaagtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagaacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttaacaaacatttgagaatttaataaagcagttaagtattaaacaatattaatccaacgctatacaacataccctattgtataggcccaaccattctgaacaaccatcccggctacacagttctatctccaaaccaggattgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtataacacaatccaccgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaaaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcgacggtgctccggtggtctacaacgacggcgaaggggcggacgaggacggagacgcgacggcgaccacgatggcagccttcccgagtgacgacgacggctgaaacggcggcggcgcacggctggagcgacggcggcgacggcggcgctagggcacacggtgctagagctcttccggcgacgagaggcgaaggcgagggtggcggcgggtagaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcggacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccattttatattggaatttattaattaaaattagatcttctcttctaggcttttaaaattatttctaaaaattccatttaaacaacaatttatatattttgaattttcagggtgtgacaggaaataaaatttcctaaatataaagcatggatggatttaatttttattaaattctccatgattaagtctactctctgaaattttctcggatttttcggagctcaattcctaaatgatacaaagaacagttcagtaattagttaatcaattaatgatctaattataagtgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaatagaaaaatgtttttaaatcctccttttggctttgggccgaaagccggcccaaaacccctctctctttctctctccctccccggcccagtccgcccagtccgccgcgccccttcctcctctctctcagccgctgagaggtgggccctacctgtcaggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccatctcgccgccggtcgccgtgggcctccgtcgccgctcgctagcccctttaaaagcacccccgagctctcctctatccgccgccacctttgtcttagcccgccgtcgcgtctagcgccgcctccgcgtagccctagccgtcgctgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcatggccggcgccgtccgttgctcttccgccgtggttttggtcaccggtgagttcgccgtgttgtcctctacccgttggtgtcctccgtttgcgtcgtcgcgctgtcgttcgccggcgagcgtgcgaggccgagccgtcgtcggtgatgacgtcatcgctgacgtcaccgctgacgtcatcgtcgccttgtcccgtgaaccgcggtagatcaagttgatctcggccgtccgttttggataggatcgatctcggccgtttgtttccttagaccgtcccgtgcacccggactgcctttgatgacgcaataatcctccttttccttttgaaaaatagttcattattgcgtaataattcaattaaaatccatataaatgctttaatccggtttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatcttgtaaaattcgtaataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgtagaccgaatattgcaagtcaagtcacacagatcctaaacacaatcctttgagcattttgatcctatatttaaattctctatttatttcaactgtgcatttattttcgaatgtcactgggtggtgtgaatctattcctttgttatggcctgtttgcattgattactttattccttgataccttgggttattataactagactagttgagctttatacattggttcagctagatattagatgtaattgcttagccatgcttagaaacattagcacactattgggataacttatgacttattattatttaatgatggcttaatgatagtttacgatggtcaatcgtgattggttaattaattacttgccaactaaaacttgataatggtgggttgtgagcacatggctttgagagtcgtgctcatgacaattaaggaccggttcacgagctactattgtgaaacattaaccgtgccaaccacaagccagcgtgggcaacggctttaccttttgtatagcatgattcattgcggagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacatatcacaccctgaaaaattcaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaagagtctcttttggctctgggccgaaagtcggcccaaaaaccgttctctctctcctcggcccaagtcggcccagtccagtccgcagccgcccacgcgcgcgcgcccccgcctgtcaggtcgtcgtcttcctcgcgtcggccgcctcccgaaaccctagcgctgcgccgccgccgtctccttccaaatccggccgctcctttccttctccggccgaattgatagaggggaaatgatcctcgggatctcctctaccttttcccttttggaaacatcggctaaatcggcttggaaagcgtttgattcgaggtcgaatcggatcggcttttctctctccgagcccgacctttccttctcgtcgccggccgccgtgggccttcgccgtcgccctccaacccctttaaaaggacccccgagctcttctctacccgccgctaccctcgccttcgcctctcgtcgtccgtagcgccctagcgccgagtagcctcgagccgccgtcgccgccgtcgctccagccgtgcgccgccgccgttccggtcatcgccgtcgctcgggaagaccaccgtcgtggtcgccaagtcgccgccgtcctcgtccgccccttcgccgtcgccgaagaccgccggagcaccgtcgccgtcgtcaagccgaagagctccgccgtttcaacctcgtcgccgtcgccgtccgttggtcttccgccgctcctttggtcatcggtgagttcgccgcgtcgcgctctacccgttggtgccctccgttcgtgccgaagtgccgccgttcgcaggcgagcatgcgcgtccgagccgccgagccgccgccgccggtggtgacgtcatcgctgacgtcatcgttgtcacatcctgatttttgtttcaggatttatagattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattgttaattttaatcatacaaagagcagttcagcaattgtttaaatattaaattaatcattaaatggtctgattataattttgttaagtactttgagtgtccaagtattttcaagatttttcttgaaattatttgagcattggaagtatttttaacaattcaaagatcatttcagtgattaatttaattggaaaagtaattaaagttcaccttttccttttcgggccgaattaggaaaagtcctctcactctcggcccagtctcctctcagcctgcagcccttttcctctctttcccgaagtctgctttatttccctcctttaatcagtccttggaagtagaagcccagccgaaagtctagtttgcctccctggcactattcatcttcaagcttggacagagccgagccgccggtgctgtgccctgtgcagccgccgcttcctccgttaaatccgccacatcccgagctccgtttgcaaaatttgttgaggggaaatattcctcttatcctcctctatcctctcccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgttttccccctctcccgtcctctcccgtgcaccgtagcccgccgtcgacgccgcatagtccgccgccgccgccggccgggttgcagccgcgccgagtcgccgtcttcgccgtcgccgccgcttgccgccgccgcctttaggtgcgccaaggtgaagagaagcccggccgcacctcctccttcgtcgccggccgccgtagctcgccgttgccggtcaagccgagccgccgccgccgttcatctcgtcgccggccgtcgtcgttcgtcgtttggctcaagggtgagtaccgttgggttcgtctcgtcgttctccacgtgtacatgtcctccaaatttgcagccgaccatccaatctccggcgaggtcgccaacccgggccggccattgatgatgtcatcatgacgtcatcattggttttttctttttcccgtttttctaatagattaaatcttctgaaaatcataactaaataactgtagatccgattcgagtggttcaagttgctaaatttttctaaaatcaagatctactgccggccgggttgcagccgcgccgagcagccgtctccgccgtcgccgccgcttgccgccaccgccattaggtgcgtgggagcgacgagaagctcggccgcacctcctccttcgtctccggccgccgtagctcgccgtcgccggttatcccgagccgccgtcgccgccccttcgtcgccggccgtcgtcgtttgtcgtttggctcgagggtgagtaccgttgggttcgtctcatcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttttttttgtactgttttgttgatttttattctttcgctttagtttccgacgttccggaggagagcgttttcgttgagcaaggttcggaagtgtttgcggaagctcaaggcaagtcacacagatcccaaacaaccctttgagcatgttgaacccgtttaaagctattattttattttaactatgcattatttttgaatgtcatcgggtggtgaacctttccccgttaattaatggccgaagatgatcttattttcctatgggttataatttgattagcatgaaccttatatattggtttggttcagttaaatgctatatgtatgtttgcttagccatgcttagaaacattagctaattaaaggggattaaatataaattatattacattattcttattaattatggttatatttaatggtagctcacgatgattaatcgtgtgatgttaattaattgataattaaaacctgtttaaggtgggttgtgagcatatggttttgatggttgtgctcatgacaattaaggaccggttcgcgagctactgttgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatcctttggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctattttcttttctttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccatctcgactgtaggataagccaaatggtcaaactttaaggacgaatttttccaacaaaaatgatttgtgaaaatttctcctttcttccttatctagaattctttgcaaattgtttcattgtctactctcctctctcgttcaacttgagtagttctgaaactagttgttgaaactagaagatgttgatgaggtcaacttatagaggtcagtaaagtggatcgaggaagaaccgaagtgccaagtggtcaagatggaatgaagtttggatcctaccttagaacctatgccgctaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaaactggttaaggtcttgtctttagtgtaacccctctccttctatcttctctaatatgcaacagatggtgaacacgcgcaccagaagtggaagtggaagtggaggtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagagcagaaggacaaccaatcacttgggctaagttcacggaagcattcaagaagacacacatacctgtaggagttgttgctttgaagaagcgtgagtttagggctttgaagcaaaaggatcataccgtggcagagtatcttcatgagttcaatcgtctggcacgttatgctccagaagatgtgcgtactgacgaggaaaggcaggagaagttcttgtaaggtctgaaggatgaactgtcagttacgttgatctcccatgactatgttgattttcagcagctggttgacaaagcaattcgacttgaagacaagaagaacaggatggataaccgaaaaaggaaaatgactgttttccaggaggcacaaggtagtagccagaggcagcgtatcatgccactccaaattagtgaatcttcttccgctggtcaaggacagtcgcaacagttgaacatcggtggtgagatcaaatcagagactaaggaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagacaaagcatcagcagccgcaagtcaacaacattgtcgtcacaggagccaatgcagtgccagttgcgtcttcaagagttgcgtcttcaagtgttacagctcagccaccagtttcaaagcagcagtagttttctttaaagccttagaataattatctgagttatggaataataagatagaatgcagtttacctatgcccttttctttctagccgttccgaatctcgggacgagattctttgtaaggggggtagatttgtcacaccctgattttcgttttaggatttataaattatttaataaattattattagaatttatattaaatgttcattaatttacaagtgaagttaaatgtgggaaataaaatttcctaaatataaagcatggatggatttttttttttaaattctccatggttaattatactctctggaatattctcggatttttcggagctcaattcctaattttaataatacaaagaacatttcagtaataatccacatattaaattaatcattaaatggtctgattataattttgtta

SEQ ID NO: 63701 - DNA, 8049 bp, Oryza sativa
ggtagttcttttatccttgaattactggataggtacatcaggagctgtcacatttgatctttctagttttcggaatcagatcctagagaaacctggtaagaattgaactaataagcgtgtgatgtagtatgtagaatatctgctgagtagatgtagaaatctggtatatttgggactttgggtatttgaaggtgtgtgattgcccaacagttgatcatggaaaagaaaagggctccattttatcctaggattatacctttttcagctttttggctttgtcctggatgttgtgaccagttcaccaccactaatttatgtttgcttgatccattgtacagggtcctgtatttgatatgcctgacttcaagatgggtgggaagaagagtgatgatgctgctcccactgatgccggggatgaagatggtggtgatgatgacggggacgaggatggtgactttggggaaggcgaagaggacgtttcagaaggtgagggatatgataatccaaaaggcatcgataacaacaagaaaagaggtgagcctgaggaaaatggtgaggaggatgaggaagagcctgaaggccaggagggtggtggaggtgatgacgacgatgacgatgatgatgacaatgaggatgacgacgacgatgatgatggtggtgaagatgatgatggagtagatgaggaagaggaagatcaggacaatgaggatgatgaggaagatgatgatgaagactcacttcagcccccaaagaagaggaagaagtgaatatcttcatgcggctatagttaccaacttaccatgcgctgagctgtgcttggttttcgtcatgttctcggaatcgaacttgcattagggagttaagaaaaaagggctccacacgttcagtaagtgtggatttgtaggagctttatgatttcaagcaattagacagaactctgttgtcattgttgcttgcttctgtggagttgaacagatgtttcgctaacataattcgacctgaatggtgaaagcctgaagattgaatatgtcacaagttatttttacttctttcatgcaactcaaaataaaaaagttagtgagaaaagagtgacgttaaaattaggaataacagcaacacggcccgtagccatttgtgccctgagtgcctgaatgtgagtaactgagtatgtgaccgggttcttcagatctacttctagcgatgtgataatgtcatccggataatttcagaaatatgtttcgtttagatggaaattttaggagtattaatagcatgatgaatatgtattcgggcggtcagaccttcaacacagagtttgagtccaatttaattatttctcgtgcttccttattttagactgggatttctcgagtactaattaatttctaagtctaattggacatggaaagatcctaggaagcaagtccatccctactatgaatacaagggggctaaacccgattgaaacaaaaactaaacaattgccaaattcaattaagtatcaaaccctctatattctacgtctccctctttcttgctacctattttaagtctatttttctcaaatctccaattgcttatcatgtctcatctctacagcattagaggacgtcctaattggcttgatgagcctacgacaaaccggtatgtgtttactctaacagggtcccacttgggtgctcgttaagcggcatctatcactccctatgacgcgtgcgtctccaggttcaaggtgttcaaggtgtggctgcacatttctacgtcaacccttccatcttcattaagttcttttacgaagttatcatttggcttgtacttatgatattcataccgcttattagtaaccaaatactccctccatttcaaaatgtttgacaccgttgactttttagcatatgtttgaccgttcgtcttattcaaaaaaatttgtgtatgtaaaactatatgtgtatatgaaagtttatttaacgatgaatcaaatgatatgaaaagaataaataattacttaaattttttgaataaaacgaatggtcacatacatactaaaaagtcaacggcgtcaaacattttgaaacggagggagtaataatttatcggtataacttttatatatgtatcttagcgatttaaaagcaaatgctataaaaataaggcatgattaaaaatcacaaaattgactaacaaaaaagtttttaaaattaaattccggcttataagcgtaagtataaacggaaagatggggttgtcactctctactaaaagtctaaaaccttggctcgattgtggtgagatataattgttcagaatgcaagtctatctactgttacattcatgtaaaaaacttaacatacgaattaccttttgtttcaggcggagaggtgtatttatatgtttttttgtagcggttagataactccaattagaaagacatttatttatatccgttatgtaatgaaatactccacgtaggttgttacgccacgagtagcgacaaatttctccaacactactgggcaatgcttaatggaagacgactctaacacttttctatatataacaaaaacaacatatttcttatccactatcctttcctacgtggtgttcgtttagtgacgtgtacgtttactattggaggaatagtacgattttgaaatggaatattactagattcctacatcatattagattcttttcgaggccactttgttaccatctctctagtactaacatataacgtgaaagtatataccatatttctcaatcgagttctctaatacacgattttaagggttttctggggctaatcttttttttttctcttaactcttcgatttttttacgtccaaatgagtaataataaatgacgtgtaataacactttttttcctctaaaaaggcaaaataaaaaaaagaaaagaaaaagaaatagcgacgaaaacacaacacaaacgaaacgctctcgagccagagtcaccccctcttctttcttacctcccccaaaccctagccatcccgatccatccactcctcgagatttcggcggaatgcctccgccgccgccgcggtctcctcgctccctttccagctagggctctccctgcccacaccctcccccgcccgcgagatttgcgcgcccccgcccagcgccgattcgagctgctcctgctttgctgtttcggtgggggaggccatgaacaacagcgcgttcagcgaggagatactcgccgagaagctcgccaagctcaacaacacgcagcaatgcatcgagagtatcctttacccacccagctttcctcgtgctaaatcttcgcgagaatttgggtgtttctttaggggtgtgtgtcgatgtttcgtgtaaagttgcaatttttttttacacttcatatcttgcgccctttcacgattactgttgggaatcaagtctcccttcttcatttttccctcctgagactgtgtatcatacttgtatcatactatcgtgttatgtttgtcaatagctagcaacttccttcaactttaagtggatatatctacgagttgcagatgtgcgggtagcacgcaagaaagcatcttgtagcttgaacaagtgcgggttcttgtgtgtcctttttacaccattggtagagagggttcttgtgttgttagtagctctctgattgctatactgtttattagtaaacctaccgaaaataggtacatgttgacttagaatcctgtgacatatttaggtggcgcaaatccatggttttgtttgtctgaacatgtctttccatgatctaatttgttcccttgactttaattcttcgcgactactagctctttcgcattggtgcatataccatcggaagaatgcagagcaaattgtccagacatgggcgaagcagtttcacagctctggaaatgaacagaagaccccttttctctatcttgctaatgatatcttacagaacagtaagcgcaacggtacagagtttgtagaagaattctggaaggttctccctggtgcgttgaaagatgtaactgaaaacggtgatgagcgcgggaagaaggtggtcagtaggctggtgagtataatttgtctactgataggaatttattatatctagttggagatattggtgataagagctatttgatgattactgctgtatatttaatatattcttttataaaatcctccaatatctaatacgaataaccgtgaaaactgcaatcatttaatactgcagtaatatgtgctgtaggttgaaatatggcaagaaaggagagtttttggttcacgtgcggggggcatcaaggatgtgatgcttggaactgttcccctgcctgtattagatatgaccaaaaaacggtctcacggttcctcaataaagatcgtcaaaagagactctcgttctgtaaaacttgtaagctttttttttcctaccccatctgctaaattatgttcttcagcattggaaagtgttatgaaaattctcttaaactcttatcattttgttttcagagactaggtgttgggggaccgctgagaagattgtatctgcactgcacactgttctcagtgaacaagcagatgaagactctgatctggagaaatgcaaaacctcaatgcggcgtgttggaaagatgcagaaggatgttagcagtgcttgtagtaaaggtgctttatattatttgttattgacatgaatcctccatcttagctgtcttagtacatattctcaagttattccttatctgtaggtgatgatcctcgtcgtgaaaccctttgcacagaactaaaggaagaggaggatagcatgacagaatgcattgaaaagcttaaagtagttgaagcaaatagagcaactgttgtgtctgaactgaaggaggcattgcaggaacaggtcagaaacaactgttgtgattatttatagtaatgcatttccattttccgtatgcaattgagttggtatttgcaaaagcttacttgtaatgttatttcaggaatctgagctggagaaagtccgtactcagttacaggtaatgttgtctaaacatcacaaattttattaaagactgatgttgtagcatgtattgatgtaaaatatattattcctatgttttgattaacagctggctgaagctatggtagaagaagcagccgacatgcaacggaaactcaagaacgagccagtcattccttcgtccaagcacttatcctcagtagaaccaggaaagccactttctaatgggcaggcgaaggatcagcagaagacagctgctgctatcctcgcagacaagattgcagcatcatcaaactctcagcagatactgcaatctgcactttccaagtttgctgctgaggaagccaaaaattcatccgaaactcaccaggataagaggctgaaaattgaacattcctcacaggtcccaagtgtcgcgaatgctgccgcttttgttccaatgccacaaatgaccaccacaacagcacagcagccccaggcaatcttagttcagcagactcctatgcaaaaccagcctcctgcacctcaaccccaatacaatatctaccaggcccctccccatcagtttgtccagcagcctggtggtgtaatgatgggcatggcgtacaatatgagcaccatggctccaccaccgcctccaccgccacagatgatgaacctagcaaggccctcaccttcaacaccccagccaccaatgggtataatgccacagactcagccgccaccgcccgcaccaacgatgcttcagcaacaaatgccgatgaacgtcggaccaccaatgcagttcgcccttcagcagtccggcgcgccgtctttcaggcctttgcagccgcccccggggatgcaattcttccacccccaatctcagtgacatttttggtagtccagctcctgttaaaactgtcgcgttttcggtgttagtattgactggtagacaaaaggttctgactgttgtagggtatactgtttggttgttctttacctggagatgttgtacatgtaatgcgaggaaactaacaggaagattcagttaagtgttgagcctttgctcaatcctgcagagaagggcagaagacgtcacctgtttgtgagctccagattggttgatgggctgacgaactgggcaagttcgcgtcaaaatcggcccgttgttttctttttctttctgggaaatgggaataacgcggtcgagattcgagatgattgtagtttgtatatgctgcccatttctgttgttctttttttgtaagcagcaggacaagttctagtaaagaggaaaaaaaaaaccccagaactttggattatgatgattcgcgaaataccttttcgattcgaactggaagtggccaatctacaaatgcgagtatcagccaaggtgatgtttggtacacattcatgtatcgaccgtattttcatgtcctccgtagctaataatctctaccatcctcactattcttctatttacaaaaaaaaaaaacataactttcaccaaatgaacttcaaatttttgatttgaaaaacatggtagtacatttcatttttttatagaatatcaaactgctgcatcttccatctttctgacatttttatgggaaacatttcgagtggcttttcttgtaaaagaattgcgtaataggcgtggacgctctgaatgggatagacacgtgactgggccgtgcggtgaattttacattttacccctcagattagtttaccttaagcactccgctaccccacctctccggaagctttcattcgcgaagccgcacaacacaacgcaacgccgcgcttccgcctctccacccgccgccgcctccctcgccggcttgccgccgccgccgcggtcgcgaggcggagaccttgcgggacgatcggagcgacgtccctctacacccctccccctccgcagcggcgagaagaacaagggggccgcccgccatgctgcgccggtaagggcacacccacaccctgtagatgtttgtcccatccgagttagggtttcctggcctaatgctcgttcctccccgcctctattgcaggtgcgtgcgggatctgtacccgctgcggcctcttaggaggatccctaggccgatctccagcgaggttagcatttccgtttccgtttgtttgcggtcgatcaagttgtttgttctgtgaggcgcttgctgtgtaggcaaatcggtagttttctgagggagctttacttggggcactcttgaattggcatgcttactcattaaattgatggaatgtgtactgatgcgcgaatagatagaaaatgctgctaatgtttacagttgtattaacataggaccttagtgtctctgtgttttgatatgggcctagcaaatcaaggactatttggagcataatgctgttacattgaaccagttttctgcttgatttgtctaaggtcttatgatgatattggggacctaagctaataaccatatctatttgtatcttgcatagctgctatgctgaattttgtaccagttttacacattgtaggtattacgtatttaatgttgtggaacatcacatgaactaaggaattgttgtgtgcgattttcttttatctatattagattgatcaattgactagtgcaatcaaatggccctcctagagtatagaaagcttgatttatttattgattaaaaaaaacttctgctgtgattctgtgaaactttctagttgatgcgagacacagttctgcagtagttgttccgactataataatgtttggaaggcagttgtttggattcaaagaatttaacttgatgtggtaccaaaagataaacaaaatccacttagactgcccttgcttgaactatgatatttgtaacttgatttaatatttttctttatttagctgtatatgcagtttgtttacttctctgtgtaaaatgctgattatcacataaagaagcgaaaaacacagaaaagtccatggtgaattcttgtatcggaaaaaaaataaccatactatcttctcatgataatatgtaatgctacttattctgctgggagcagtattgacgca

SEQ ID NO: 63702 - DNA, 1105 bp, Oryza sativa
agggtagtcaactgattcagtagcaggttttgtaaaactaagcggttaacacgtccttaaggtaaccgtacagttttcacggtaaccgtgatcattttcatccaaaacagtttgctgtaccctgttgatggattcataaatttctatttgatattagtccttttttttccctcactcaccagatctccttttttaatattacaaacagatattgaggatggagtagatattatttggggggaattttgtagtaggcgagactggcgagtacaccagcacctccgaagtctcagtctccatttaatcctgggaagcatgcgaaggcactagtagtaaatgtacgcatttgccctccacggctccacgcctccacccatcactagcctcaccgatcaccacaccgcggcgcggcccggtctatcctgcgcccaccacctgccctgcccgtcctgcccgcgctgcccgcctctctatcctcctctctctctctctagagtgtgaaaagtcttctcctttctctgctccccccttcctcctctgcacctcacctctcctctcatggagttcgcctagttgtgtgctctgctcctccttgaagaagccttcagatctgtggttcctagcctttctcagcttcctcaacacaggtacccccttctcgtccccctctctccctctcttgaaacctccttactcctgcacatctgggaggattacctccttgttctttgttcttgccggtaagcacaatcagttaatcatgcccgttgtctctcttaacacactttaccatacgtatgtcgtgttcagagttcatatgcctgaaaaactctgaaaacttttcttctcttgtgagaactgggataactctcttcttctcgttctgttttttttttatcctgctgttacctgacagagtgacaggtagctgttcgtttgtctcgtcagtatgccttgagttccgacctttctgttatctctgacagttgtagttgttcgtccctagagtggatctttgctaaaattagtttcacgaaatatcggacgcgagcgctttttttgcttgaccttgggaaggaaaaaaaggaaaagaaaaaaaaaactg

SEQ ID NO: 63703 - DNA, 2429 bp, Oryza sativa
aatgaaaaaggctgtgggggccgattaatcaagtggaatggtctgggagccgagaagtaatgatctgacccgggaggtcggtacattgctaaatgagttgttgaaaagcatctcttaaagtcgaatcgagacgcaagtctcttttcgcccaaacatagaaagaaataaatcacttagtgatttcaaaatgtcttcaaataaaagatttgcaaaacaaccttgcctctcttccaagcttgcattaaacacctaagttcccgtgacttgctgagtgcgaaagtactcacccttgctctatataaatatatacatagttcctccgccctgaagagaagataaggtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcctctatctattttaaggatttgctatgattcatatttgtcaccgtgggtaccagcactatgtcctgggactggtaccgagatcgcggtttcgtaggaagcggttcgcgccgttttccctacgacacgctcctatcaggtgccgttatacggcggtatcagattggggtgtgacaagagatggtatcagagcattagttggccctaggatcgaaacccctaaataggatggcattatctgaatacaaaaactatttgtgaaagctaaggtgtcgttgtcccctttagctctagttttgcgaaaaatcttttgtgtccaaaagtagaagctagtcgttgttttgacttttatcctagagcaaacctgtcttcacgcccagttaaagaaaggtgagctcaagcctctaggagtcttagttaagcccttgttggtaggctaaccttagtaccgtcacccgctcggtaggagttgtggtgaactagtgcgtgtgtgagttttgtttggtagtccgtgttcaggtgttagaccagttgggttaccggctgggacacaccacctatgtcttctgtgatttcgaaaaccgttttgatgtagtgtttttgtttcctccttttcttatctactttctgcgttggtcagttctcagttcctctgaagcaaatggcacctcaaccaacctgtcagacttgtgtccgcaactaccttggttctgaggaagacccagctttgtcagaaaatccaaatcaactagctgaacaagtcaccaaccaagtcgccaagactggtaatgctgttcctggaccaaacaaggaagttgcaaccagaaaccaacactcctcaatggatatttatcagattctagccaatcagactcagatgctacaagaaatagctcaaaatttggcttctatacaacaacaactgctactaccacagcccaaggtgaatccagacaagagtaagaatgaggccgcagaaatacaaggaacacaatcagtagaaggcactgatacccataaagagaagaacaaagaattcttaaatgtgatgattacagggatgaaaaccccacttcgagctaataattgccccaaccttcagaactcaatcaatgaatccgtatcgcaagaaaatagcatggttaaagaaggaagttgtcacaaaagaaagaccttgccatcagaagttgacatgcaagatgtcccacaatgtcagacactgcaatcttgccaaaacttatccaagacccccaccctcaaatcaaagaagatcagacacgttcccggattcatatgcttcatttgccacgaaattggccattacatgagacactgcccccaaaaaccctatatggatgcactactacaagctaatatgagcatctcaaggatgcccttctatccccaaggaagcccgaattcgccaaatgttaatgcagtacgtccaaccttccctgatgacaaaagagcaaaagcatcctgcgacatgtgccaagacatccaagaaaagaaagagatgcaagaatacaagagacgcaaagtaatgtccctagagattcaagcaaaagaagatttgtgtcgaaaaaacaaactcgccagcacaatactatcagaaagcatctcattcaactagttccggttctacgtctcgttcgactatgtcagaacctggtcagcaagccacaatgatcaacagtagtagccatgaaggaagcaactccgaaccatgccctacaccttcaaaaagacgtggttataaggcaggagtcgaatgtttcatctgccatgggatgggacactattcatggtgctgccctcagaaagtcaagtcaaaacgagtccaaccaacaacaagccttcccaacgtatctggaccaaagagttcaaagtcaccaaacagtggttctgcctcgttgacctcac

SEQ ID NO: 63704 - DNA, 3143 bp, Oryza sativa
ccctctacacttgttcttatatagttgtttgcaaaatttttgggatattttgggttcaatgggatggatgaattgatgtgggctgtgatggttgaattattttggaggaaatgtgagttttggtatgttttttatggctatttttttactgcataaggacagaccctctacactgtttttatatggttgtttgcaaaattttgggatattttaggtccaataaggacagtgggggcagttgcaaatgatggtaattgatgcataatttttgagcaaaattgaggccaaacttattatatgtcatgacttgtgtttttaggtacaaaaataatatatatgtgactgttttgggttttgggtcattttgagggaattgggatggatatgcatagaaatctattattaaatgaagttactaaaattatggcatttaggagaatatgaagtgtcccggtcgccaaatctggtttggtcgggttactgtctgcacggtaccgaccaagacaaattggtaaaaagaacatttcgttcaaatacaacatttgtagaaatctgttatcgttaccaatatcctagattgatttcaaggtcatttctttatggaaccctgttgggggaagtccctcgatagcgggaggtcgtgagacccccctttcgtgggtttggccgggggaagaagctcgcttcatagaaatcacgtatccgcccctaaggctgctaatcaacttgcacacaattggattatacaggttcgggccgctgtggagcgtaataccctactcctgtgtttgggattatggttaagtgttacaaggacgtcttccctccgtatgagttcaggttttctcagaatcatccccttgttcggtgggcaaggtcctccttttatagttcaaggggataccacatgcaccgcctctatctacccttccatgggagggggacccactttaccttgaccgggtcacgatccgtgccttcgcttggaagctaagcagcagcccttccttgagtgggacccagcgccgccccctgcctggtacggggggcagccctgtcattctctcataaatgagtgaagacttgtggtggtcctcctccgaatgacgtttcgacgggacgggtcatacctatctctactccaccggatacagaggcgacatgggggggcacagccgcccattcaattggacgtgaccggcgacaggcccgtcatagactggtcacgtcctaattgacgggggtcagctagacggcaccacacgactgcccttactgcattaaacacagtgagggacagttgggcaccgcacatcgatggctgttcagcctgggtccccttcccgctcgttccccccgccacatggtagctgggcgagggcctcagggcaaagcagcgcgaaagcccgaggggcacaacgtggcaccccgaggcccccccggccgcttctgtaactcatgaggaggtgagcgtgggtgaggcgaggataaaaggatacggaggcaaggactttgccttcttcctttcgccaactgcccacttgccttctcgctccttaagccctaatattctcgccacttcacaatatcccgcgcgccaagccctccgccgcttctccaccagccatcatggctcaagacgctggtgacacagtgctcccggcatcacgcattacggcggatagacaccttatcctcccccgtaagatcatgccggaaggcgccgtcgtgagggcgggggagtggcggccgcggccacggtatctggagcgatccgtgcacctcctgtccttctctatggcggggttgattccgccgttctccggattctttcatgaggttttggatttctatgaaatccatgccttgcatctcgcacccaacgccgtgatgacgctggccatcttcgcacatctgtgcgatatgttcatcggggtgcgcccgacgatgcggctgttccagtctttcttcattccgcagctgctgcaaggtgcggtggtagggggatgttacttccagccccggccaggcacggcgggacaatacatcgagagtcatctccgcaagaaatgggaggactggaagaaggactagttctacaccgcgttgccggaccacccgcgacttcggcttcccgccggtcctcccgaaagatctgccgcatggctggcggtttcggaactgggcaaggagtacgacgcgatgtgggatcaccttaggggcctgcgaagcctgggcctcacaggggcgatggtctttggtgactatttccgccgccgcatcgcacctctccaggatcgatcccgtggtgtgtgggagtacactggtcccaacaaccccatgcgtacgcatgtgggtgcgcgctgggactggggggaggaggacgcgaagatggtgattcaacgggtgctgggcctagactccgccgagcaaatgctaattccagatgagatccttcccctccgctgcgaccgcgaccgggagagcatcttggccgtgatgtcggtcgtcggcgttggcaggggctggtccagccggggcggcaccggtggtagcgctgccggcatgggtggcggtggcgcgaccgcaggcgggagtcggacatgcggacccggcgggggtgggagctccaggtctcccggcacaaaccgcggacccggggacgactcagctagcgacccgaaagagaaacggaagatttccgaatctcgaccgccctctcctccgcgtggagggggcgccgagcgcgtggcggaccgaccgccagcgggccacaagcgccccgccggtgctgaggccggacggaagaagaagcggctccggaagataggtcaaacggagccgtgtcgggggagcttcattgagcccccgaagtggacttttaaccgccctccctgcaggtacaactgccggcacccacttcgatgctttttactcatcttaggtttcttgttccctccgtttcttttccttcattaacgcgatccgggttctcttgcagcgagattccttcccagggggtctcggggttcgacccttcgcggcggaccaaatccgaacgatcggagcggccctggcttggccgatccaaggccgcggggccttcacagcccctcggcggggcccacggccgcataccgggt

SEQ ID NO: 63705 - DNA, 711 bp, Oryza sativa
agtagaaacaaatggaaaagttgtgaatctcgagcaagttgaaggagcaggagaagaacaggttccacaggcaagagcaaagccacagtaagatgaagaatgctaagtgaatcaagttaccagaccgttttgtggcaagtacgcaacaataagttgaagaaagactagcagagtctgaagctgcgaagaagtctgaagatcccttttggtttcgtgtgtgtggtccaccttcgaatctcggggtcgagattcttgtaaggggggtggatctgtaacgctccgcttttcgtgagtcgttaaaaactatttcggcaaaatcctaattgcgaaaattttcgttctttgtgtgcgagtctaagttgtgccaagatctcaattcaaatcctgttgttccctctcatcgaaatcaaaatcctccgcctcaaatctcctctcccaattcaagtctccgaaatctaaatccgaaagtcaatcccttcctttgaatcctcgccaaacacatttccaaatcccaaaatgtccaaacccccgttttgtttccttccttgactcccctatgttcccgagaacaaatacccaagtattccttttgaatctttcccatgacttctccttgaattccccttgatacatccctaaaccctcgagtttgaatatcaaatttgaattcgaacccaaaccctaaatctctccatttctctccaaatcaat

SEQ ID NO: 63706 - DNA, 2655 bp, Oryza sativa
ggctcgagcctgagcccgaggccgaggccaaatctaccctaggacccgaggcggggggcgagagggacagccactcccccttgcatttggggcgcgctcggggctggtcgtgccgaaggagggccgagagcaggccccagtctcgcgggggatctagcagcactctgtcgtcccgggggtggaccggcgacgtataggtgctgaaacccacctcgagccgccttgaatggtccaaggatgtctagcccccagaccgcaaaaggccaggagagtgggatgacctgcaaggcttgggctggctggtggcctcccttcgcccaggggcagagagagggcgaaaccactcgaacgggtggaatcctccctccgcgagggttcgcgacgggaaggagttggggagtcgtggcgacggtgacgagggccgtggctcccactagagtccccactcctggatggggtgggggtaaacgccaccgcctcctccacctccaagacctcgaccatgatcatcaagggccccgggaaacttggggcagaagaaaatgacttctcttcaaagtgtgcgactgccccttacctggcgcgccagctgtcgggggaagtccctcgatagcgggtggttcggccgggggaagaagctcgcttcgtagaaatcacgtatccgcccctaaggctgctaatgtgcttgcacacaatcggattatacaggttcgggccgctgtggagcgtaataccctactcctgtgtttgggattatggttaagtgttacaaggacgccttccctccggatgagctctctcgcccttgttctcctagagtttaggttttctcagaatcgtccccttgttcggtgggcaaggtcctccttttatagttcaaggggataccacatgcatcgcctctacctacccttccatgggagggggacccactttacttgaccaggtcacgatccgtgccttcgcttggaagctaagcagcagcccttcctggagtgggacccagcgcagccgcccgcttggcacgggaggcagccctgtcattctctcataaatgagtgaagacttgtggtggtcctcctccgaatgacgtttcgacgggacgggtcatacctacctccactccgctggatacagaggcgacgtgggggggggcatagccgcccgttcaatccgacgtgaccggcgacaggccggtcacagactggtcacgtccgattgatgggggtcagctaggcggcaccgcacgtctgcccttactgcattaaacgcagtgagggatagttggggcgccgcgcattgatggctattcagcctaggtccccttcccgctcgctccacccgccacatggcagctgggcgagggccccggggcgaagcagcgagagagtccgaggggcaaaacgtggcaccccgaggcccccccggccgcttctgtaactcgcgaggtgcgggagtagggccaggctgtagagccacgcggctggatgggaagatgacttccccttacttcacatacccccgggcccatatctccgacaaaccccattcccataaattcagtatccaaagatggttgctgtatctatgggaataaaggttccataacgaaatgatcttggatgcaatctaggagtttgcttatgataacgttagggatcttggataggaagggttttggttgcctgtgtgttctatctgcgtccgcctcgtcagcagatatgtagcatccatattccttagggccggagcagacgggatcttgacctcgacatccatatcccactagaacctgctaccgttgccactatcttatggtagtgacattgatagcaagttcgagtgggatactgatgtcgacgtcgagttcccggctgctctggccctattgagcatggatgctatggttccatcaacgaggcgaacacaggtaggagatagaggtatatcaaaccatcagagaatgtgtgtagatgcaattttgtgtttaaaaagtactttctccccgtacaacagtgacataggacatgtcgcagcaagacgaaccgatgtcaacgaccactacatcgagccggaatcctagggcctagaataagattcctaaggaagtctacaccataatagaggtggacgatgttggatatccgatggctccgacgaaagctgtcaaaaagttccctacgatatgcggaatcctagggaggcggaacttcactattctgaaggaccacatcgatctggtccctcaagaagaaaaagaagaggcctggaggcagttcaaggaaagcttccgataccctacagagcccgaggcaggactcaagcggcaggctatccgcaagatagggaattgttggaaaaatttcaagacaacgctggtcacggagtacgtcctcaaccccgcccagccagaaccatttgagaaatacccattcatcacccgacccgtgtgggatgagttccatgcccaccaaaccaacgaaagagtctcgggtaaaaagccaggcctaccgtgatctgcaggcaaggaaccttcacccgcaccggcttggcaccggaggctacgcggggaaacaggcagaacgggacaaggaggatgaagctgcagcggaatctaacaccccgcaagtgcttgctgatatcccgttccagcgg

SEQ ID NO: 63707 - DNA, 5236 bp, Oryza sativa
attctatgtcggcttattataattcagcttacagtaatctggcttaataatatatattacaataattttaacctgaaacaaacagaggcttagtttatttattgagagaatacggtagtgcagaaggtggagaacggctccgcttttacactagtagacacaaggaagacatacgtgttaccgtttgcgcataataccatatatttcaacagctgaaacacacttgtgtttacgtaaatgcagtggcggagctagaaacaataaattttatctgccatgaaggtgactatcagtaaattatttgaattttgcttaaattcaaattaatctaatttttttttgtcaaatggagggaggttatggtggttattcttctttatgtactccagtaggaaataaaacaataaatgcatgactaagattgaacaataatgaatctgttggatcagttggcaagtgtaaatgattgtactaaccgggaaattggtattagctattaatttatgaagttatgtatttatttttcttcatgcagacatgtgctcctacgtatcaaaaccatgtttcattttttacttcccccagccacagatccttgttggtatcctttccaaaacagttaaaaccagcttatcatactagtaaaaatattattattgtcacaaccatctatcaacttcctaattaatggctacctgtagtaaacaaatcaaaatgggtaaaccaaaccataactaattaaaaaacaatttacacttgtctgcatatttttttaaaaaatattcgataatattgagtttgttatagtttatcactatacttttatatactccatccatcccataaagatttcattttttttctttttccaacacttgactacccatcttacttaaattttttatggattttttatatagtcgcatataaagtgctatttatattttatcatctaataaaaatagaaatactgatgatagaaaaattttaaataagatgaaaagttaaatgttatataaagactgaaaaatagagtttttatgggagagagggagtaatacggagtaataatacacaagtttatcaattcttttacgacgtgctattgggatggtatagaatggacttccttttcttttcctacctcacctaacatttgatgaagagaacggtgaaccgggaaaagccctgtgaattttcaaacttacccagtcagtggatgggatgctatgcgatcatgtgagcgacaagttacaagatccaaaccagtcgtggagcagtcaagccgcgcacgcagagagaggcaggcaaggcaacgcaacgaaggcgaagctgcctgcctctgccgcgccgcgccgcgcgagatctgggcggaagggaaggcgcggcgcgacgcgacgcacgagagaaacaaaaggaaaagggaggggcgggggggacaaaaaccttcgccgcacaaagcggttaccgcgtccccccagatctcgtcgccgtgccgtgccgtgccctgcccttgccccgctggataccggcggcgcaccggcgcggccgcgcgatccgatgaggcggcggccgttcctcgaccagcggcggccgtcgtcgttcaagcgccggtggcagcagcgcccgtggtggttccgcctcgcggtcaccctcctcctcgccctcgcctgcctcttcctcctgctcgcgctccggggctcgcccgaccccgacccggtggtgctcccctccaccgactcgtccagatccgcggccaccacctcccctctcctccatcaggtgagcgaatcgcgtctcatatctactttgcttcacatttcgttagctcatttgcatttggcttttgagttgatccggttttaattagttcatgatcatgagtagcgtttgaaattcgtggctcctgtaatgtgcagagatcttacctcgatggcgttacggatgcgttcaacatgaccgacgaaatgctgagtgctcactcgttttcaaggcagcttatggaccagatttcccttgcaaaaacctacctcgtcgttgcgaaggaagccaataacctgcagtttgcagcagagcttagctcgcagatacggcgggcgcagagcatccttgcgcatgctgcagcccatggtggcacggtgacggagcaggatgcggagaaggcaattagggacatgtcggtgttgttcttccaggcgcagcagttccgctatgatagtgcagttacaatcatgaagttgaagggtcagattcaatccctagaggagaaatcgaaagctgaggcggaaaagagcaccaagtatgggcagattgctgccgaggagcttccaaaggggctttactgccttggagtccggttaaccatggaatggttcaagacaactgagctccagaggaagtttactgagaggagcccagcagtacagagcaacctaagggataacagcctttaccattactgtgttttctcggacaacatccttgctgtttctgttgtcgtcaattctacaactctaaattcaatgcgccctgaaaagattgtttttcacttggtgactgacgaggtgaattatgctcccatgagggcgtggttcgccctgaatgattacagaggagccactgtggagattcaaaaggtagaggatttcacttggctcaattcatcgtatgttcctgttcttaaacagctccaggatgctgccacccagaactactacttctctggcagtggtaatcgtggaacaccagtcaaattcaggaaccctaagtacttatcaatgcttaaccacctgaggttctatatcccagaaatctatccagaattgcgtaaggtcgtatttcttgatgatgacattgttgtccaaaaggacttgtcggaattgtttaccatcaacctcaatggaaatgttatgggagctgtagagacttgcatggagacatttcacaggttccataagtatcttaaccattcccatcctctaatccgtgctcattttgatcctgatgcctgtggctgggcatttggtatgaatgttcttgatcttgtgatgtggaggaataagaatgtgacaggtatatatcattactggcaagagcgcaatgctgatcataccctatggaagcttggatctttaccacctggtcttcttgctttctatggcttggttgagccattggaccccaaatggcatgtcttgggactgggctacacaacagtggatcccgctactatcaaagaaggtgcagtgttgcattacaatggaaatatgaagccatggctaaaaattgggatggagaagtacaagggcttctgggataactatgtagactattcacaccctctgcttcagcggtgcttcacgcactaatgaatgtgtatcaacattagaattttttgtgaacttcctagtggaaatgcttcaatgccttactcaacagccacacgtgaacacagtaacagaactgattaactttgtcctgaaattacatcctcagattagacatgggcggccgtttatactacctgtagttgatgaagtacagcaaccacagatgtgactggcacaggtaaacatcagaaagagccaagattgccatggattaggctgttatttgagcagcgtccattatatacattcataactcgcaaccaccaatgtaattttttcaattttgattttttgggtgagaaaattgagggcataattgtagatttgatttaaaattcttgtggtgtcacagcaagttttgagatatatatatttattggatgttcagagtaaagcttattgtttaaatgtctcacaaagcataattatcgtatatattttctaaatgttgttttgcactttgcatgccctttatgaggccatgcaatgttagtataaagtataaacaaagttagctcatccaggaaatgtgactttatgacatgatgtcgtagtaatcataaggattatcatgtttaacctcagagagaaatttagtgcttacagaacttttgatgaattgtcgtgcaagaaagtgtttacacaaaacaaagtgtaatattcagaacagaaatattatttgtgctgccatcggctacaaactggtaactgcagctgcttagctattattttctttccttctcttcagggctatttagcatatggcagctatctgggtcatctcttttgaattgtttttgcagttttcctatctataccttttatgattcatcattgcattgcagtcattttccaaatccaagtatctttttggttttgctgtggctaccttactttggtgacttctccatcaacattggtagaaggagcattggtcctctttttccttctggatctaaactttctccgcctacgtctcttgcttgtctcttttgtttcatcattatatatgggcatacggggcttcacatctgcaggatcagccacaggttcaacagcctgtgtactgttttggttggcttcactcaagctatccttcgaagtctccagctcagtctcaggactggtttccttcattggttcaacttcgttgctggcttccacctctttctccagcagattactgcctctgctttcatagttggcctcaccttgtgagttctccaactgtctagtgctatctagttcttctgtgctattatcttgactatctgccaatttggggctccactgaggaagttcagatttccccaagtggcttccctctagagcatcatttgaattatcattggcatcacctgttgttttgtcttgtggttcatcatcttccctgttagttctaagctttataaagtgttgttctggggaactattttcttgagggttgctctctgatgcagtggtgttgtagggatgcggttcttctgtagtagcaggtgtggaatcactagagtttgcatacttatcgaccaccacagtatcaacagttgcattttcgttgtttgtgcttgctccagtgctctcatcttggttactctctgacgcactattgtcgtaagaatgatgttcttctgctggagcagagtcaccagggtttgcagaattctcaggtaccgctgtgtcagaagttgtattctcattgtttgtgccaaccaaaatgctctcgctgatatttgtatctgatttctgtagtcgtgcaacttggtcttgatctcttcaagctcagcttctttttgctgcagaagttcctttatagctgccatttgttcagggcctgaagcagccgc

SEQ ID NO: 63708 - DNA, 9441 bp, Oryza sativa
  unsure (1)..(9441): unsure at all n locations
atgaatgtcccatcagcaaaaatgacctgattcaatttgattaaccattcttgtatcatagcacactaatgaaaggtctttttagaacataaaagaaaagaacaatgtgtagtactccctctgtcccaaaatataagggattttgggtcggagggagtcctccaccttgatctctgcttttatgggcaaggaggacctttattagtgtgctttgatacaagaatggtcaatcaaatggaatcaggtcatctttgctgatgggacattcatnnnnnnnnnnnnnnnnnnnnnnnnnnnnnnnnnnnnnnnctctcaagcataaccaggagtttccccagcagttggtttaataaatgatcctactgggcaagtttgttggactatttcgcagaatgctatgagtctctccctgttgccaagctctactgcctgagaaaatgaagagataatttatcactgaaatgcctagactgcagtgttctaaactcttttaaggcttggttggccttctgtcagtactcaaaatcaaacttctaattggatggttccttcagccatatatgccgcactatcatggctgtatgaatatttttgtgctggtgaagtgatgtttaaacatgtagatccaacctgcacaatatcatggcgaggaacccttggaagtggctgaactctatagcccttggttgacatgacttctgcaataagcatgcctccctgtggatggtataagactgtcacttgatatcttgcatgctgttttattttttcattttattggttaaagatgtggaaatttataaataacttaccttgacagcttctccaaccatttgcggagcaagaaacaagccttgaaacagtgcccgcatcacatgtccaggtgtagacccaaactctaccccaagtccaggtgcagacaggcgagctgctgctgccgcaaccaaatctttcttccctgcgacatagccaccacaaggtgcaattgtcccacctggattctttatcaaactacccgcaatcaaatctgctccctgccatgaaagtacccaatcaggtaactaaaatctaatgcttaaggtggctacaagcatgaacataccaccattggaggctctgacgtctcaacaaattcaccatagcaattgtcaaccataaccatgcagtttggattttgcatctgcaatgagttccaaaacatgactccatgagcaaatatcaccatatgcattagttaatgcacatacagaacatgctggtccatgaattcacaacatatcatcttgcctttatcaaatctatagctcgctggatatccgatatgcttaggctcttgcgccacgaataaccacaagatctttgtatgaaggcgcatccggtctcaggtctgacagcatttgcaagagcatcccaatcaaggccaccatctgctgcaagctacaactgaagccacatcagtaactcacaaatagcacaatgtaaagcattcctggtgtttgtaaggtgaagaaatcaacaaaccggaacttctcggtatgccactccaaaatccttgagcgatcccacattggccgaccccctgatcccaatcacctcctccaaggtgtcatagggaggaccagcgacagccaggagctacacattttctaaattttcatcagctcccagtttctaagctagcagaagcaatgcgaaaactcagttcatccaggtgttctctaatctcttacctcgtgtccaggcctcagaagagcaaacagagcacaggcaatggcgtgcgtcccggagaagaactggaaccgattaacaaagagctcatcactagtacaagaagctcagtttttcacgaacgcgcaaaaggattgcgcgtcaatatattacggtgtaggtacaagaagctcagtggagctcagcaatggaagcagtggagagagtggagtggaatgtatggagaaatggggggagtcagagagaaatggtagcgcgtgtggacatggaacctgggggcggacaatggcggcctcggcgccgacgatctgggcgaagacggagtcgagcacctccctgccgcccccgtcgtcgtggccgtaccccgtcgagccaccgaaatgctgaaattcgcggatgccgcgtgcgcgtcataccctgaacctgacagcgagccgcatacggcggaggaggagagaagacgagggaggtttacgtgcggcgcgacgtgggcggcgtggaaggcggcggagacgcgggcggagttgagggcgagcgcgcggtccacctcccggaactccgcctgcagcgactccaccgcgcgggacacgtccgggtggaacgccgacgcgcgcgccgcacgcctgccgccccgcgaggcgggcgcggagcggggccacgcgacgagcggggagacggcggcggcggcgcccgtcatccctttcgctccgcttgggcagacgttatcctcgtccccgcgaaatgtttcgcctcccttaagcccagcctaatgcggccatgtgaagcgagaaatgggccgtggccgtctgatgaggcccattacgagagaatctgcttcggcccaggcccagcaacctagtagctctttcaaaaaggcgaaaccacccccaacggcgattggttgatggtgcgaagcaaagcatgcggggtaacacgccacacaatgcttgcactcaacgaaggctagctaagctaagcttaaatcattgcctcccactgctccgcttgctgcatgctgctctatatcacttgctgtgtcccggtgttttctctcatcaggatcaagctcgtctcgttgatcaatggcatcagacaagtgctcatcgtttctactagcagcggcagcggctgcagtgctcgtcctcgcgtcggcgccggtggctcattcgtggagcaaggagggtcacatgctcacatgccgaatcgcgcaggtgaatgatcactatcaatcgaaccattcctgaacatttaggctgaatgactgatgattatgatgccgtgttggatgcaggatctgctggagccagccgcggcgcacgcggtgaggaacctgctgacggaggaggcggacggcgacctgtcggcgctgtgcgtgtggccggatcaggtcaggcactggtacaagtacaggtggacgagccctctccacttcatcgacacccctgacaaagcctgcagcttcgtctactcaagtacgcttaggcaactcttctcctccatcagtttctgaattatgctatactctgaatctgctgtgataatggtgtatatgttgatctgtctgtcgcgtttgggttttcaggggattgccatggcgcggatggtgcggaggatatgtgcgtcgctggcgcgatcgcgaacttcacctctcagcttatgcactataatcacggcagcgccgatcgcaaatgtgagaactacgcagttgtagtatatcatatcaaccaatatagtttagttgtcatgtatctcttgtctgactgttcattttctttcatattgttgtaactgcttgtaacgcagataacatgactgaagcactgctattcttgtcacacttcatgggagatgttcatcaggtaaccttaccaattagtctactctcatgcactccctgcaacagttcatacacatcaacatactaactattttatctgtccatccagccaatgcatgttgggttcacgagcgaccaagggggcaatacgattaatctacgctggttcaggcacaaatccaatctccatcatgtaatcaacttccttgatccttgcacataattccttccatgtgaaaaacctgccgttaagctcaatttacttacttttcaagtctgtctggtgttttttcaggtgtgggatagggagatgatactcacagctattgctgaattctacggcaaggacatggatgcgtttcaaaaggaccttgtgcacaacttcaccacggtaagagaactgcctgaaaacaactcttccaagcaaagaaacatgagaaaaattcctgcaaaattattttgaacgaacgaatttctgcaatttttcatctccagggaacgtggtctgatgacgtatcctcttggggagactgcgaggatctcctgtcttgctcaaccaagtcagtacaatccaaaattctgaaaccacaattctgtattgtttaacaaagaaagaatcgccttggttttttgcattcgaatcatatttttctatcatacaacaggtacgctacagagagcataaatttggcttgcaaatgggcgtacaacgatgtccgtgaaggcgaaactctgtcaggtaatgctgcctttgctagaacaagcacacatctctgaagtctgaacctagctgatgtcatgggattgtcaatttgttatttccagatgactacttcggctcacggctcccgatcgtgacacgacgaatcgcgcaggggggagttaggctggccatgttcttgaatcggctcttcggggagcacaaccgtgacgtcgcatcaccagcctgaactgatagctgcttcagaattcagaaaattcagaagttaaccacacgtgtaatctaacggccgcatccatttcattttatttttacgtgatacgtgactctatttttacgatgaatagttgatgccaacaatgctgattaattaaccacatagtaatacaagtaagcaacgcttgaaatcaacaggacatagcaaaccaattccattcttttctgatcataaagagatgtacatccacatgtatgattaattgtatctagacaagattcaatgactatactactctcattgcaccaagctgtttctgctttatagcctactagaattttttttaaaaaaaaattgctagtatgccccaaagttgggttgcatactcagttttgctacaaacgtgagtggctttgcagatttcatttgccacagagttctggccgatattctctctttatcgtgattttctgcttgatgccgcgatggtgaattatcccatgggctgcatgcatgggccaaattactcgcgttacagattcttttggaaataataatgatagaggtacgttgcaatttttttaacgcagtcatgacaaatttagacattctttatttctaattttactgaattttgttgtttttgtaaaggaacaatataaataagcccgaaatgctcttgagtcttgacaccataattttggccaggattttttgttatctctagtgaaatgactatccatgatcatcatcagatgaataattaaacagaagacatgtgcatgcaacacacgcgttttccagcgcataaatctgactgttccctatcgagatagtagttcgacactgaccaaaacggggagtttgtttcactaatcacggcgcggttttagaggccccacaccacgcacgcagcagctaggtgctaatctaacgtagtttttttttttttgacgcaaatctaacgtagttttttagcgaagcgaactgctggattccacggtgttcgtctcgccaccttccatttctgtttgatgatttaatcctctgcccagttcttcactgacgaacgaacaagctcgccgccattgccaaaccaccttcttcttcttcttcttcgcctcctcatcatccacgatcaggtccatttgggagatcaatgcgaaattgtgcagttgctgcgtcgttctggggcggaattgattgtgttcttcagtctatctaatccctattaatcgatcgttgagggtttgagatcggatttggcgatggcgattacgaaggttctcggatcgaaacctgccgactgcttccaatttcaagatcctaattcctggtacttcttcacctgtcgctcgtcctatcccctatcgtatctatccccaatcatctccttgttcatgtttgagacgctttgcgtgtgttcatctcctaaacgattcgttaacttctatatatatgtatatatatatttgccttcgttagggttcaatgtgatcctaacatatgacttgttgattgtgtccctgtagcgcacagactgcatggattttcttccatgaaaattcttcatttcaggttttttttttccaaaaaaaatatcgctatctttgatcaggttaagatgacagtaactcgatcataatacacctgtaagatgaacttaactttcagttttgaccgaatgtagcacataacagagaaaataaactgagatgtaaactttgacacattaacagaatagatgagcatatttgagatgaacagtgcagaatcttttgggtctctttcctgcactctgctagtggaattgcatgttatcctggttttttttttgacaaaatcaaaatttctcaatcttgcaggacttgcatgactgagcttgtaagcgatgtggtcgttgaggttggagatttctccttccatctccacaaggtacatctgctacactgatctctctttcaatctcctatctttttctagtgcaaattcactattgagtcttgaagtacaaatgcgcaataaattgaactcattacacatgcgtcaacaatttggtttcttgatgaaaagatatcatctgtcatcctgttttcttgttccatgtcctgtttgaggtagctgaaatcgatatattgatggattatctgatttttgtgacagctatttgagggtttaaatgaatgaattaactactacaaagattaaaaagaaatgttcaagaacagggacagaagccttaaattctgcataatctgaacattttaagatttttctctactgacgtgtgtcaaattgctcttccatttccagttcccattgatgagccgaagtggcacgctgcaaaagctgataagcgaagcagccgccggcgccgacgacggcgagccgtgcagcgtcaagctccacgacgtccccggcggcgccgcggcgttcgagctggcggccaggttctgctacgacgtcagggcggagctcgacgccgggaacgtggtcgcgctgcggtgcgcggcggagcacctcggcatgaccgaggaccacggcggcgagggcaacctcgtcgagcaggcggaggcgttcctccgcgacgtgctcggcagctgggacgacgccttgcgcgcgctgcggtcgtgcgacggcgcgctcctcccgctcgccgaggagctcctcgtcgtgccgcgctgcatcgacgcgctggcgagcaaggcctgcgccgacccgaccctcttcggctggccgatggtggagtactacacggcgaggggcctcgaggagacggtgatgtggaacggcatcgccaccgccggcaagccgaggtcgccgggcccggactggtggtacaagcaggcgtcgtcgctgaagctgccggtgtacaagaggctcatcacggcgatgaggtccaagggcatgagccccgaggacatcgccggctcgctgacgcactacgccaagcgccacctctccggtctgacccgccactccggttacgtcggcggcggcggcgcgtcggggaccgtgctctcggacgtggagcagagggcgctcctggaggagatcgtcgcgctgctccccgtcgagaggggcgtcgccacgacgaggttcctgctcgggctcctccgcaccgccacgatcctgaacgccggcgcggcgtgccgcgacgcgctggagaggatggccgggaaccagctcgaggaggcggcgctggaggacctcctgatccccaacaccggctacgccgtcgagacgctctacgacgtcgactgcgtgcagcggatgctggagcagttcgtcgccgcgaacacgtcggcgttcgccgcctcgccggagatcacggacgaagcccagctggtcgacggcccctccggtgagctcatgccgatcagcacggtggccaagcttgtcgacggctacctcgcggaggtcgcgacggacaccaacgtcaagctctccaagttccagagcatcgccgagctcgtcccggactacgcaagggccatcgacgacggcatctaccgcgccattgacatctacctcaaggtaagcaaacgctcggagagacagagtcttgaactggacatttttctatggaaaaaatattaaaaaaattagtcaaattaattgagataacataagtctataaaaaaacatgtgagaataaggccatatttagatctcatggtaaaaaattaatttgttcctgtaacgacccgcctctcccaggtcgggcccacttacatctggcagctttcatagcctctcccaggccgggccagataggtgccctcacagaccaacacatctgcacactttgtgctcattcgtcgttctttggaaattggcttccggaaaagaagttgcaacttattgatatgagtattctattaatcttattaagccctaggccgggatgttacagttccccctatcacatcgaatgtttgaacacatatatggagtattaaatataaatgaaaaaaataactaattatacagatgacgtgtaaattgcgagacgaatcttttaagcctaattgctccatgatctgacaatgtggtgctacagtaaacatttgctaatgacggattaattaggcttaataaattcgtctcgcagtttacagacggattctgtaatttgttttgttattagtctacgttaaatacttcaaatgtgtgttcgtatattcgatgtgacacgccgaaactttacaccactgatctaaacacagcctaaatttgatgtacaattagaaaaaaaaattctaacaattaataatacatgtacaacagatataatttgttttttttcctcttgtatagattgaatttaaacttccatgtttgtgtagtgtcccatattaaccctaatctatattatcaaattttatgaatattttttatataactttcatgtctcgaactgcattagagcagcaacgtggtgatgctctggctgtggacgcaggcgcactcgtggctgacggcgtcggagagggagcagctgtgcaggctgatgaactgccagaagctgtcgctggaggcgtgcacgcacgcggcgcagaacgagcggctgccgctgcgggtggtggtgcaggtgctcttcttcgagcagctccggctgcgcaccacggtggccgggtggttcttcgtcgccgacaacgtcgaccagggctcccccatcgccgccggccggtacgcgccggagaggagcggcgagctggacttcggggcggggccgccggaggaggaggatggcgacgacgacgacgacgaggcccggaacaacgtgcggtcgtcgtcgtcggcgacgatgagcgtggacgacatcaggcagcgggtggtggagctcgaggaggagtgctcgagcatgagggaggagatccaccggatcgggaagcccaagggcgcgctgagtaggctgttccggaagctcgggct

SEQ ID NO: 63709 - DNA, 552 bp, Oryza sativa
ttcctgtgcgccgacatgccaccacgacataccgaaaagaggccgtgacaggacccttcgcataaccctctctaaccgatcgcaccacaccttagggttcacgcccgtccccagcaggcaacgggcagccccccttttgtgccgcggtgaatccggaagccgatcaaccggacaccccggccgacccaactccatcacgcccaccctcgcctgggtacgtcggctagagaaaagctacactacaagcccagccgttgcccaggctggcttgtggtaagtacgataagttcttccagggcatcccgcgaaccggtccttaatcgccatgtgcacgactagcaaaaccatgcacccacagcccaccatgtagtgtattttaattaaccaacaccattgcggtggcactaatccaaagctattgccaataatcaaagtctatgctttaatgtgatccccttttgtgcactagttgaactaagcatggctaagcatctcctaaaccaacatctagtcattttaatacccaagttatcaatggcgtaagggaaacaa

SEQ ID NO: 63710 - DNA, 713 bp, Oryza sativa
attcctgcagcccaacaaacatgacatgtgcagcagaaaatgatcttagtgaaagtgctaaacatgaacatgctaataattaaaaggacatcattaaaaaatagttttaacctatagataagaaggtaacatacccgagaacgctccggtaaaacataagacattgttggtgttgttgcctccgttgatgttgttctcgcctcctccaatgctgttgcctctaccagcaccgttgacgccagcgcctccatagttgcttccactggtagacatgattagtgaagtagatgaaacagagtagaatcaatgtagaggaagaagacaacattgtgcagaactgatgcagcagagcaatcacactagaaagcgctcccgaaaaacttgatcgcagcctaccagtgcaggtactcaagcgaatggagtttcggaggcctgctcgtcctcgccgcctagcagtgcaggtactcaagcgaatggagttctgaggcctgctcgtcccaaacactgcaaccgaggatgcaaaaatgtagcaaagtaacaaaaacaggatgtgccgaggagaaccagtgtgggggagaggagagcagagaggtgttttcccgtaaccgctcaacaggtgctctccaatagtagcctatttaagttgagatccttccacatggatatttaaggtggtattaatccattagcattagttgtaggtctatcgaatt

SEQ ID NO: 63711 - DNA, 519 bp, Oryza sativa
attgattgctcaaaaaatatatattataagacaagtagtttcatttgtaaaccatcgctccagagtatagaatccttatacgcaaaagaagttattaatcatccttcaacccacaaaagtcatgcagttgccaaaatggaaagttaaaaaatagaagatgttgcagtcgaccaatcaaaataaatatgatggtaaggatgggcatatagcaagtagacataagttttccccacaaaaataataataatagagaagatcactgaagttcaaacctttggtccatctgtatctgtgtgtacatgatgggaaggacctgctgttgctaggctcgattgtaccggagaaactgaagtggttgtcttgtcagtttgttcaggaagaacttctcctgttgccttatcatcaacacttggatttatgtcaataacaggaatatcttgggacagtggtttagcagcagctccatgttcatctggaatttgcggtgtcccctgggcaagggtttctttttccttttct

SEQ ID NO: 63712 - DNA, 849 bp, Oryza sativa
tgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtagatggccggcagcgtcacccgtcgtggtttggacatgactggcttcgtcctggagctgcggggcatgtgcgtggtcttggggtatccacatggagtggattaccaggccaggccgctcccggagcaggagggtgaggatgcagagcctcacgctgggtgggaggtcactgcagtgatcctctctggctctcccgagcggacttcgctggcagtcaccgcgggtggggattcttctcccgccgcttgccagaacgccgctctcctcgccatcggcaccctccaccagcgctacccggacgagttgcagcactcgccctatcgctaccaccctcgtcgcggaggagcccgcgacttcgccaccttccgagatgctagcttggaggatgacgctaccgtcgtgcatctggcacgcatggtggaggcatacgacgcggctcgtatcgacttccatcagatggtgcgtcgcgggatggttgagaacaacctgaagatcgtggagcggcgtcaggagaa

SEQ ID NO: 63713 - DNA, 772 bp, Oryza sativa
tcaacctcgtcgccgtcgccgtccgttgcttctccgccgcttctttggtcaccggtgagttcgccgcgtcgtcctctatccgttggtgccttccgttcgtgccgaagcgccgccgttcgccggcgagcgtgcgctgtccgagccgtccgagccgccgaaccgccgccgccggaggtgacgtcaccgccgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatccttcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaatgaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaa

SEQ ID NO: 63714 - DNA, 2502 bp, Oryza sativa
attcctgcagccccatgtgataatttttaaatttaaatatagttcatatcaaatgtaatcataatattttcactatacacatctaatttagataagtttattagagacggatggatgttgcttgtatgtataaagattcaaattagaaaacagtgcatagtatgtatgtacccggaggatttttttgtacaatccggtggatagtagtacatatttattgtacaagtgaaaatattttttattttttttgggtgaacagcacatacgtacgtttctctcgtagcaattacgtgggactgtcaactgtagcagtgctaatccttctttcttaatcgtaattacgtttttttttcttttttgcggtgagtagcaaagtacggtaggacatatatatgcgtactattcacgggattttttctaccggcgaggttagacgggatgtattttaaataattctaatctaatggtttgaaaatagtaggttcaccgaattaaaatcgaggattggatatttttcttttttctcaaaatttatatgtttttctctaataaatattacagacagcttggtagtgcttctagaagtgatctaatatatatttttttctttattatagataagataaatatgcagtgttttaaatagtcatttaaggattgatcgttgttattccagatagtatgtatgcctgtgtatgtacaattctctttgttgtttttgtcaaataacgaatagtgtactttttttttttgcttttttgggatacttacagatgtttatttcccgggccctttttctgttgggtcaagcatacgtatatacgtgggctgataagctgaggggtggggatagcagggagaaggagatggaaagatttatagagataaatataataataattaaaaatagtgggtccaccgatttatttggtgccacatggcattttaggagtgtttgtaggagtaccacgtaggagcgtttgtaggaagtttaatggacttttagtatataatagatagatagataacatgctacatgcttaaattttttttaaaagtaatacaattttaatggaaaattataaaaatataggtctgacctatactaataagctattatctcagcccatcatggtgaaaaaagtcttggcctataggcttttcaaccccaagcccagacattagcactactgcgtcgcagattctgctttgactatggtggatgaaagaggggcagctggagcgaagcagccgtgggatagaataaggtgggaagggagatgggccgtgggcgagtaacgcagggtgaaatgggccacacgagacttatcactttgcttgtctccggcgttggtcaacaagtatctccggacgattttgctaaacatctcccgcgtgatttttttcctggcatttgacgtttttttttggccacatgatctttgcgccaagatttgtgcagcaattgccgtggatgaagtcgacagggagtcaaggtgtgttagtcttggtgtgtgaataaaatatgtgaagtatgtaattttcatatgtcaaattaagaaatatctctatgttaatttacatgtcaaattaagtactaatcgatacaacaaatttaacatatcttaaaaatctaaataaaaattgatttttttaaccattgaaaaattaagacatttgaaactaaaataaaaaataaaaaaataaaattacggggctatctatacatcttgtgacagaaaatcccaccctatatcattcgaattttggaccattagatatacttcaagattcgtgcagacccttttaacctaactcctctcctcctccccaccgatttagatcgcacgccaccaccaccccgttctcacgcgatccccgccgcaaccgccccaccgcgccgccgcccgcctcgccggctagccggaaggggtcaacggcgctggcgaggcccccccggtgagccccctccccttcccccttccctccccttccctcctctcctcgaggtggcgacggcgaggtgcccccgccccgccgtcttccccgtctccggcggctccccgccgctggattcgccaccaccggccgccgcctcgccgcccgccggagtccaccgcccaccgtcggtcctccgtcgcccacggccatccctctaaaccccgaggaaatcccctcttctttctcttccaacccccctcctaccctcaccccaaccctaaaccataacctgccggagttagggtgtcgtcggcgctggagaagaaggagagcccgccggagatggagcagagaagccaacgcacaaatctgggcatggatctagtggtccaaaatctgtaagatttcttccccaaatttcattcgaatgacatataacaattccgtaaaaataaatgtgtaagtaaatatgtacttattattttctttaaaatataaaattacagtcctatataactaaaattacatttgtaaattaaatttagttaatttgatatgtaa

SEQ ID NO: 63715 - DNA, 1810 bp, Oryza sativa
cggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtatgaggggtattgtcataactcctttccgaggtaccgtggtggtattgaggcacatggtgacatgatgtggggttgtgtcttgtgggtacagtggtacagctctgatcagagtaaaactattcgaatagccgtgcccgcggttatgggcgggtcgaacaatgtctttcgtgattagtttcacacttctcaccttagtaagagatgcttaaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcctttgcaaatgaaaccctattatgccctcctttgttatcctgtgcacttgcatatttgctgcgtggcttgctgagtatgtcatatactctccttgcaatcattcatcagaagaagagttcttcattgaggctgatggagtggaggattaggtgtagccttggtcaagctgcctgtggagtggagccgtctgcgccgtttattttattttctgctgcttagatctttattgattgagaggaactatctacctccgtaatgacattttatacgcttaataattagagtaataactgtactctattatcaatttgttattgtgtgcctcggctgattcctggacgagggttcacacacatgtaagcgtttggaattttggatagaaattccaggcgtgacaagttggtatcagagcccctttgaccctaggttatgccaaatggttacccatagaagccttctaaaaatattggaaaagtagaactgttctcctctctttctcttttaattaaaccaaactaatggcacatgcacttcataatctcttttaatggttctcattcaaaatttattccagtgttattagtactgtacatctattactgtactaatggctcattttccagcaaaagttttacaatgatgtttcatttaatcttactgcaataaaataaatttagcaagttgattttataactttcttttatttcttttgaaacttgttattcaaaagtacaaaacttgtgacctcattttcaactatttcaactcatcttgcaagtttggtttactttatttacttaccttttgctttgattttcaaactttattcaaaattaatccaaaaacttgtgctattaattggataaatgttttaactccctcctttcacttgtctttagatgccgcgctacaagcctgagtacttgtttggtgttgagggttttgtccaggagttgcgtactatgtcctttgtcattggatttgggactgcccctttttatgcctagattcgtcatgatcgtcatgaagagaagtgccgagtcaaagttaccttgaacagtaacagtgaagatatcccatcagtgatgttcgaagctggaggaaggaactacatccatgcatgtcaggaagtggcaaggatcgccataggagagctccgtgatcgctacagtgatcagttggccgacactgagtatcgttaccatcctcgtcaaccgcagggaagtgaccgtggcagttaccttgagactgaaggaatt

SEQ ID NO: 63716 - DNA, 2486 bp, Oryza sativa
cggcctcgagctgatcggacggcgcggtgagcagccgccaagctcggctcggcttcaaagccggccagccggccatggctagtggcgatggcgcgcacagccaccggcggtgaccggcggcatgcgaggcgatggcagacggtgcggaaggcggcggcgtcggccgaaggcgacggcgtgcgcgcggagaacaggagagagaaaaggaaggggagagagaggtggtcctcaccgacgagctcgggccggagtgggaaacgaaggtggcggcgtcgactggcggcgcggagggatggacgggcggcggcggcaccttgggagggagttgagaggggttaggaatagagagagagagagaccacggtggtcgccattgtcggctggaggtggaaaggatggatagctcaccggcatgcgaggagttggagctacggcggtgatttgcggaaaccgagcggtggacggggtagctcgtacgacggcgaagctggcagcggcgagcgcacagcgtggcggtgaccattgcaatggcatcgtgcggctggaggcggcggcaagcggcagtgcgtgcggcgagcgacgcgagtacggtaggacgcacgggagggggcgacgagtgtgggaaacgagagagggagctcgggggagggtttttatgggcgcgggaggggcggacacggccggggattggcctatttggccagcgacgacgtgggggaggtggagagagagagtgggatgattcgaattgaatctcgcccttacgggtgcgcgcgagctggcgggaaggcgagggcgtgggcacaggaggagcggaggaggtgggtgcggcagtttcggcggcggcggttgccggcttgggcggaagcgggcggcgggaggaagggggaaggcccgacaggtggggcccagctgtcggcgcccgagagagaggagtccgggaggacttcgggtggaggagggaaggaatgggccggcctggcaaggagggtggtgcgtgagagaggttgggccgacggcccaagaaaggaagaggagggaaaataaaaagaagaaaaggaaaagggattttcctgggattctttattgcggtttgatgtttttaattggttataattatttccaaggcttctgaatagaacccaagaaaaattccacatgccgattctgattattatttgcatttattgattaaggaattcaactctaggttaatttgaaccaatttcttcaggcgatttattcaatgaatttttaaacaaggaaggggaactttagggtcaggtggagccgacggatgggagggccggggcagctggagcggagtggcagccatggggtaggtaggaggaataagttcaccggaggtcccttaactcaacagcgagattttttgaggtcctttaaccgcaaaatcagaaatatatactccaaaactcactcaaaccgttcaaagaaggtccgatgacaatatttttgcccagttttactgacgtggcatcctagtcagcaaaaaataaaaaaaataaatatgtggggttcatatgtaagtgagaaaaatgtgtggtctcggttttttttctacccaagcttgggagtggggcaggtggccggcgggaggggcgggaaacggccggcgggaaagcgagggggaggcggcattaggtgttgccgccaccattcgtgtgccgcgtgctcgacccggtgcggggtcggcgccgggcggagcagggttagacgcggagggcggtggaggcaccgcagctggtggaggagatcgagggccggagctcgtggaggtggagctcgagaagcgtgacggcagctacagcttgagaagctcgagaagtgtcgcggcggccgctgctccgtccctttgccatgtcgcctgcagccgtcccccctttgcggcctactccagccactctactcctcccgctgccatgctcgcccgccgctggtcccccctctgccatgctttctcgccgctgttgtgccttctgccgctctcgctcgccgctggtcccccctctgccaacctactgagttctccaccaaatccctccatcgccgttgctagcagatggacttcatccttctctctcggaatcgattttgagggcgacggtgatgagtcccacctcaccgacaacggcaatggaggggaggagcagaagcgttatgaggctctcgatgcaccatccttctctctcgacatcgacggtgatgaggagcaccactgggaggagcaatggtgaagttacgaggttcctgacgcgccctccttctccctcggtactaactctgatggcggcaacccggagccgccgctcgcccgccaccgcgcgctcgcccactgcttgctgccgacgacgccgttgctccgcacccgcactcactcgctgccgccgccgctccgcctgcctttggctgtgcgccgctgccaccgccgtcacctctaacacctctaccgcaggcctagattt

SEQ ID NO: 63717 - DNA, 1282 bp, Oryza sativa
  unsure (1)..(1282): unsure at all n locations
gccccagcagatcctccgatcatcatcataagtagtgatgaagaagaagaatccaagcgcaaccattccaagattgagtgggtagcaactcaagatgatgaagacgagccgaacgagccttcaatcgaccttcgatgctcggaagaacaagagtagcttgttaagtcgttgtcttagatcgttgtgttagtttgcttcttttaagcttgcttgtgtgtgtgtgggtcttgcatgtgatttacatcagtggtgggatataagtacatgcgtttgtttgctttttgagtgttaggaagttggtgagtttagtggtgtgagagtcttcagtttgtaataatgaaactcagttaagatcaataaaagttaaagtaattctctgtcctaagtagttttcccccggtttctcttcttgtgccctatccatgccagatggtgaacactcgcagcaacaggaatggtcccaatctcaacaaccccaataacaataacaatggagagaatccaacccttgctcaagttcttgctcaacagactcagcttatgaacatgatgatgcagcaacttcagaaccagcagaaccaaggaaataaccatgcaccccctcagaataagttagcagaatttcttcgtgtaaggccgcctgttttctctagtaccactaatcctgttgaagctggcgattggttgcatgccatagagaagaagttggatttgcttcagtgcactgatcaggagaaggtctcatttgcatcacatcagttgcatggccctgcctctgaatggtgggatcacttccgcctgaataggactactgctgaacctatcacttggcttgaattcaccgctgctttccggaagacacatataccatcgggagtggtgtctctcaagaagaaggagttcaggtcgctcactcaaggatctcgctctgttacggagtatttgcacgagttcaatcgtctagctcgttatgctccggaagatgtacgcaatgatgaagagcgtcaagagaagttcttggaaggacttaatgatgagctttcttacccactcatgactggagattatcatgatttccagaagttagtggataaggctattcgtcaggaggacaagtataaccgcatggagcagaagaaacgccggattgctcacttcaaggcacaacaggggagtnnnnnnnnnnnnnnnnnnnntttaggaccccagtccatgccacaaggaggttcttcgtctgttgttcgtccgcagcgttagttcttcaacaacaatgctggcaata

SEQ ID NO: 63718 - DNA, 7862 bp, Oryza sativa
ctagacaagtttgtggtggtctttattgatgacattcttatctactctaagaccaaagaagagcatgaagaacatcttcgccttgcattggaaaagttatgagaacatcaactgtatgctaagtttagcaagtgtgaattttggttgtctgaagtgaagttccttggtcacgtcatctcagcaggaggagttgccgttgatcctagtaatgtggaatccgtaaccaactggaaacaaccaaagacagtttcagagatccgcagtttcctaggcctcgcaggatattatcggaggtttatagagaatttttccaagattgctaagcccatgacacgactgcttcagaaagatgtgaagtacaagtggtcagaagaatgtgagcagagttttcaagagttgaaaagtcgcttgatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaaaaactaccctactcatgatcttgaattggctgcagtagttcatgcgttgaagatttggcgtcattatcttttcggtactcgtacagaggtatatatcgatcacaagagcttaaagtatatctttactcagtcggatctgaacatgagacaaaggagatggttggaattaattaaggattatgacatgggaattcattatcacccgggaaaggctaatgtagtagcagacgctcttagcaggaaaggctattgcaatgctacggaaggacgacagttgccattggaattatgcaaggaatttgaaagattgaatttgggaattgtcagtataggtttcgttgcagccttagaagcgaagcccactctaattgatcaagttagagaagctcaaactaatgatcctgatatccaagaaattaagaagaatatgagaagaggaaaagctattggtttcttggaggatgagcacggaactgtatggttgggtgaaagaatctgtgtccccgacaacaaagatttaaaagatgcaattctgaaagaagctcatgatactttatactccatacaccctggtagtactaagatgtactaggatctcaaggaaaggttttggtgggcaagtatgaagcgtgaaatcgcagaatacgtagcagtatgtgatgtttgtcagcgagtcaaggcagaacatcagaaacccgccggtttgttgcagccttcaaagattcctgaatggaaatgggaagaaatcggtatggattttatcactggtttgcccagaacgtcattaggccaggactctatttgggtgatagtcgatagacttactaaagtggcacacttcattccggtaaagacaacttattccggaagtcgcttagcggaattgtatatggcaaggattgtgtgtttgcatggcgttcctaagaaaatagtgtccgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaacagttatcaagctagtcttcagatggctccgtacgaagcactgtatggtcggaagtgccgcactccgcttttgtgggatcaagcgggagaacgtcaggttttcgggacggatatcctaagggaagcagaagaaaaggtgaaaatcattcaagaaagattgcgagtggcccagtctcgtcataagagttatgccgataatcgccgcagagatttgagttttgaagaaggagattatgtgtatcttcgtgtcacgcctcttcgaggagttcatcattttcacaccaacggaaaattggcaccgcgttttgtaggaccttataagattgtcagtcgaagaggagaggttgcttatcagttggagttacctcaatctttggcaggagtccataatgtgttccatgtgtcgcaactgaaaaagtgtttaagggtacctaccgaagaagctaatcatgaacagatagaagttcaagaggatctgacctatgttgagaaaccaatccgtattttggaaatagatgagagaagaaccagaaatcgagttatctgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgtttaaatggaatttttagaatttattttaaaagcctagaagagaagatttaattttaattaataaattccaatataaaatggggccaaataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaagtcctttctctctctcctcggcccagtccggcccagtccgccgccgcgcgcgcgcgtccgcccgctgacaggtggggcccacctatcagggtcgtcgtcaacctccggccgccgccgcccgaaaccctagtttcgcgccgccgctgttcccttccaaatccggccgttcctttccttcttcggccgaatcaaaagaggggaaatgatcctcgagatctcctctaccttttctcctttggaaacatcggctaattcgttttggaagttcgtggaatcgagttcgattcggatcggcctctttccttcgaaccctaaaccttccttctcgtcgccagctgccgtgggccttcgccgtcgcctccgagcccctttaaaaggttccccggtgtctcctctacccgtcgccgccttcgccttcgcctctcgtcgtcggaaacgccctagcgccgtgtgccctagcgtcgccgtcgccgccgtcgctccagccgtgcgcccccgccgttccagtcattgtcgtcgctcgggaagaccgccgtcggggtcgccaagtcgtcgccgtcctcgtccgccgcttcgccaccgccaaagaccaccagagcaccgtcgccgtcgtcaagccgaagagcgccgccgtttcaacctcgtcgccgtcgccgtccgttggtcttccgccgtcgctttggtcgccggtgagatcgccgtgctgtccgctacccgttggtgccctccgttcgtgctgaagcaccgccgttcgccggcgagcgtgcgccgtccgagccgtccgagccgccgccgccggtggtgacgtcatcgccgaggtcatcggggccgttcgctgtgagccggtcgtggaccgttcgatctcggccgtccgttttagatcaagtcgatctcggccgtccgttcgcgtgaaccgccgccgtgcgcccggtccaccgaaaccctagcccgctgacgcaataatccttcttttccttttcaaaaataattcattattgcgtcataattcaattaaaatcttcaaaaattcataagtaattcatcttagctccgatttagttggttcaagtctctaaatttttctaaaattgagatctacatgctaaaaatatccacatgtactgttcatgtttgtttatgtgctgttttggtgattttgcttctttctgtttagattccgtcgtttacggagagtccgtttttgcagaagaagaatttgaagagttccaaggccagcaaggcaagccaaacagatcccaaacaaccctttgagcatgttgatcccgtttaaagctactgtttcttttcaactattgcatttatttttgaatgtcattgggtggaattaacctattgtttgttatagcccttttgttcttgattactttattccttgataccttgggttattataatttgactagttgagctttatttatattggttcaactagatattagatataattgcttagccctgcttagaaacattagctcacttttgggataacttatgaatcactattacttaatgatggcttaataatagttcacgatggtcaatcgtgattggttaattaattaatgtgccaactaaaacctgataatggtgggttgtgagcacatggttttgatggtcgtgctcatgacaattaaggaccggttcatgagtttcggttgtgaaacattaaccatgccagccacaagccagcatgggcaacggctttaccttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtccttcgtgattagtctcacacttctcaccatagtaaatgatgctataattggtaataatctgattagctcctggtttggaatggtatattcctggtttggagatagaactgtgcagccgggatggttgttcagaatggttgggcctatgcaaccgggtatgttgtatagcgttggattaacattgtctaatacttaactgttttattaaattctgaaatgtttgctaaatgctgcttctgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagcacgcctcctctcgaagccgcagctcctccgcgcgacgagccaccaaagcctctgcggctattgacagaaaacacgaggcctgggagatctgcttaactccagtgcaggtccaaaactcgccttcggatgtgtgagcgtgccagttgatttgatcctgcaatcaacaagaaacaaagacaaagaaaccgaaattaaatccataaatgatagccgatcggctaaatgccgatgacgtatcatttatctttgagccgatgtcatatgtaaatcgatcggcaagtgttaagtaaacaaatcagaactaaatctactcgatcggctgtagacatcaataatatataatccttatatcgatatatacttgaatcaagtgattgggatagatcggtcaccttgccgagacagtataaatcacttaaatcgaaatatatattattaatgagattatatatatatatatatattcatagcatagccgatgaaatagatctagcatgtatcggctaataccccgataccacttcgtattaagatattaaagcaagtagaatataccaaacagaagcctaatatacttaaatgcaacaagatcttaacataaagggcagatctaacatgtcaaacgatcatataggataaaagcagttagatcaggtaagatcggctgaaactccgatactaccctaatcggcaaccagtaggcaggctagatattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcaagaacacaaaccgccataacaagttttacctcttgttgaagatcgaaaccgatgcagctcaacccgaaagcaagaactcgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgattcttactctgtttccgcaacaacccttatcttcgattccgcttcgatccattttcatctcccatgctgatattaccaaatttggtcgttaacacatgccccccaagtccgggatatttgataatgttccggatttgccgtgtatcgactccaagcaagtttcgcactctaccgttttcccaaccgttactctagtgctttaaatactaaccgttatccccgagaaatctcacaccgtgacttccgttttcaccgcttaagcgaaactttaccctctctctctccggcgattcctccaatgcgcaaggcaattcccaggcgactccatccccagccagatctccgcctgcgacgatgtcaacctccgcgagcccatctgccgcaccatcggccaaatacgctgaggtaagtccccatcggctagatcccccttttcatcattagatcggttttctctcgcctcatactgctttctttttctcggttactttgaacttgtagcatctctccaatttagtcgcagttccaagcttgtcacatgaaaaccactactttctcggcccagtcggcaaccctgaccccactgagttcatcatcggtgaaaccaataggattcctttcagactatccaatccagatctaggtcattggaagaacacctttaaatcttggccgtctctagaaaaaacttcacccgagaaaagttggattacatggttcaagcgtatgtcagctagcaaacgagttcactggaacgaaatcggaatcggccaagcacttgacctaaccatagcaaactcagccaaagaagaacctctaatggcagctgcttcttacttttggtccaacactatcaatgccttcttattcaaccaagggccgatgaccctaactctcatagtcatcattatgatcacgggtctagatgtcacttcatcggctaaccccatgagtctgaacacaaaaaaccaatatgacttcaagaccaagagtataggaggttggtcaggttatgtgcaggg

SEQ ID NO: 63719 - DNA, 3460 bp, Oryza sativa
aggtaggataaggtgggaagggagatgggccgtgggctattaacacaggatgaaatgggccgcgcgtgttttatcagttgtgcttgtctccagtgttgggcaacaagtatcaccggaacccggatgcaatcatgcaaaaagtgcgtgacgcgaactgtgccttagctggtcactcttgtcctggagcttcacatgctgcaagagtctgcagaatgcatgcatttggcctgccgacgcgctcgatcggatatttttgccaaccaattcacgcacaccaacaactaattataacaattactcactccgtcctaaaatataaatatttttaacttaatgacaagtcaaatattttaattatcattaagcaaactatcataatatataattaatttttgtttaaaacatcttacttttataaatattggtggtcaaagtagtatctcatagactgtgtcagggtcaaaaatagtaagattttgaaacggagggagtataattaattatcacttgtagcatataactaacagcatgtctccgtggagcatatataactatagttcattaaccttgatcgagacactcttcacgaatagtattatcaacaactaattatagctactgcatttcaagttagtaatatataactagaagcatgtctcagtggatcaagcaagcagacatagtattccctagctagctaacgggagggcgggcggcacgtaagcacccgaagaagagtgatgaagctgcaactcccgccggtggagaaaccaactttggtcggtggctacaacgcgtatatgtgatctttagtcccggttggtaacatcaactggaactaaagatcatctttagtcccggttgtagagatgtcagatgttgtcagggcccccgggatctttagtcccggttgttgttactaacaggggctaaagatccgatctttagccccagttggttggtaacaccaagggaataaagatccccccgttatatatgccttcttcctcctctagcccgagagcaagcttcaaatttctcaaagaaagaggaggtcatgccaaaatttattgtgaaaattttttagtaattatatacaaatcggatatgtctaaaaggttagtaacttcatcctccaatattttttttcttgttatattacttttggagctatgtttcacacatttttttttctacaaaactttgttgtaagttgatgagagagaaaatttatgtggggaagaagaatatatagaaattttattctcatagtttaaaatatgatgaaaattaatcttaaaaaatagaaaacaaactaaattgaaaattaagagaagtacaacattaatattagtttagaacttcaaaaattgttaataagaattgctcgtcgaaagagttttaaattattttatcattactgtttgactgtcattattgtatcaaaatttatttatgtatgatttttttttcatttcatgtagatggatcggcaatggatgtatgctgaccggcggtccaaagagtttatcgagggcgtgcattattttttgagagtggccgaagctaacaagcgtaacggttttatttgttgtccatgcaataagtgtaagaactagaaggagtattctgcatccaggactattcatttttatttgttgtccatcaataagtgtaagaaccagaaggagtattctgcatcctggactattcattttcacctgtttgagtcagggttcatgccaagctataattgttggacatcccacggtgagcaaggggttgaaatagaagaagatgaagtggaggacgagaacattcccgactgggctcagtacgctggatttgaaggaaatcaaacgggcgaggtggacagggatgctggcgataacaatgctgcggatgatctttgtaacaccccagaaactacaaagacatcgggatgctactaaatagacatacatttaacaaagaaggagaaatttcgacagcaactcctctaaaacataagcattgcggaagcgtcaaatataagtatagcattgcaagtagccatctacaaaaaaaaaggagaaaggaacattcagggatgaaataaactaatttcaactctcagattcatctagtgcaacttaacaagggtacaattcctttattataaaaatcatgacaactttaaaaattagggtggcagtgtggaatgcagctgtgcttctactcccgttttccccaagcgagcatgtcactttaagcacctgaaaacactgtaggggtgtgagaataaatctcagcaagagaattattttatcaagttatttaacctaccaaatcattaaattatatttataagaaaacaaaggaacataacattaaatataaaggcaaacatctagtgttcataggttcaagagtaaggaggataaaccagatctgcaaagacctcaggagaaagaagccctctcatgaactcaatagagtatataacttccataccccaaaatgctaaagtgcaatgcaatgcaaatgcaataatattcctgccttcacacccaacaaggtgtgaagctgcatcgtgttacgacaatacacgatgctgtaccggtacggtcgcgaccataggttcacgacataacttcgaatgaaatgcaatgcaatacaataatagaggaaagatacacagccataaatccttccaatgatatcacatataataattactctcactaaaagcataccacattaaccatagttaccgatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaacttgggtataagccaaacgtcttctccttctggatcctttttcttcaactgaggttgattgattattgcaaggtgagcatatgacatactcagcaagccacacagtaaatatgcaagtgcacaaggataccaaaggatggcataatattggctcatttgcaaaagcagcatttagcaaaacatttaagagaagtaaaacagtggagtaattaatcagaaattttaatcaacactgaacagcatacccatgctgtacaggcccaaccatcctgaacaaccatacccggctgtacagatctaactccaaaccaggagctaagcaaattattaccagttataacatcaatacttattgtgagaggtgtgggactaatcacgaaaaacattgctcaactcgcccataaccgcgggcacggctattcgaatagttttactctggccagaggtgtaccactgtacccacaagacacagcctcaa

SEQ ID NO: 63720 - DNA, 915 bp, Oryza sativa
gcagtaacaagtatatggttagcatgtgacgctttaacccatatatttttgtttcgattcctggtctactacaattttactacgacgttactgctaaaagtgcagtaacgtcctatgtattctacagtaacgtcacgtgttactgtacttttacaacaatgttactactggagcatagtaacatattatgagtttcggtagtgaaagatattagaattgataatcatattactttctcacaaaattcttgaaacaaatggcatcattagatgaattgattacaagaatgtgttttgaactatgaggtcatgggttcaagtcttgaatttggcaatttattttttatttttctagaaaagagaaaaaatgtttcggggagaaaaaaacagaataaagaaagagagagagatcgggaggagggagggggagtgacgggagagtggtcgggaggagggaaagagagagagatcgggagggggaggggaagcgagagagaagggggaacaggaggaagggggggaggggaagcgagagaaagaagggggaacatgaggaagggggtatagaatacgggtgtagaatagtcttaccctatatatatgtatatgtatatatatgtatatgtatatgtatatgtatatgtatatatacatatacatatacatgtatatgtacatatatacatatacgtacatgtatatacatatacatgtacatgtatatgtatatgtatatatatatatatgtatatgcatatatgcatatacatatatatgtatatgcatatatatgtatatgtatatatacatatatgtatataggacactcatatggggcaccatggtgcccgggcaccatggtatcaaatacaaaaaatcactcaaatttttcaaaattttcaaattgtgagtatat

SEQ ID NO: 63721 - DNA, 12739 bp, Oryza sativa
gctagaccgctggctcatggatttattttcgtgtttcaccatgttcataacccgcgataatgaatatgttgattagtcatgcatttacttttgataatcatatatctttcggttttaaattgacagattattttattattataacttaccaattgaaagcaacatataatacttgtagatccttttcgagatggtttgagtggcggctttttttatatggcgtaaaaagtatggtgtagaatatagaccttttaaccaaaagtccaaaatgcacgcactagccaagttattgcacttatatgctcatttctcaagtttttgcgctagatcgcacccacctacctttatgtaccgtagacgtaatttactcgaaaggaaaaaataaaatggtggcactatttagcagaactgttaactaggagtaataaaataaaacattaatcttacccttgcaaccttggtccttgtcgtaggggttaccctcgtaaccttgcttgcacttgcagtagtatccgggaccgttggtggagttgacgcactcgctgctgtcgctcacacatgcgtacccagccggtttcttctcctgcacatccagtggagggcaggtaatggagtcgcggatggccctctttcggagaccaaaaatcccagcaacttacccgcacgaacgccaaaaacacacttatctggattcgtcttcatgcctaccgagcacaggttgtcgaatgtatcttgaaggccagacgcatggtcgaatgccttgcggctttttacgatgatgtcgtcgacatatgcttcaacattccgccccaactgtgaacaaaggactttgcagatgagcctagagaaagtagccccagcatttctcagtccaaaaggcatcctaatgtggcagaaggtgctgaatagtgtgatgaaagttgtcttcagtatgtctctgggttcgtaaagatttgatgatacccggagtaggcatccaaaaaactcataagtacacagcccacggtcgaatcaaccaattgatcaatccttgggagtgggaagtcatctttcgaacaagccttgttcagatccgtgaaatcaacacacatccgccacttgccattggacttcttgactaacactgggttcgccaaccactccgggtggttgatctcccgaatcacaccagccttgagcagcttttagacttctgtcttcactgcctgttggcggtctatcgacattttgcgtagcttctacttctttggcttgcatatagctttactactagatggtgtatgatgaggtcgggccaaacgcccacaacctcgtttgatccccagacgaagatgttgatgtttttcttgagcacggccaagatgttattcgtttcttcttcacttatatcgccgcctagggaaaccacctttgttggttcagcctcgtcaacttggaccttgatcaccttgccatgtggggacggcttcggcacgattcttgctcgctcaccatcttcagcttgtacattgtctacttctctacttatcactgttgtttcgctccctagcacggccaaagactgcagccccttgactacgattaccccggccggaccaggcatcttcagcttgaggtagttgtggtgcgcgatagcttcaaacttgttcaacgtggcggtgccgaagatggcgttgtagttgtacgaaatatcaatgacaccgaagagaatcatctgctcgtgtctgttgggacccgcgccgaacgccggagctaagtgaacttggcctaggacttgcaccgcttcgcccccaaagccgtgaagcaaagtgagcgcctgagagagagccaaggtcaggaaccccatcctagtgtatgcttcggcgaagatgacatatgccgaactgccgccatccacaaggattcgacgtactttaaatctagctatctctgccgaaatgatcagcgggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacgttcggctctggtctttttacacgtcatgggagcttggctgggtcttgggggcagcaccttcttcgtcggctgcacttggcgattcgccagcggcatggcttcagctgcttgcatcaccgcttgcgcagctgcagcggaagcggcggccttgtcatagtcggcttgtatctccagccttcgctttgtgtcctcttcgccacgtgcatggccgtcgatgatgcgaaacaagcgctcgatggtctggggctctttccttgctattcttcttgtgaggtcgcttggaaggagccctgccgaagcagcattgatgacggacgcctctgtgatgtcttgcacttggcagcgtgcttgcgagaagtgtcgaatgtactccttgttgtttctccgtcttctagcaaatgccgaagaggtcttgctgcgttttcggctcctcataggtgcctcagaagttaagaacaaagacttcacagagttgctcccatgagtatataatattagatagcaaattgaaataccaagagcgggcgatcccgtcaagcgcaacatgtattaccttcgccttggtattgtcattgccgtgagccacttcgattgccgactcgtagattgacaagaactcacttgggtctgattcacgcgagtatattgcaacgggtgggtacttgaattggggtgggatgggatgattcttgagcacccaacttaacggtggcctcttttcgcccccgcctctcatcgttgcaccttggaaagatgagttcaagctcggttatgggatggcgaatggcgaagtcatcgcctgcacccgtggttgggccatcgctttcggctagggtccggttctgaacagtgctccttgcatgttggctgaaactacctgtgtcaccatgcctaggtcgaactgtggtgcttggatccaggccacgccctgattcgactggttcgcttgctgtgtggagccgaaaccggtgattatcccataaacatcagttgttgatgcttgggtcatggtgttctgttcgaagctcagtgcttgctaccaggctattgtcccttgacttggttgattgattgccgcgccgaattgacttatcggttgccaggtcggagccccctggcttgactgattcgcttggtgcattgcaccgaattgacggctgccagaccggggcaccttgacttgcttccaacggcattcgccgatggggttggtttcgaaattgtgtggggttgattgagctgttgaaggaaagcttggaactgagcttgtaaggtcaaagatgcttctatggcggcgtgctgtgcttcgacatgcttcgccggttgtacttgtgtcactgccggctgaacgggcatcgtgaaggtgtaaggggccggttgcactgtaacggtcggagcggctttggcaacgtacagcggagcttgatagacttgtccgtacatggccgaagccggcggagcatggggttgtgcagcatggccgaaaccttgggtggtgaccatcgctgtcgaagtcgggtggggggccgatggggctggcttgacttgttttgccgcttcataggcttgatgctgcagttgcatttggcgaagcatgtcttgtaacttgttcatgttctgacgcatcgtccccatctcggcttcggcttgcacttcaaggtcgatgccttctagggtcatggtcgccgcttgttgagtcgaagctgttgcttgctttttgatgggtctgttcgtgctgggccagcacaagtatggcccagaagggtgggagcgggagcagacctatccacctaccttgccatggctcatggaggttccgctgtctttgccatggatgccagccccagccagctgccaccaccaccatggatacctgtcgacgccacgagtttagtctactccatgacgtgctcgttgctttgctcctggactcttggtcatggagtccttgccagctggctagagaaccgttccacggtgaaagaactagggcctggcccggcctcggccccggcccactgccaattattttggtgtggcattaattgatcattgccaaacaaaaaatttaagagtcggctgggattttcggccccatcattttatgcttattatccgtaccacatattattaactaaaaaattaatttgtaggtgaaatttttatgtacatgttattagcaatttaaaaataaatatataaactatgatgaaaagggcacaaaatcaactctaaaattaagctttaaaatttagaatttggcttataagcataagcctgagcaaaacgatgggttgcttgtttggtttgttctacttaaagttatatattttgacatacaccaaagccaaataacttggaatgcttttttgggttaattcgatccatgccattgcaaatatgtcatttatgataaatgtgttggagtttaaaacacttaattggttaaatcttagcctagacatgatcaccttctacttatgcggaaattaattgatttactgacctaaaaatgaagccattgttcttctgctttcttcttcttctagagatgcctcacgaaccccttccagtgcctaatcgatcggacgattgacttagggtttagggttagatagagttaggttgttaatttgcctccctccttctctttctttatatagcgacatcggtggggctcagggttttttctcaagctaaattcgaatctattttgtaccgatcacacaaaacagatttctcttctttggtttcttgttaggataggaaaaccagtgggattttattcttcctagctaaccggcattagccaagaaaatcatccaacattctccccttgattttgagactaactgacgagtttactaaataaaatacctccccaagacaatgtgtcacaagcgtcactgagacaacactatggtacgcaaataaactcaagcttaacttagtgggtattgattgaaaattaagttcccctcatccaggatcttaataaggctctaatttacacatgtgctagctagaacatatcttagttaaacttaattttactagcctttagagtatggagccatgagcaaatgctcagcttaataattagaccctgggacatatctttcacaaccatatgtgaaaacacatgttgttactagaatagaaaactgtgtttaattagtgcacaacttatagcatagtataattttgagtggtttatgagcgctatttaccactcttagttcagggaaattttcttaaacatatgactgaatcataacatgctacaaaatccaactgcatcgtcgactatgcaataagagattattttggaccttttccatggttattgctcccctatgtgtggacatagcttaatctaaattagcttaataatctttataaatatccacacatctcacaaaataagtgtgtccaaatatctctaaactttagagaccaaatagacttttagaaatataagcatgttacttaaagttgccttgtaaataatacaaagcattcttaataccagtggtctagtctagatttaattaaatactgtcaagattcccagtattatgccaaatctgtatgcatctagatttgagctaatatcaagcttctgtcagctgaatcataaatgattatctttataatttaatttcaaatgactgaattaactaatccaatgaggagacacccttcttcctcgtgtacggctcagaggctatgctccccacggagctacgacatcagagcacacgagtgcagaagtactccgacgaggagcaggaggagcagcgaagtgacgatgtgaatctactcgaggaacatcgagaaagagttgccgtcagagcaggcagctactagtaggcccttctccaatatcacgagaagcgcatcagagcacgtacactttcgatcggagattatgtcctccgacgggttcaaagccaagcagggcacaacaagctctcacccaagtgggaagaactatacacgatcacttaaagtcttgcggctgggcgcattcaagattgcagacggcgatggtcgcgagttaacaaactcctggaacattgatcaattacgtaaattttatgtataaatcaatagtatacatatttgtaagatatcttacgacttcaataaagttgatttcaggtaaagaacatcgtcaaagtgttccttcccaacgatcccttaccacgacaacacctagagttgaaacctatcctcatgtccctttacgccgccctggcaaggcctctgaggaacctaagtgaacttcggctggggacgcccagagcggagaaggccttgtcagattatgcagggacaaacgaccatgtaagatctggtcatgtaagagttctcaccgggcgtattaaccaagccgtgtgatcagaaattgagttttccaacttcacggctgagggctagggtcagtgctttttcaaccaaggcaggtcaagggtcgaagagccttatcccccgagaacaattctccgacgacaaggctgggggatagggagagtgtatggctcaaatgactaatcaaagtcgcagaacgagaaaacactcatacacaacatacccaaaataagaaaacttagtatattacatgcttccttgagatgtttttctacaggatacaaaagctactaggacggccaacgccaatacatggagcagaaaaccttctcggcaagcgacgccatcaactgcgcaagaccgtcaatctccacggatgtcctccgagaacgagagaacccttcacgaaggaactcgaggtgcaactgcgagcggttatcttggatgcaagccagcacatgtcccccggcgtagcggctcgctcgacgacactcctgcttcagggcctcgtcgatgcgcttgccaatcccttagagctgtgcgtaggcccccttcatccacgagatataaccagcagcggactccatgggatctccgcggggaactcggagctccctgcaaacttccgccatggccgtgcagcaacccttgaggtacgagttgaaccacacctcgcgacctcggagagtttccatggcctggtccttcttcgcctccacgatggtcctttcgagttcggccacctcgagtttggtcttccaatactggattcgacgatctcggtctgccaacacgttcttgaaatttgcccaacacagaaaagattaagtcaagctactcttctctttcgagaacacagctaattaagtcaatccgaacacgaggagcgaaggaaatcaagacacaaacctaaggacgtcatcaccatgttcgtctccacggacgggctttgatcgatttccacctccggcacgtgaggctcaagcgtgagcgccggaatgactactgacgtatcgggctgcccgcactgctggacatcctcgacttcaacatatctacaatgacaaaggtactcgggatcacatgctaaggaaacaagggaaacaactgtttaaataaaagcagttcgaacccacagaaagttttacaacatgtagataaaggagtacagaggaaaataaaaatcctactcttgaaaaagggggaggacgaactcccccaagtcactgacttcctccatcgtgtccttacgcgcgtcatcggcggccccccgatccaaagcctctttaaggtctaagtcgcgatgcgctagcctcataaacgcaaggacatggcacgccccagtgtaaataccgttagacgtctcctcaccaagcctagccgtgtggctggaggggatctcctccatcgccttagccagttccgtgagcgacgatgtcagcaaccactcgtcgggatgcgctgggatcgaagttgtgacaccgaactccccggcgagttggtgcacgccggtgaacgatgtccgcagcgaacctcggatggctgtcagatggccctcgagctccgacatacggtgctcgagtccacgccgctacgtctcgttgccagctaccagctccttcatcttttggaggtcctcgcgggactccgccagatcacatgccagctgatcggcacaatgatttgccgacgacgccgctgcactggcctcctcgatctcgcggcccacgccgcgggcgcccgcttgaaggatgcactccatcttagcctggagctgcccccaggtgagggtgtcggcggacagaggccggacgggcacgaggcgagcgataggactacatggcgccgcctcctggtccttagtactggccatgacttccgtcgaggtcgccacagggggcgcactagaagcagcatcagccccactgtgcgccgctttcaccagtgccatcctgcgaagattttttctccatgaggctaggtgatcaaaactttgagaataaaaaaacctcaaaaacatttacttacttctcgccgaccgtcaccaacctctgctttcgctgaggcggtggagacgcacccaagtcctgagtaagataatatgatgtgaggttaagtcgttctgactacgtactcaaggacgaaagagaagcttaccgctgggctcatcgccttccggcgggtcccgggtacagaggagaacttcctccccctcttcggaacattgctgccacttgtggtgtgtcacgcccaaaacgaccctaaaatatatcctttaaattacgcctagaataattaaaatccgtgtgaaagcctccaaaaaataaaatgtgcaaagtaaaagtcaaacaaggcttagaggatttttgtatatttcctaaaagcctaaaatgcgtaaataaattttagtggaattttcagagcacaaataataattattaagaaataaacaaagttgaaaaagttttataaaaagaaaaaccctaaaagtcccccttcccttccttgggccggcccggcccatctctctcccccctctctctctcctctcccccgcggcccattcggcctccctccccgcgcgcgcgccgctgacgggcgggcccacccgccaccctcgctgacgggtggggcccacccatcatccccgtcctcccgccactcccgccgctccgcccgcgccaagcgacgccgccgccgccaaatccgccgcatcccgccgtccccgcgtgcaataaagtggggggaaatactccccgtgatcccctctccctttccccccatttttccctctctctcttgcgttcaaacgggtggatttgcccccgcaaatctcgccggctgctctctcccccttccaaccctatttaaaccctccccgcacctcctccgtccggttccgcctctcgccgcccttcctcctcgccggattcaagctcgcgacgtcgctctctctctccgccgtcgccgccgagctccggtctgccaccgtcgtcgccccgaaccgcctcccacctcggcgccgcctccttcggcttcgccacatcctcgccgacctcgtccacctctccgtttcggtcgccgaccgccggagcgccgccgtccgcgtcgacccgagccgcgccaccgcctccctccgctccgggcgcctcctccgtcgccctggggtgagccgtggaccatcgcctcctttcccccttccctcccctctctcggccgccgctccgcagcatctatggccgcgccggcgaccatcggggcgcgggcgcgccgcctcccgccgaccgcgccggcgtggccgttctcgggcgcgccgagtggctgccgcgtggggcccggccatcagccgcccgcgccctcgggtgtggctgacgtgtggggcccacggcgccggccggtgcaagcccgggtgcgcccggtccaccgtggaccgtgaggctgccgcgtgggccccactcccgtggacccggtccgcgcgcccctccccctcggctaacgcaataaaccctttttaaattaaattttaaatgaagaaaatcgcaaatatttatttaaagagcatataaacttcaaatgcccataacttggccatttgaactcggaattggaccattcaagtctctaatttttccttaagaagtcaagaacccattttagtgctttgttactgcttgttatatggagtttattagagtaaaagcccttttattttccgttggttgtgtagacgctgcagctttggaagatccgctcttcgtgtaggttgaagccgacgtttgggaaagcgagcaaggcaagtcacatcatccttgaacatattgaatcctagtttataaaattattttgatttaaattattgtattatcgctttatttaaattcccgcgttatcactgttttatctagccatgcctatttacctttgttatgaccttattattgttattgttattattaccttgttcaccctagaataaacaaaacctcaactagtggacactttactcatggtaccactagtatgaatttaggtagatgcttcgctggttagttaggcaacattaggtggttttacaactctagactttgggaatattctcatcacctggacactacggaatggttggattattgtggaattggattcatacccccccctctattcaatatccataaaatggttttaggctgggcttggggtgcctggttttgatagtagcacctcggccatataaggaccggtcttcgggcctctgttgcaaagcactaccgtacttccaaatgtctagtgggtaaggcttagtttgtggctcaatctggttataaacaaaagtacacggatggagatggacgaagtcaggggtcgatggacatttctagggcaaatgaaggctacacgagctgcggcccggtagtcgagatgtcgtggcacagggccggtgtcctgctgctaggggctcagtcctgcctacctgtcccgggtgttccggccgtaggtggggttgggtcggtactcttgtctatggctaggatgggttggaaactatgtcatgtcttccgtccgtataccatggtggtatgtggcacgtgattacatgtgaggaagatgtgtcttgtgggtaaagatatacacctcttatcagagtataatctattcgaatagccgcgccctcggttatgggcaagccgagcaatgtacacatgttagtgttttaattcttaaaacctgcttaacaactaaaacgtggaatggttggcctgggttggcttgggacgagctgggacccagggtcgggttgccacttcggtctgaatcatcgtaggccttgggttaaggcagattcgtgtgggttgacggcccttattaataatctggtatagctctaggatcgtatttataaaatagctttgagcaactaagtgtcttttaatgctgtttactgcaaatcctaacccttatattataacccccttgtactcccttgcatttattctgcacttatgggtgtgtcttgttgagtacggtggttgtactcagtcttgctcaatttttcccaaacccagaagaggagcccctggatgatgaaggctttggtgtttagctcgtgcctgccgtcaagcgcctgtggtcatcgccctagtcttccgctgtttcccgtttgtctttgtgtgtgttgggctttcgccgcccatgtaataaattaattatttacgcttccgcttattaaactctgaattgtatcaacttttggtgtaccttgcctcctgggacaaggaataatgcacgcacgtaaggaacgcccgttgggttatttctggtcgtgacaagttggtatcagagcccccttgaccctaggacgagctttagatcccaagccttagcaatattttcgaaataaaattcctttcttatttgtgaaaatcctctagtctctctctgtcccgctgcttcatttatcgtcaaaatctgatctttaaaatgttgctattctcttttgtttttgtttgtagatggccggcagcatcaaccatcgtggcttggacctgactggcttcgttttggagctgcggggcatgtgcgttgtcctggggtatccgcatggagtggactaccagggcaagcagctctcgaagcaggagggtgacgatgcagagccccacgctgcttgggaggtcactgcagtgatcctcactggctcacccgagaggacttcgttggcagtcaccgcgggtggagattccttctccgccgcttgccagaacgccgcactcctcaccatcggcactcttcaccagcgctacccggatgagttgcagcactcgccctaccgctaccaccctcgtcgcggaggagcccgcgactacgccaccttcagggatgctagctcggaggatgacgctaccatcatgcacctagcgcgcatcgtggaggcgtacgatgtggctcgtatcgacttccatcagatggtgcgccgtgggttggtcgagaacaacatgaagatcctgga

SEQ ID NO: 63722 - DNA, 13035 bp, Oryza sativa
catgtatatgtatatgtatatatatatatatgtatatgcatatatgcatatacatatatatgtatatgcatatatatgtatatgtatatatacatatatgtatatatatatatatatgtatatgcatatatgcatatacatatatatgtatatgcatatatatgtatatgtatatatacatatatgtatatatgcatatacatatatacatatgtatatatatatatatatacatatatgtatataggacactcatatggggcaccatggtgcccgggcaccatggtatcaaatacaaaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaataagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatgtatatatatatatatatatgtcctctctttttgtgcgtcagcacagcacttgtttgtttgttaacatctcctagcaatgttacagctggttgtttgcttaagtttttgtctaaggtgacaaggatttacttgcttttgtttcaataaatctgtgtttggtatccttttgtaatgaatcatgtgggatgtatcaatcttattagaagtttgtgtaaagcatgtgtacaaaatcggcagtgtaagatatttttgaagctgcaattagctggtgttagaatagtagcgggtcggtccaccctagaccaaggaaaccacagcggtccacacggctagtccgcggggatcgatggtccggatcggccagggctgatcggatggccgtgaagcggcgtggccagggcacgggcacagctcaacactggcctcgccgagtgttgtgagtttcaaaagatcttagatggagagataaaaaaaagatcatagatggagagttaaaaaaaaagatcttagatggagatacaatctatatcaaaacggtagagatcaacgagacctataactttgtagatgaaagttttacatttgagattgtttatgtacctaaatatttattcactacttaaaaaaaggcacatacaagtcggcattataggtgccggaatagctaaaatcggtatctatagtacttttctcccttcaaaatatgaaaaaaaaggcacctttaatacactataggtgtcggttcttctaggtgccttttttttaaaaaaaaggtatctttaatatattatatatattatagatgtcggttaattaaaaaccgatacctataatatattatattataggtgccggttttttaataaaaccgacaccctatcaaacgagccgagcgaggtgggcggagaggcggcagtggtgggcggcgccctcccctctactagattcggcgcgaggggaggcagcggcggcggcagcagtagcgggcgacgacgggaggagaggcggcagcggcaggcggtgccctcccctccgccagatccagcgggggaggcagcggcagcgacgggctcccctccgccagatccggcaagaggggaggcagtggcagtgggctcccatgggcgacggcgggaggtggcggtagcagcgtgtggacccccgtttttataacaggaatcaatcgtgtaaacagtaccatttccctggatcaagtagtctggtacatacgaattcatagctgaaataccaaatacacatacacgaatgtgtagtacgaattattacatcataagcctgcaggcatagtcttaaatcatcggaccaagcggtccggaatacatccaaaagcagaaataggtaaggcagcagaatttaagcagcggcatgccattgccacaggcaacgaccgtactaagacctactgggcgccttcgtcttcatctccctcctggtagtaggcatagggatcctccgaagcttcatctcccgcttctaataaattttatatttgcaagggtgagtaccaaccgtactcagcaagccaccacagcaatgatgcacatgatagaggatttcaaaggatggctatggttcatttgcgcaaagcaagttttgtaattcttttcacaagcctaagacctagcaaagactaatcaagttttaataccattgttcataataaacaatgacggttctgtccaccatccattgtgatcccaaggatagcttcccgccattgagtcgttatgattttctaaggacgtccacattcccgcctctcaggaagtggctctatcagcataaaaattatcatgcaatattccatcccactcaagttaaagaatttagagtctagccaagtgtaatacatgtcccggtgctcattaaccgcgagctcggctattcgaatagatttggtttactcacactgcagtggatgtacactttacccgcactccgcgactgcccaacacatgagcctcatcccaacacatgagacgcgtcacggcaaagctttttgataaccttgcattggcagtacccgctccatgaactttacatcctcatgcactctaggcgtcatacgtttctagcagtgagaggagttctggcgctcccgggaagggaaaaacacacactcctacgttgcttcttgtcgttgaacccagtccatcatgattgttctcttatgggtatcctcatgtagtattgccaagccagcctctgaccatccggaacgggcatccgccattcacctggccatccgaaccgggcatctgccagcagactgctgccacatcacacacctaaaagaagaccactacgcatggatactgcctccgctcagctatctactccgctaggtctatacccatacgagaagtgcggttgtacggggggtcgtttcatgcttaacttcatggctcggtccttaattgaccagggacggcactagccttttccggacaccacccaaatcctccagccgccccagtcgaaaacagttgtttaactttattttcctttcacaaatcatgtcatcaatatcatggcaatgtggcgctcatgtctccacataccgcatctcaattaccttcccaaaggtaattgcccaagcatatagcatttgataaatatgagtatgcatgattctagaatagcatttctaagcaattgtcataattgactagagactcatacgtaaacatggttacgaaggaataaggggtaaacaataatcaaggcatggcataattacaagtaggatgttcataattgcatgcaattttatttgtaaacaaaacaacttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagttgattcctttattttaactttactattcgcgaactaaggcaaacccaatttcgattcaaactattttgcgggtataaatgttttgttgtcataagtttttaatttaatctacccgagcattatatccatataataggttagagatttttatcgcgagctaaatatcggacgaaatcctagaaatattatatgatttaatttagtctatgactagatgattaaatataatacacggctaaaatccctaggaattaaatccgaatttctaccgtgaattgattacttatagggattacccaaaaaaataatctataataatccataagaattcatctatttgtttagttattaactacatctaaattattatcgcgaattgattccttatagaaattgccaagaataatccataatttatattaaattttgcaattctatgactataattaacctataaaattccaattattttaaattttctaaacttccctaatctccctctaatttccttttttttctctttttcttttcctctctttctttctctctctctgccagcctctcttttcctctccctctttctctcggctctctctcccacccgagcagtggcggcggtggacgcgaggggaacggagggcggctcaccggcggcagcagcggcgacgacggcggcagcgacggtggcgcacggcggcgcgggagtggcggcacggcggcacgagaacggcggcgcggcggcacgggaacgacggcacgggaacggcggcgcggcagcatgaaggcggcggtacggcggcactacggcggcgccgcggtaaaaagggaggtgatggacgggaatgggtgtgggggagaagagaagggctgggggttttatagggtgtgagagagaggagagagagggggcggtgaaggagggtgaggcgacggcggcgcggcagcgcggggcgcgaggcagcgatgggacgcgcgcggcgatgggacggcgcggcgcgacggcgatggcgacggcggtgtagggctcgaggcggcgacggcaacggcacgtggcgacggcgacggcgacggcgacggtgcgcggcgcagcggcgggcgatgggacgcgcgcgtgacgggacgggtggtgacagggcggcagcggtggcgcgcggcgcgaggcgggtcgcgacggcgatggcgacagcgcggcagcggcggcacggggcgcaaggcgatgtgacgggcgagcggcgacggcgacggcggtagcggcggtgcgcggcgcgaggcgtggggcgcgggcgcggtgtcggcgcggcagcggggcagggttaggctaggggacctcgtcgaacacctagcggccgatgaatagtgccgttttctatttacccgatttaagcctatttatttatttaaaattgattctataaaccttaatttttgtacaaatgaagttcactcaatatttgtgttattccaaccaatgggtccatccttgattaattttacccatattttatttttatataattttcttgaatttaattagagttaattcttattccgacacttttcaatttaattgatacaaatatagtcgtaataatattttactcatttctatcctcactaaatattattttaaattgtactttaattatttacttagtcaatttacttttcagggtttattcctaactaattatccattattcgcgatttataaactccgaaataaaaattcaataaaataatcgaacaaaattggcatgatgcaactttatttaaaaagtttttgaagatccgtatttttagagtttagcttttgtcgtcgaatttttagggtgttacacagcgggttcccctccgccagatccggcgggctcccatgtgcagttgttgattgtgtgatgctgatgtgtagttgtcctttttggtagatttttagatgttttttttgggttgctttgatttttgcaaatcgtatacctcaaaggtgcagtgttctaatcagtgtcatcttcatggtgttggttagaaaaaccggcacctttgtggggttctcaaccggcaccaatgacattttctgtggtagtgatttaaagctcttagttcttacaatttctggttacttagaaagtttaaactccaaaatttttataggaggttggttggttcatatataaaaatcgattttcacatatattcgacttaagccgcccgcctaaaaaattctcaaaggtggatgccttaatatctacttgtgaaaatggttttctatattttcattttattaggctccaaaacaaaacaaaaaagtattttgaattttagtgggcatctatacacactcacacatccaagttgcaaccagtggcggatttaacgtgggggtcttgagaccccactacggccactgggaccactggaaccatggagatcgctctaagccctcactaaaaattatttgtatagatccatatgatatgggggctgaaggttctcctagtttgtttagccccaactattattttgttctggatccgcccctggttgcaacccacaccatttttttttgcacgaaatacgcatccgtgtgttttgtaggatttgaactccccacaccatcttttttctacacgaaagatgcatctgtgtgttgtataggatttgaactcgagacttcctagttagtctacacccatcatccttatcatctctatgtcattcttgttttttagaattaatatgctattcttttgatttcttctgtactaatataaaaaatatgagtttcatcttcaatcctttaatcttggatccacatatcacgtgggacccacctgtcatccggcccaaagaaaccacaccatcggcggaccatgcatgtcacgcacggaaaaaaagaaacgtggaaaaaaaaagaacgccaaaaaaggaaaaaagaatgcaaaaaaaaaaacaaaaagaacgtgcatctaaccccgactgctcccaacgacacctctactacgtctctgccgccgtcgacggcctccaccgctgccatcttctccctcttcaccgctcgccctaccctttgtcgccgcctcctcgtgcgctcgcgacgctggcatgatatgccggagaggcggggtcgccgttggccgcttctccactcttccccttcgccaccgcatcaccgtccaccatcttcgtgcgggcggatattgccgaatcatggcaaccgcgtccgacgctgcctccacgtgacccactgccggcgtctccctccaccgcgccgtcctccatctccaccgctccattgtcctgcctccatcatgatccaccgccgccgtcgagaccatatgcctccatctccctccatcgccatggctacagcctcttccctgtcctcacaaaatccccgtcgatgcaaaacttctccccgctaccccctaccccgtgctccacatggcatctgcgcctccgctcgccacccctccctgtgcgtcgggctaccccgcgtccgcgcctccccctcgcacctaaccgcccccctaccaccgttgggttgccacctagcagcggtgtccgctgaagatcgctgccttgattgttagagtttgtctcgaatatgtgtacaaagtcggttatagtttaggacttggagttgtactaggtgtaggactagagtaagagttggactctatcctaggatctctcataaataaaggggcgtgcttgttgtaaccgcacggcgacttagcatagcgagagggagcggctgccagcggcatccggccgtgagtcgttgtaactcggatacgctgtaatatgctggatcggggaggagcgcccataatcagtgccccggagatgaaggcttcggctgaactccgttatcaaatatcatgcctcagtgtcgttatcgtgtttggatctcctatggcgtttcttccacatttggtttccgatgtgatttcggggccggttttataacaagtggtatcagagcctgcgggagatccatggtagaggtacaagggaggtgctccacgccgtgacgactacacaaggtgtctagggacagacatagacgcaaggtggagcacggcggcgataaacggaatttgatcggtggaatcggacactttaggcggcagtctgaaccgttcgatggctattttcaacagggagatgaccagacatagtgcttgggttgatggcggcggaagcgattggcgatccaatcggtggatcggacacttcgggcgggtggctcgaactttccggtgagctactttcaacagggagatgtaaggcctcatgctcggggttgattgaagctagacgcgatcggcgttctaggttggtggaatcgaacactccaggcgaggtggcccgggcttttcgatgagctacgttcgacatggagatggcccgggcctttcgatgagctgcgttcgacatggagatggctagacatagcattcgggtcgtttggcggctgagaagacagcatggtgatttgtcggcttcggctcatggctagattgacaggcggtcaattggaggtcggagcggttttgttttcgacgaactctagtggtaggaacacggcttggtgtggtcgtcgtgtaggtgccggcgggattcaacgcaggccagctctggtcaacggaggcggcggtagctcgtacaaggatggtgtccgagggagcagttatgcgcatcacgcaggagggctgcacacaggggttctgagcaagatgtgcaagtaccatccaatggcacgtagcagtaaggaagacaaaaatatgagattgcttgagcattggattgtgggctgtcataggaagctatgcatggacgtggtgtgcgcacatgcatgagaatcatggtggccattaatgcaaagcagggatatctgaatatttttgttgtcttggaggcaactacatggtggctggtggctgggcaggcacggaaaccgaatccaatcaagcgccagaattggtagtcgaaactgtgttggtccgtctaagtagaggcatggcacagtacgtgagccaaaggcgaggaggtcggatggtagacggaacagtgcggttttttgtttgtcgctggttacggtgtgattgaggagttgttctcaactcagagtcgatgaactcgttggaggccgggtggcagaagagatgacagagtcaatttagactcaggttatctagctaagccgaaaaaggggatcgtgaattaacaacagtaattgagaactaggtttaggcgttcgcaatggattgatcggagaaggtggaggctcaggcagaggtgtacagcagtgcgtggggtccttggcaatagcgggggaaaagcgggggaaaatcgttgagggtgtcaacgtgtctgtttggcagtacaggatatatccagaatctgcggggtttgcatgatggggatatatggaatctgcgtcactgaagaggaagagcgagtgctatggtggtaatttcttcgggtgattcaagcaacggtgaattttctcaaattatcgggtactcagtctaggaatgcaagaaagcttggatgttggatctattagctcggttcattagacgacaaggaagaaatggttctcttcatgtctagtgagtttgctctgtctatttggtgatgacattggttatctggtcatgaattagataaattcaaatcaaagacggaagatgaaggtgaacatggtcttcggggagtctatgatgtgacagctagggagaaattcaattcgcttggcaagacgactgtgatcatatgagagaaggtggagcaatgttctaggtggagtcaagggaagaagttgtaaggatagcggagtctcttgtttacggtgagcctattgaaggcttgtcggggcggctcggcgtgagcggcgaaaaaggatcaactcaagtcttgtacacggagattcgagcaagtaacgaattcaggttagtgtggcatattcgccaaggtggagtttgttagagtttgtgtcgaatatgtgtataaagtcggttacagtttaggacttggagttgtactaggtgtaggactagagtaagagtcggactctatcctaggctctctcataaatagaggggcgtacctattgtaaccgcatggagacttagcatagcgagagggagcggttaccggtggcgtctggccgtgagtcgttgtaactcggatagtcagatacgctggatcggggaggagcgcccataatcagtgccccgaagattagggttgggcgttcagtcagactggaaaatttggtctcgttcttcggtttttcggttagttcggtctttgaaaactcaggaccgaatttcatccaaaaaattcggtctctgtctcagtctgaccgaatattttcacagccgctagagagaggagacggaggcgacgccgaggcggtgccggcgctggaggaggacacggcgttggaggtggaggcggaggtggagggcgctggcgctgggcggaggtggaggcggcgtgcagggcagcggcggcctgcggtagctccaccgacgccgtcggcgcaccccccaccagcacggctgcatgggggaggaggggatgtggtaaggggatgtggatgtggatggagaggatggtggtggtggtgggttggatatggataaggttttgcttgtgttgactactaaggaggtattggacctaagagcatcaccaacagattatctataattttctcctaaaaatttgtagttgggtttcctaaactgaaaataggaagtgaaaaaactcttccctccaacagatagcctaaattcaatccccaaaacttaaaagtgggtcttcctgttaaactaccaagagaaaattctgttttttttctttcacacgtagaaagatcgctatctcccacgcgcgggaacgaaggagaggcgggattgcgtgattgggagcgactttcgcgcccgcatataaacggagcgaggaacccggggaagggaactccaaaactcggataggagagtaggggatctgttgaagctgatttttagactaaaatccctcaaaattagttttgggaatcgtataggtagactgttggtaatgctctaatgggccaaagctatatttcagttttttcggtcaattcggttaaccgagcccaaaaactgaattgaccgaactaaattcggttagtagaaagtgctgaccgaatttgtgaccgaattttttggtctgggtctcgatcatttcggttcggtctttttctatccacccctaccggagatgttggtctcggctgaactccgttatcaaatatcgtgcctcggtatcgtcatcatgtttggatctcctatggtgtttcttccgcatttggtttccgatgtgatttcggggccggttttataacatcgatgactccaggaggcggggctttgatctgttgggagagcctcgcgctgtgtcgaccttctctactctccggcgctggaaggatgggatcctctccgcagggtgaggggcaccgacatccgacgcggaggttctcctcgtcctctccatgttccccagcctcctgctcctagctcctcgggctcctctctgcggtggcagcggtggcgttgggaagttcggttccttccgagcactgtgctggcttgagatcgacggaatcggagtctcttcgccgttgcggggacgtgttgttgtgcagatgagcgggtcttagctcacgacatgtttgtgttgtgatttagtacatggtatgagatttttgttctcgttttagcgtgtgataccagctcagtgaacatgaaataaatgtagaagatgtttcacaatgcagctgaggagaatgttataagcatccgggcttatgtcactgaactgaaggagagagttgcaataccaaaagcagttgctctgtcaggttctgatcgtttatcttgcacatataatcaatttgccgtgaaaaagatatgttgtttcaccactaaaatatgttttcttctgatcttcttacaacaggtcttggagttggaatcgaatgaaggcaaggcaaatgacacggaagaagattcagaggaaaatgcaggatctctacacgatatataaaatataagtcttgactgatgaaaacaactcacaatgcaagagataatgcttcttgtctatttctgattgttgtggcttgaatgctagatttatcccaatctgcttttatttgtctcattgtctgaccttcgattttgtttttgaatttctctagaacatattgtgaattgtgaaaattttcatattgctcttgaacagattgtgcttggtagtgtgaaccaatatcatgcattgcaccttattgtatgatatcagtttgatgtctattgtatgtatattgggatttggaatgaggagtactggaagcaggaagatggtggtggagcatggggcagcgtcgaggaagacgacagacaggtacattgatttctgcccatgctcccctaccgctagatgaaatgattcaatttactgctatttactctttggtagttgtaatacaatgaaagaccaagaacccgagattgcttactttagtgcatatacatgagcttctattcgcgggcttctctgttttcaatttctgttgatcaaccttactgctgtgcactgctttagctcaaacaaaccgagtgacaggagaggaaccggaagtttttgtggtttgtggtttgtagtttgtagggagaggaaccggcagtcgtgcattgatacatatgatagtttttgtgatttgtagcctgagatcaaattaaatttaccaagtcagccaaatttcagagactgcttcacctaggcaatgtaaaattatgaaggccttcacctagcctatgctatttattttatttttattctcacaataggaatgatattgttttcaatgcccctaggctgctcacaccagttgctgccgctgccagttcggacggcccaatgaggccggtgcccttgaatgacaccatatcaggtcctagcgtcagacaagataattcctccgtctgaacgttgcaattgccgttctcgccgactccacattttcttacccataacaaaccatacatgaaaactctttttgccacggcctcaattcatgagcaagtctaatacttcaccttttttcttaaatatgttatcaacgtgtaactccgactcatgtaatggttgctcatgctgaagaaaatgtaacccgtgacaaggagaatgatgcttccatagttgtacaaacctgtccaggaaccaggataagtaccatgtttgttccaaaaaattatggaaatatactctcttagccatcatgtttgtttataacaaggaagctatgcttccattgctgctgcctcaaagaaacca

SEQ ID NO: 63723 - DNA, 6546 bp, Oryza sativa
gagggggacctccttaaagggggatgatgccctcctactcacttgaagcgtgtgaggtggagagaagagggggaacacgcacgctcgctcacctggcatggcatggcggcgcgcgcacgacgtgaaaccattgcccggttggtgtcctgatatctctataatactgcaccctcctctgcgccatccctcaggcgtcctgatatctctataacaacgtgctgcaccgggagaaggcagtttgcctcctcctctgcgccgtcgtggagttcggttggcgtcctgatatctctataataacatgctgcagcgggagaaggtggtttgcctcctcctctgtactgcgtcgtcgctcgtagtctactccatccagctcgccagtgtgtaccggcgatcaggagagcaggtctcctctctataataacgtcctgcaccgggagaaggcggtttgcctctgcgccgtcgtggagtccggttggcgtcctgatatctctataataacgtgctgcactgtcctgatatctctataataacgtgctgcaccgggagaaggtggtttgcctcctcctctgtactgcgccgtcgctcgtagtctactccatccagctcgccggcgtgcaccggcgatcgggagagcaggtctcctctctataataacgtcctgcaccgggagaagacggtttgcctcctcctctgcatcgtcactcaaggcagtttgcctcctcctctgtactacgtcgtcgctcgtagtctactccatccagctcgccggcatgcaccggcgatcgggagagcaggcctctctataataacgtcctacaccgggagaaggcggttggcctcctcctctatactgtgtcgtcgctcgtagtctactccatccagcttaataacgtcctgcaccgggagaaggcggtttgcctcctctgtactacgccgtcgattgggagaaggcggtttgcctcctcctctgcactgcgccgtttcttgtagtctactccatccagctcgctggcgtgcaccggcaatcgggagagcttcgacgtcctcatcctatgtgtcgcgctgtcgctcgtagtctactccatcccgcttactggcgtgcatcggcgatcgggagagcttcgatgtcctccgctgggagaaggcggaaataaggtttttgggaagcgcttcacgcaactgctccttattcgttcacgacgactcgtctttcttttcactcgcgtgctgcgcgccgagaccctctaccttcgacatcctgcacaaggagaaggcggcaataagttttttgggaagcgcttcgcacgaatactccctgttcgttcacgacgactcatcttcctctttgctcacgtgctacgcgccgtcgtcaacgcctgcaaccgtgagtaattcctgctgagcaactagtcttccggtaccctcgatacgtgttcaatatattacgcatatttgatctgttgatgctttactgcctagtatacatatgtagatctaatgatggatttatactagtttacatctacaatatcatgatttatttatggaataaattaaattattatatgcttataaattcaacagtacccgcgctgcagggaggagtgccacgccgcgtagtcagcggtcttgttgatcagctccatgacgcggccgccgaacttggcggcgccaccggcgccggtcacgttgttcatgttccacgcgacccacgccggcgcgttcgttaggttggcccggaagtcctcgccggagaaccggagcatgtactggtcgtagtagatcgtggcgtccctgaacctgtcgcagaagaggcggttctcgacggcattctcgaacgccttgcggaggccgttggcgcactcgtcgccggtgtagtcgccgcggcagagcgcgatgccgtacgccgcgtccggcgcgctgccgacggtgtgcgaggcgaagttggagaccctggccacaccgacgagccgcgcggccagcgccttgaggttgtcctcgtacgtggtgttttgaccgtagcggccaccggacaggctgcagttgtagtatagcgggttcacctccggcgaggccactgccaccgcctcatcttcaccacgggccgtccatgccgacgacgagaggacgaccaccggagagaggaagaggaggaggaggggttgcatttggcagtggagagaatatactacgtcttcggactagtgtttgattagctattatatatgcatcagtagtgctatgctgttgctagctagtgttttggtttaatggtattgctttcgctttgctgggccatatatataggcacagtagcatgcatgcaagttttgagaagtggcgtgccaatgtcaatttcttctatgttacaagacaacgcgtttgttctcggtcgaggacctaaaataactagagtaaacgattcgcgcaagaaatttcatgcccctcggctgatcgatcggtgccctatggcttttacaaaaatattatcggcttctcatgcagggggcatgcagcaagttaattacagtaatacggagtatatatgtaaaaattatgggtcgagtcttgctggttgttttcatgagatcgagtcgtttgacttgggaagatcatctttgaggataagatcgatatgtttgcgtaatcgaataacctctctgtgcggccgtgcggccgcggctgggttcgcaaggagatatatatattctgaatccttgttttacatgttcaaaaactctggctagctacatcaactttgtaattgatgacttctttactcaagattatttaggtgactaaataagcacaataagattttgagatatgaagttaaaataatagcatcttaattctaaacaataagtatttaaaacacagctcctctgacttaaaatccgagggatatgagtccctaaccggtgggaccaacctcatggacccacacatcagaaacgtatgtccctctatggtacgttagaggagcctcatcacaagtatctgatagtagttgatagtgatgatgtgtgtagactaagaagtctcaagttcaaatcttatacacggcacatgcgtgcgtatttcatgaaaaaaatagtttggcttgcaacttgggtgcgcagagtgtatagatgcttattaaaattcagaatactttttggtttttttttggcaactacaaaattaaaaaaatgatagatcttgattactatagttaacaacttattttatttgatattttttagaaggcaatttttgctacagaatactgcttatgtatggttttagtcctacgacactgcccaaactcacttttgggggaaaacactctataaacgtggtaatttgccagtggacaccgcgtcaattaaaataataatttctggttgaagatgagagagaaatcgcgtgaaatatcaaaaatgcccttggacacatatgtcagctctatctcctgtctctcttctcctctctctctctatatatgttctctctctgaggcgcatggggcggtgtcggtcgccggggcttgagctcgtcgcggcggaggagatggcaaggatggcggccggcagagtggagcagggcgtcggctgtggcggagcggagctggcggctgaagcaggcggagcggcgatgtcggccgagcgtgtggcaggcggagtagagcgccggcggcgggtgatcgcacggcaggagggaccgttgttgccacaatcttgtgccacccagcatctgccatggatgcgacggtgcggttggggccgaacggcgggggagaagcggtgcacgggcggcgagggcagaagctgcgcatgagcttcacgcgtcctcctcctcctcgaactcgtcaccatcgtcgtcgtcatccgccaccgccccgctccgcgccgccggatctgcgagccatcgcctcgccggcctgcatgctgcgccagccaccgccccgcagcggtgttgtgattcggtgattgggatgagagaagggcggcggcggctacggcggtggcaatgagtggctcggcgtagacgttggggatgcggtgcgggagctacggctcgctcgcgtcgaccgacggcgggaggaagtgcaggggcagggggtgggggtggcgaggcagcggggagaaggagcggctgcagctgctccaccgtgcactgtagctggtaggccgccggagggccggggtgctgctgctgcttgccgctgcctccgccgccgtctgtgcgggcatggccggcggccggcgggaagcgacatgcgggcaggaagaggagaagagatataggagatagagctgaaatgtgagcccaaggggcatttttgacatttcacacgatttctctctcctctttaaccggaaattattattttaatcggcgcggtatccactggcaaattatcacatttatggagtgtttccccctaaaagtgagtttaggcagtgtgctaaggctaaaaccacatataagcagtgtcctataccaaaatttgcctttttagaataggggtgaaaacggtcgtgaaacgtcttaaccatctccataactatattttttttggaaaatggtaaagttggagatggaaacaatattgaaaatatcgatcctttcaaaaaaatattgaaaatatcggaaacccggaaacggattatacggacataaacgtgtcgatatcgatcgaaagccgataaaaaatatcaaaagcattgatctttaaaagcagacatttaattttgcataattatattatataatatgataaaatatattcaaggttacacaatgtaaattccaaattgtgtactctagctagggtgtggttgagaagttgatgtgcctctaaactatagatctatttaaaaaaaagagttcattccactttgggctatgttttattaccaaaatttcactttgaaccatcctttatatccatttttttcaccaaaaggagccacagcttctagcaacctggggtatcacattgccataataagataaccagatcaagttgacccaaggaatgtttgctctgttataaaatttatgcagatgcttcataagaagagccctatttttgaactttgaggtcaataacttctagaccacctttgtcttttggcctacaaactttggaccaagcagcaagagatttcttggatgaattaaggtcatttcccctccaaagacaatgacgtctagctctatctatggaatcaatgaccgagactggcaatgacagagaacacatgtaataagttgggagcaatgagaggaccgaattcaccaatgtgagtctatcaccataagatagaaaagctgaactagcgtcagtcttctctcaattctatctgtaagtggagcaaagtctataacttttggcttggtggttccaagaggcagccccaagtaagtaaatggcagagttccaatagaacatccaaaagtttaagcaaacatctgagctttatcctctgtgagtttcaatggaatcatgcaagacttggaataattaaccttcaagcctgaagagagagcaaaagagttcaacaaggctttaagagcatgaagttgaggggccgaggcctgcataaagatgagggtgtcatctgcatactgaatcacggggaagttatcatcaccagggatcgggataggcatggacaagatccccctttgatgtgccttgttgattatggattgcaacagatctgctcccaaagcaagcaagagggagataagggaaccccctgcctgactccacgtttgcatttaaaaacttgccaggaacaccattaagaagaacagccgaagaagctaaggagaagatcactttcatccaggcattccattgggatgggaaacccattgcagccatcacattgaggatttcctcatactcaactgtgtcaaaggccttttcaaaatcaagcttcaacagcactatttccctttttgaatgcttacattgatgaatgtattcaaaggcccaagctaaacagtcctagatcgatttgccttttatgaaaccatactggttctaatgcaccaatcttaacatcaacacctgcaacctatcagcgaaaattttgcaaagaattttcaccgaaaagttcatcaaagagataggcctataatcattaggagtttgaggcgcagacatctttggaaccagggtgatgtaagaatagttgatggcagcaagatcaacagagccaccccaaaagtcagcacaaagtctgtagaaatcttgtgcaataatctcccaacaagatttataaaaacatccattgaaaccatctggccctgggccttatccacaagcattttcttgagcacatcaactatctcctttgtagaaatctgagcacagagggaggacaggtcacctttatcttcaatctgttcactaagatcaaacaccattttaggcttatcagaaactcccattctatccctgaacacactccagaagatagcagctttcctctcatgatcaaaaacttggttaccatctaaatcttggaggcaggaaatggtattgca

SEQ ID NO: 63724 - DNA, 2181 bp, Oryza sativa
aaggaaaaaggattttccctggaattaaaaattgcactttggtgatttttaatgggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttggggtgtgacatcagcgcaccttcagaggcggacgacattcctgtcccactctgagagaaggactcgaccgaacgcgccgccgcgattaaagtgagtgtactcgatgattcctttacatctttcttctcgagatcgcgttgtgacttcatattgtgcaggctctccctctgacggacgccatcggaccactcgtggatcactaggtggtgacgtcgttgaaggagggggtcaccaaggaggcatcagacgctgttgctgccaccatgtcacgactggaaataacccaacaggcattccttatgtgcgtgcattattccttgtcccaggaggcaaggtacaccaaaagttgatacaattcagagtttaataagcggaagcgtaaataattaatttattacatgggcggcgaaagcccagcatacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagccatagacaagagtaccgacccaaccccacctacggccggaaccccccggacaggtaggcaggactgagcccctagcagcaggacaccagccctgtgccatgacatctcgactaccgggccgcagctcgtgtagccgtcatttgtcctagagatgtccatcgacccccgacttcgtccatctccatccatgtacttttgtttgtaaccagactgagccacaaactaagcattacccactagacatgtggaagtacggtagtgctttgcaacagaggcccgaagaccgatccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttccacgaagagcggatcttccgaagctgcgcgtctacacgaccaacagaaaagaaaaggcttttactctaataaactccaaatgacaagcaggaacaaagcacaaaaatgggttcttgacttctta

SEQ ID NO: 63725 - DNA, 900 bp, Oryza sativa
aatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctaggg

SEQ ID NO: 63726 - DNA, 5049 bp, Oryza sativa
ggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccgattgttctcaacaaccgggactaaagatatctttagtcccggttgttgagaacaaccgggagtaaagaaaagatctttactcccggttgttctcaacaaccgggagtaaatatcttttcccgctatttcgaaattctttttaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccaatcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgatgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttttcatcccactgtcatcaatcattacgcctccaccagtcaacctaacccattggcaccggaacagagaaaacttgagaggaccatagtcaagttcccatatgtcctcgatggcaccgtaatacgtggcagttgttccatcgtgtcccatggcatcgacacgaacagcgctgttctggttcgtgctcttcatgtcttgggctctcgtgtagaatgtgtacccattgatctcatatccctggaatgtcgcgatcgacccagacggtcccctctccaggaaggcaagttgttggttgatcgactcgttacccatgagatgttgtcgtagccatgcggggaaagtatcaatgtgatgccgtgtaatccatgcatcggacttaccgatgttcctggtgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacagtacctttatgctctccaagcattcaaatatactttccttctctgccttgctaagagtgtagctggctggactcaagtaatggcttcctttctcctttggttccgggtgaaggtcgccgcgttgttccatatgcttcatatcattacgtgcttccagtgtatctttcgactttccgtatacacctaggaagccaagaaggtttactgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcgcttgacggtaggcacgagctagacaccaaagccttcatcttccaggggctcctcttctgggtttgggaaaaattgagcaagactgagtacaaccaccgtactcaacaagacacacccacaagtgcagaataaatgcaagggagtacaaaggagttatactataaagggttagggttgcggtaaacagcatttaaagatatttagttgctcaaaactatttagtaaacacgagtctagaactatacaatattatttatcaaggccgtgaacccacacgaacctgccttaacccaaggcctacgatgattcagaccgaactgtcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaacatgtgtagagtgtccactagttggagttttgtttattctagggtgaacaaggaaataataacaataataatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccatgaagagcggatcttccgaagctgcagcgtctacacgaccaatggaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaaaaaatggatttattgcgtcagccgaggggagagggcgcgcggaccgggtccacgggagtggggcccacgcggcagcctcacggcccacggtggaccgggcgcacccggctcacaccggccggcgccgtgggtcccatgcgtcagccgcacccgagggcgcgggcggctgacggccgggccccacatggcagccgaggggcgcgcccgaaggcggccacgccggcacagccgacgggaggcggcgcacccgcgccccgatggtcgctgccggcgaccaccggcgcggcggagcggcgcccgagagaggggagggaagggggaagcgagtcggcggtccacggctcaccccgggtcgacggcgacgacgggaacggcg

SEQ ID NO: 63727 - DNA, 3244 bp, Oryza sativa
ttttttcaatttttagggtgtgacacgcgggcggctgacggccgggccccacatggcagccgcggggcgcgcccgaaagcggcctcgccggcacagtcgacgggaggtggcgcgcccgcgcccctatggtcgctggcggcggccataggcacggcggagcggcggccgagagaggggagggaagggggaaacgaaatgggcggtccacggctcaccccgggtcgacggcgacgacgggaacggcgaccggaacggaggaaggcagcggcgcggcacgggttgacggggacggcggcgttccgacggtcggcgggcgaaacggaggggtggacgaggtcggcgaggttgcggcgaacccgaagaaggcaacgtcgaagcgggagaaggtcccggggcgacgacagcggtggaccggagctcggcggcgatggcggagagagagaatgacggtgcgaactcgattccgacggggagagagagcggcgagtggtggaaacggcagagggaggcacggggagtgtttatatagggttgggagggggagagagcggccggatgtgggggaatcggccgcggaagatccggccgccattgatgcgccggcgaggtttagggggaaacgttttcgaacgaatccgagggagagagagagggaaaagtggggggaaagagggagggaatcacggggaatatttcccccctcttgattgcacacggggcggacgggagcggcgggattcgcagcggcggcggcgctagggcacaggcgaggcggcgggagcggcgggaggaaggggatgacgggtgggccccacccgtcagcgagggtggcgggcgggcccgtccgtcagcggcacgcgcgcgcggggaggaggccggatgggccgcgggggagaggagagagagggagggaggtgggccgagccagcccaagaggggaaagactttttagggtttttctttttataaaatcattttaactttttttatttcttcttaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaaccaccactgtcaccgtcgtcggccagcctgagtaatgttaaggaaaagatccagaagctcggtttgactgacgtccatgaaggaaacgttgtgcccattgatccagagaagttcactcccgaacagaaggaagacttcaatgcaatgatgcaacaagcacaagatcaatttttaagttcattcatgcagactcgcaagggcacatttgttcagaagtacaaggtgaaggtggttcttgaggatcctgggatcggttcttctaaagagggagaaaagaaacaagttccagacggatcagcccagccgagtgacaaaggcgttacagatgggtcgacccaggagaaccagggtgactacttccatggagtacatggagttcaaggtgacggcactcagggaccacaagggggaaatcttaatcagaatgacaatgcattccaagattttttcaataactttcaagatcgagttgactatgttgtgtatagtgctttgattaatcaatctggagtgttgactaataccttgtcaaatataatgaaatcggtagccgatggttcaatagctgaacatcaggctgcaggcccagtttatttgcaagggggtacttttccaaattattgaactttgatcaccgatgttcatccacttactcagggaattcctcctgttgcatcatcagctcagccgatggcaccagcatcagctccagcacctgcagcgccgtcgtcggctccaggccaattaatcaatcgtcaattattggtaagagagcaatctcagcatcctagaccgaatgtgactcagctaacacaagaccagattgcatctaggtgtttctacctcctcagaatgctgttaattcagctcagcagcagccgattcagcaaacaccgcccaggcaacaggttgtgcagcctattcaacaaacatctccaatccagcaggtcgtgcaaccagttcagcagacgccagcaaggcgactggctttacagccgattcagcagacgccgttgagacagtaggtcgttcagccgattcagcagcaaggctcaatgaatgtgttgcctggatttgcaacacctggtggtcagcctgtgcagtacactacaaatcaggttgtcccggaacacctggttcatcatgtgcaaccagatggttcagtggtacctcaagttattcctgagcatttggcgcgtggtactcagccaaaccttcacaattaccaggggggcaatttgagttatgaatatcagcctccatcacctcaagttcagtaccaacaggcaggatcggttcaacctcaatttgttcatcaatacaatcagtttgagctgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaagtaaatattagtggaattttcagagcacaaataataattaagaagaaataaacaaagttaaaatggttttataaaaagaaaaaccctaaaaagtcctttttccccctccccctcttgggccggctcggcccacctccctccctctctctcctctcccccgcggcccaatcggcctcctcccctcgcgcgtgccgctgacgggcgggcccgcccgccaccatcgctgacgggtggggcccacccgtcatcccctaccttctgccgcccccgccgcctcgcccgtgcgctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttcccctaaacctcgccggcgcatcaatggcggccggatcttccgcggccgattcccccacatccggccgctctctccccctcccaaccctatataaacaatgtcgcgacccaaaacg

SEQ ID NO: 63728 - DNA, 4021 bp, Oryza sativa
cggcgatagggcacgggcgaggcggcgggaccggcgggaggtaggggatgacgggtgggccccacccgtcagcgagggtggcgggcgggcccgcccgtcagcggcacgcgcgcggggaggaggccggatgggccgcgggggagaggagagagagggagggaggtgggctgagccggcccaagagggggagggggggaaaaagactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagggtcgttttgggacgcgacatttacgcaaaggttcttagtgaggtgcatcacgtcgattgcgtggcgtacgtccaagaattcccaatatggtaactcccaaaatatagagttctttttccacatcgccgcgtgaccatcttcgctttctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacctcccttcttccataactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttctccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgacaaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattataacttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactacagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttagcatgacctcccctcttttttgaagtaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtaacactaaccggggctaaagatcaccgggatctttagtcccgattggtaatatcaaccgggactaaagttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgtttcccttttgaaccgggactaaagatcatctttagccccggtttttattgcatccgggactattgtggaaatcggccgaccgacgaaagatggtttctccaccagtggcacgtgggcgcgtgacgtttggctgtagcgtcatcagcacgcagcacgctgcttggtacaaagtacatcgatctcacaaaaatctgaaatctctgtcttgctaaaattctgtcgttcaatttttctcttaaaattatcgatttttctaacgctaggcgcagccgaccggccgttcgtacgtacgaggcaaaagcagtgcggatatcctcgttcggtaacatgcatggagccatggactgaaaaatctaatgggcgattgatcgttcctaatgatccgaaatcgctaagagcaaggataatagtgggctataagcaagttatatgcttatgtggaagagagagataaacaaaagtgggaagtgttggctcttatgcaagagctaactgcacacaaactctaaaaaatatgcattaaattcatggtgagagaaagagagaggatgaagaaaataaagataaacttatagccaatctactatatatgttagctttaacattgactagtacgtagtgaactctactattaaacttgctctaaaaagcgatcagtcgcgcgcctcccctcccgcgcggcgcggccacgtggcacgcgtggagaggggcgctacggtggaacggcgcgggagcggtcatgtgcgcacgtttcttgttttcttttcgttctttctggtttttttccctgattcggcgtttctctttttttttctttcagtatttcttttcgtttttttctggtttttttcctggtttatttttggttttaaacttatacatatataaattttatatctgtatgtatataaagtttgtatacgtacgaatacaaagtttgtatacgtggtgcttttttgttttcg

SEQ ID NO: 63729 - DNA, 35400 bp, Oryza sativa
atatcgtaagggaagcagaagaaaaggtaaagatcattcaagaaagattgcgtgtggctcagtcgcgtcataagagttatgccgacaatcgccgcagagatttgagttttgaagaaggagattatgtgtatcttcgtgtcacgcctctacggggagttcatcgttttcataccaaaggaaaattggcactgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgtggagaaaccaatccgtatcttggaaacaaatgagagaaaaaccaggaatcgagttatccgtttttgcaaagtccagtggagtaatcactcggaagaagagtcaacttgggaacgagaagatgaattgaagtcagctcatccgtatctgttcgccagttcttccgaatctcgaggacgagattctgtttaaggggggtaggtttgtcacaccctaaaaattcaaaaaaatataaattgttgtttaaatggaatttctagaatttattttaaaagtcttgaaaagaaaatataattttaattaataaattccaatataaaatggggccagataaaatttcattaaatactttgcttaattttataattcctagatttttccggggtttaattgagctaagaaagtatttttaataaatggaattgcatttaagaaataatttaaattgaaaaagtttttaaaaagtcttcttttggctttgggctgaaagtcggcccaaaaccttctctctctctccccggcccaagtcggcccagtccgcagccgcccgcgcgcgcgcgcgtttggacgctgacaggtgggtcccacctgtcaggcccatcgtcttcctcgggccgaaaccctagcgcgccgccaccgagccgccgccgctgtttccttccaatccggccgcccctttccgtttccggccaaatcaatagaggggaaacactctccgggatctcctctaccttttctcctttggaatcatcagctaattcgttttggaagttcgtggaatcgagttcaattcggatcggcctctttccttcaagcccgagctttccttcctcgtcgccggcagccatgggccttcgccttcgcctccgagcccctttaaaagcctccccagtgtctcctccacccgccgccaccctcgccttcgcctctcgtcgtcagagtcgctctagcgccgtgcaaccttgcgccgctgccgccgccgccgctccagccgtgtgccgccgtcgattcagccgtcgccgtcgctcgggaaggacgtcatcgtggtcgccaagtcgtcgccgtcctcgtccgccgcttcgccatcgtcggagaccgccggagcatcgtcgccgtcgtcaagccgaagaactccgccgtttcctcttcgtcgccggcgccgtccgttgcttctccgccgtcgttttggtcgtcggtgagttcgccgtgctgtccgctacccgttggtgcccttcgtttgtgtcctagcgccgccgttcgccggcgagcgtgcgccgcccgagccgtccgctccgccgagccgccgccgccgtcggtgacgtcattgctgacgtcatcaaggtcgtccgccgtgaaccgccgtggacccgatcgatctcggccgtccgtttggattggatcgaatctcggccgtccgttcgcgtgaaccgccgcccgtgcgcccggtccaccgaaaccctagcccgctgacgcaataaatcccctttttcttttcaaaaataattcattattgcgtcataattcaatttaaaccgatttaagtgttttaatctgatttaatctttaaaaattcataactaattcatcttagctccaatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgccggagaagagtttgaagagttccaaggccagcaaggcaagtcacacagatcccaaacaaccctttgagcatattgatcctatttaaagctattgtttctattcaaatattgcatttattttcgaatgtcattgggtggatttaacctattgtttgttatagcccttttgttcttgattactttattccttgataccttgggttattataacttgactagttgagctttatttattggttcaactagatattagatataattgcttagccctgcttagaaacattagctcactattgggataacttatgattcactattatttcatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagctagcatgggcaacggctttatcttttgtatagcatggttcattgcggggcactagactgagaagtggcggagataagcccacgggggtcgctggggagtccatgccttgtttataagggggtgattatgatccaggaaggtgcgctgcagtggattgtgttgtatgaggtgtattgtcataactcctttccgaggtaccgtggtggtattgaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtataactcctttgtactcccttgcatttattctacacttgtgggtgtgtcttgttgagtacggtggttgtactcagtcttgctcaatttttcccaaccccagaagaggagcccctagaagatgaaggctttggtgtctagctcgtgcctgccgtcaagcgcctgtggtagtcgccctagtcttccgctgtttctcgtttgtctctgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagccacccttgaccctaggacgagccgtagatcccaagccttagcaatatcttcaataataaaaatcctttgtatttgtgaaaatcctctagtctctctctgtcttgctgcttcatttatcgccaaaatctgacctttaaaatgttgttttcctttttgtttttgtttgtagatggccggcagcgtcagccgtcgtggtttggacatgactggcttcgtcttggagctacggggcatgtgcgttgtcctggggtatccgcctggagtggactaccaggccaggccgcttccggagcaggagggtgacgatgcagagccccacgctgcgtgggaggttactgcagtgatcctcactggctctcccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgctgcggaggagcccgcgacttcgccaccttccgggatgctagctcggaggatgacgctaccatcgtgcacctggcgcgcatggtggaggcgtacgacgcggctcgtatcgacttccaacagatggtgcgccgtgggatggtcgagaacaacatgaagatcctggagctgcgtcaggagaatctgcagctgaagaaggacctacacgcgttggaggcgcagctgtgtcagcttaaggtcgcccagggtgaggtctgtcgtcccaagcgccgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcgatagacgagcagttagtaggcttgcgcgtgtgttctttctcgtttgtcttcttgttggagttgtgtggggcatggttatgccggtgtatggcataactgtgtcggagcctgtctttattttatttgtctaagcaatttgaactttaatgaaccaatttaatagcagtaataaatttaagaattaaggtagtcgtgggtggttagctttaattgtcagctctctctctgtttgctggttctgtgtggggttttcagatggtgatgaccaggagaagtgctaataccggtgatggcaaccaacctgagggcagcaaccacaacaaccatggcagcccacccccacctcctcctccgcctccaccaccaccaccagataccaacgctattctcacccaaatcctcgcccagcaggccaacatgatgactgctttcctccaccacctccaaaatccgccacaacataatgctccaccaccacctccccaacactcaaaactcgctgagttcctccgcatccgcccacctaccttctccagctccaacaaccccgtggatgcgttggattggttgcatgccgtggggaaaaagctagacactgtgcagtgcagcgatgaggagaaagtcgtcttcgccgcccaccagctgcaggggcccgcatctctatggtgggaccatttgcaggctacgcagccagagaggcagcctattacttgggcccgtttcaccgccgatttccggaggacccatgtgcccgccggagtcgtggcccttaagaaaagagaattccgagagttgaagcaaggcaaccgctccgtgatggagtatttgcatgagttcaacaacctggcccgttcgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgctacgagcccgggcactttgcggataaatgcccaaagccgaggcgccagcaaggcaaagcgcctccccgctccaacaatggtggtaacgatgtcattcggggtcgtgtgaaccacgtgacggccgagaacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggagtggttatgacagcaaagtattatagccctgccgtccctatagaaattcaggggattccttttccctcggatcttattctgctagacaccaagaacttggatgtgatccttgggatgaattggttggctcaattccaaggagtagtggattgcgcgagacgcactgtcactctgtaccgagggccggaacaaccggttgttttctttgcgcccccaacctctgtcagtagttcagaacttcatcagataggactgtcagaaatccccatcgtcagagagttcggagacgtgtttccggaagaactactcggtatgccacccaagcgagagattgagttccggatagatcttgctccaggaaccactcctctgtacaagcgaccctaccgtatggcagcaaatgaactggctgaagtcaagaaacagttggaagagttgaaaggaaaggggtatatacgtccgagtacttcccccaggggtgctcctgtgatttttgtggagaagaaagacaagacgaagaggatgtgcgttgactacagaactctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacacgatacggactgtatgaattcacggtgatgtcgtttggtttaaccaatgcacctgccttcttcatgaacttaatgaacaaagtgttcatggaatacttggataagtttgttgtggttttcattgatgacattttggtatactcacaatcagaggaagaccatcagcaccatctccgtctggtgttgggaaagttgcgggaacattaattgtatgccaaacttagcaattgtgagttctggttgtccgaagtcaaattcttagggcacatgatatctgctaaaggagctgctgtggaccccgaaacagtgaccgccgtcactgattggaagcaacccaagaccgtcactcaaattcgcagtttcttaggtttggcaggatactatcggaggttcatcgagaacttctcccaaatcgctcgacccatgacacagttgttgaagaaagaagagaaatttgtgtggagcccgcaatgcgagaaggcgtttcaaactctcaaggaaatgctggtttcctcgccagtgttagtcttgccagatactcgtaaggatttcatggtgtattgtgacgcttcgcgccaaggactgaggtgcgtgctcatgcaggaaggacatgtggtagcctatgcctcacgccagttacggccccatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtagggctaacgtggttgccaacgctctaagccgaaaaagccattgcaacactcttaacatccgtggcattccacccgaacttaatcaacagatggcagccctgaaactaagcatagttagccgtggattcttggctgcgttggaagccaagcctaccttgctcgatcaaatccgcgaggctcagaagaatgatccggacatgcatggactcctcaagaatatgaaacagggtaaagccgctggtttcacagaggatgaacatggaaccctatggaacggaaatcgggtatgcgttccagataacagagaacttaaacagctgatacttcaggaagcccacgaaagtccttattccatccaccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcggttaaccaaggtagctcgatttattcctgtgaagaccacctatggagggaacaaattagccgagctctacttcgctaggatcgtgagtctccatggcgttcccaagaaaatcgtatctgattggggaagccaattcacctctcacttttggaagaagctccaagaagagctgggtacccgattaaatttcagcaccgcatatcacccgcagacggatggacagaccgagtgtctaaatcagatcctagaagatatgcttcgcgcatgtgtcctagatttcgggaagacctgggataagagtctcccctacgccgagttctcctacaataacagctaccaagccagtatacaaatggcaccttatgaagcgttgtatgggcgcaaatgccggacaccgctcttgtgggaccaagttggggaaagccaagtgttcgggactgatatcttgagagaagctgaagcgaaggtcagaaccattcgggataatcttaaggtggcacagtcccggcagaaaagttatgcatataaccgtcgccgtgacctggaattcgcaatggatgactttgtgtatcttcgggtcacgccattgcgaggtgtacacaggtttcagacaaaagggaagctcgcacctcggttcgtgggtcctttccgtatcattgctcggcgcggagaagtcgcttaccagctggagctgcccgcctctttgggcaacgtgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggaacgcaggaccaggaaccgggtaatccgtttttgcaaggtccagtggagcaaccacgccgaggaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaatgcgtaaataaattttagtggaattttcagagcacaaataataattaagaagaaataaacaaagttaaaatggttttataaaaagaaaaaccctaaaaagtcctttttccccctccccttcttgggccggctcggcccacctccctccctctctctcctctcccccgcggcccaatcggcctcctccccgcgcgcgtgccgctgacgggcaggcccgcccgccaccctcgctgacgggtggggcccacccgtcatcccctaccttccgccgcccccgccgcctcgcccgtgcgctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttccccctaaacctcgccggcgcatcaatggcggccggatcttccgcggccgattcccccacatccggccgctctctccccctcccaaccctatataaacaatgtcgcgtcccaaaacgactctaaaatacatcctcaaaattatgccgagaataattaaaattcatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaatccctaaaagtcttctttcccccccttttcccctcttgggccggctcggcccaattccctccctctctctcctctccccgcggcccatcggcctcctccccgcgcgcgcgccgctgacaggcgggcccgcccgccaccctcgctgacgggtggggcccacctgtcatccccttcctcgcgccgcgcccgccgcccgcccgtgccctagcgccgccgccgccgccgaatccgccgcatcccgccttccccgcgcgccataaagagggggaaatcactccccgtgattccctccctctttccccccactttcccctctctctctccctcggattcgctcggatttattcccgaaatcctcgccggcgtcattgatggagccgagatcgccgcgccggtttccttcctctccggccgccctctctcgctcccgacgctatataatcgttcctcgtgcttcgctcctccgtttccgccactcgccgcactctctccccgtcggattcgagctcgcgccgttgtcctctctctccgccgtcgccgccgagctccgattcgccgcccgtcgtcgccccggatctcctcccgtctcggcgtcacctccttcggcttcgccgcgtccccgtcaacctcgtccaccccttcgtttcgcctgccgaccgtcggagcgccgccgtcctcgtcgatccgaaccgcaccgccgcctctcgccgcttcggtcgccgtttttgtcgccgccgtcgacccggggtgagccgaggaccgccgcttcgcttccctcttctctcctctctctcgggcgccaccccgccgcgccggtggtcgccggcggtgaccatcggggcgcgggcgcgccgcctcccgtcggccgtgccggcgaggccgccttcgggcgcgccccgcggctgccatgtggggcccggccgtcagccgcccgcgcccgcgggtgcggctgacgcgtgggacccatggcgccggccagtgtgagccgcgtgcacccggtccaccgtggaccgtgaggttgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgggtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccgtaggtgggattgggtcggtactcttgtctatggctaggatgggttggaaactatgtcacgtcttccgtctgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggttcatgtgggttcacgaccttgattaataatactgtgtagctttaggatcgtgtttacaaaatagctttgggcaactaagtgacttttaaatgttgtttactgcaaaacttaacctctatattattatccccttgtaccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggacccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgaaattttctcagtcgcgacaaggtttctcagccatgagggaagctgccttctgacttctaatcggtcccactgggcgtgccaaaagcgtgttgacagaaaacacgaggcctgggagatctacttaactccagtgcaggtccaaaactcgccttcagatgtgtgagcatgccagttgatttgatcctgcaatcaacaagaaacaaagacaaagaaaccgtaattaaatccataaatgatagccgatcggctaaatgccaataacatatcatttatctttgagccgatgtcatatgtaaatcgatcggcaagtgttaagtaaacaaatcagaactaaatctactcaatcggctgtagacatcaataatatataatccttatatcgatatatacttgaatcaagtgattgggatagatcggtcaccttgccgagacagtataaatcacttaaatcgaaatatatattattaatgagattatatatatatattcatagcatagccgatcaaatagatctagcatgtattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcgagaacacaaaccgccataacaagttttaccttttgttgaagatcgaaacccatgcagctcaacccgaaagcaagaacttgtcgaaataaaactaaagcaaaaagggtggtgatgcgccaaaattgtattgaacgtgtgtgttatccattacatagggctcggggcctatttatacccaagaattataagatatgtccatattggacacgactcttatccctaacaaactctaagataccataagtctttgtggcagacttttgcccacatttatctctaaggaatttacataaaatatcctaattaatagatacaattgccttcccaggactctatccatgcgtggcaatcatcttgaagcacatcaattcgaacccgttgtcgtacgcaagtcgtattattggaatcggctacatcacttaacctagtctgactcagacttagccgatcccaatcgtagccgatccggactccagccgattcttactctgtttccgcaacaacccttatcttcgattccgcttcgatccatcttcatctccgatgctgatattaccaaagttggtcgttaacagcggtgagggtggtccggttgcgatcggctgcggcctcctcatggaggcggagggaggactccgcctcagccgccgttctctcgtgggcggccaaagtggtctcacgctggtctagcatgcacgcccgcttctccagtgcctgggtacgctcctctagcacccgagcatgctcctctagctcccgggcctgctacgcctgttcccggcggtgcccatcctgttcgcgctggttgcggtcaaggacctcgatccgtggatggaaaatggcggtatcaaccccaccatggcgaaggacaggaggtgcacggatcgctctgggtaccgcggccgcggttgcgactcccccaccctcacggcggcgtcctccggcatgatcttgcgggtgaggctaaggtacctctctgccgtgatgcgtaaagccgggagcacagcgtcaccagcgtcttggcccgtggtagccggcgggaaaacggcgaggagtatggtgtatggaacagcgtggagcgagagaagcgttagggcttgaggagcgagtatgcgggtgagcagtcggcgagaggaaggagacgaactctctccctccctgcccttttatccccagctccccgcctcgcccgcgctcgcctcctcgtttcacgcccttgcggctgccccctcgattcccgcgtctgcggttgccttctcgactctcgcgtccacccatcacaccaccccactgaacccgcgccccgcatttagtgcgcctgtcatcggcacactcggcgcggggcgtgcgatgttcacgggcgcggttaggcgggcccaccatcggtcccatcacgtgcctagcaggtgagggagtcgaggcggcgtgggtgacgattctggacgtggtctagccgaccccccgattttcgcgccctaggcacccccagcatcagcgtggttaatggtggtcaaatcaccattctggctaaagcgccagcctggccgctcgccgacaaccctctgaattccccgccgggcccacaaccacagcacgggaagtcgtgaggcgccacgtcagactgtcctttgggggccaatgttcgacgcggtaccgggggctactgtcggagatatggtcccgggggtatacaaagtgaggggaagttaccttcccatctagccgcgtggctctacagcttggccttactcccgcacctcgcgagtggcagaagcggccggggggcctcggggtgccacgtcatgcccctcgggccctcgcgctgcctcgccccgaggccctcgcccaaccgccatttggtggggggagcgagcggggaggcgacccaggctgaacagccatcaatgcgtgacgccccaactgtccctcaccgcgtttaatgcggtaggggcagacgtgcggtgccgcctgactaacccacgtcaatcaggcgggaccagtctgtgaccggcctattgccggtcacgtccgattggacgggtggccgtgcccccacgtcgcctctgtatccggcggagtggaggtaggtatgtcccgtcccatcggagtgtcattcggagttccctccgtgagaggacgaccaccacaagtcttcacccatttatgagggaatgacagggctgttccccgtgtcaggtggggggtggcgctgtgtcctgctcaaggacggactgctgcttagcctccaggcgaaggcacgggtcatgacccggtcaaggtaaagtgggtcgccctcccatggaagagtagagtagaggcggtgcatgtggtatccccttgaactataaaaggaggaccttgcctaccgagaaaggggacgacactcagtagacctgaactctaggaaagcgaagagcaagaacgctctccggagttaggatcccttgtaacattcaaccactagtcccacacacaggagtagggtattacgctcgatagcggcccgaacctgtgtaatcttggcgttcgcatgcgatttaggagcattcaaggcggatacgcaatctcgagaggcgagccctttcccccggccgaactcacaaaagggggatctcacgatctcccgctagagaggatcatctcctcgacacccgacgacttggctcctgcacgctccggctccgtaggctgtggtgggtgtgttggtggtgatattcgatgaccttaggtcctgcccagggggtccctgatataccgcgggtcagttgatctcttagtaggacttggagatatcggacccctcacaatatggtaaagacccagtcttgtccgagtagaactccttccatccgtagataccatccttatcacgtgatagatttccttaatgtatacttgtcacgaccggaaatcacccaacaggcgttcctgacgtgcgtgtattgttccttgtcccaggaggcaaggtacaccaaaagttgatacaattcagagtttaacaaacggaagcgtaaatataattattacacgggcagcgaaggcccaacacacaaagacaaacgagaaacagcggaagactagggcgacgaccacaggcacttgccggcaggcacgagctagacaccaaagccttcatcttccaggaactcctcatctgggcttgggaaaaattgagcaagactgagtacaaccaccgtactcaacaagacacacccgcagatgcaaaataaatgcaagggagtacaagggaattataatataaagggttagggttgcggtaaacagcatttaaagacgtttagttgctcaaagctatttgataagcacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaggttttaagaattaaaacactaacttgggtacattgctcggcttgcccatatccgagggctcggctattcgaatagattatactctgatcagaggtgtacatctttacccacaagacacatctttctcacgtgcaaccatgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccattcgacatctcgactaccgggccgcagctcgtgtagccttcatttgccctggagaatgtccatcgacccccgacttcatccatctccaatccgtgtacttctgtttacgactagactgagccacaaactaagccttacccactagacatgtggaagtacggtagtgctttgcaacagaggcccgaagaccggtccttatatggccgaggtgctactatcaaaaccatgcacctcgagcccagcctaaaaccattttggggattttgaataaagggggatggtgtgaatccaattccacaataaaccaaccattccaaagtgtccaggtgatatgaatatttcccaaagtctaaagttataaaaccacctaatgttacctaattaaattgcgaagcatctacctaaaattatactagtggtactatgagtagagggtccactagttggagttttgtttaatctagggtgaacaaggtattaataacaaaaacaataataataaggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgccttcccaaacgtcggcttcgacttccacgaagagcggatcttccgaagctgcagcgtctacacgaccaacggaaaagaaaaggcttaaacactaaataactccatataacagcagaaacaaagcacaaaaatgggttctttacatcttgaggaaaaattagagacttgaacggtccaattccgagttcaaatggccaagatatggccatttgaagtttatatgctctttaaatggatatttgcgaatttcttcatttaatttttagttaaaaaaaatcctatttattgcgtcagccgagggagcgggcgcgcgggccgggtccacgggaagtggggcccacgcgtcagccccacggtccacggtggaccgggcgcacgcggctggcggcggtcggcgccgtgggtcccgcgcgtcagccgcacccgcgggcgcgggcggcggacggccgggcccacctggcagccgcgagggcgcgcccgaaggcggcctcgccggcacggccgacgggagcggcgcgcccgcgccccgatggtcaccgccggcgaccatcggcgcggcggagcggcgcccgagacagaggagggaagggggaaggcgaacggcggtcctcggctcaccccgggacaacgacgacgacgagaacggcggccggagcggaggaaagcggcggagcgggtcgggatgacgatgacgacgacgctccgacggtcggcgggcgaagcggagcggcggacggggtcgacggggatgcggcgatgccgagggaggtggcgccgagccgggaggaagcccggagtggcgacggcggcggaacggaactcggcggcgatggcggagagggcggagcacggcgcgagcacgaatccgacggcgagagcgagcggtgagcggcggaaacggaagagcggagcacggggagggtttaaatagcgccggggaagggaaagagcggccggagagggaggaatcggtcgcggaggatccggccgccattgattgcgccggcgagggtttcgggaaggaaatcggacgaatccgagggagagagagagggaaaagcgggggaaacgggagagggaatcacggggagtgattcccctctctttaatgcgcgcggggacggcgggagcgagcggatttggcggcggcggcggcgctagggcacgggcgcggcggcgggcgcggcgggaggaggaagacgacgggtgggccccacccgtcagcgagggcaggcgggcgggcccgcccgtcagcggcgcgcgcgcggggaggagccgatgggccgcgggggaagagagagagagagggagggattgggccgagccggcccaagaagagaaaaggggggggggaaaagaacttcttttaagattttctttttataaacctttttaactatgtttatttcttttcaattattatttgtgctctgaaaattccactaaaatttatttacacgttttaggcttttaggaaatatacaaaaatcctccaagcctcatttgacttttatctgtgcacattttaattgttgaaggctttcacattgattttaattattctcagcacaattttgaggatgaaatttagggtcgttttgggacgcgacaatacggaaactatccatatacgcgtgggtataccgtattagtatataacgtacagccaaggatagagggtataccttatccgtaaccttgacagtagcccccgacttctgcttaaatgagctcatgttatcgatcgcaacttctgatgtcggaattgttgtcgctctcatctggtcgatctcggtgtgaaaactgtagagacaaagagccatcgacaacaccgcatgaagttcaacggccatgagtgaatttaaattgaagtctgaaaaactaccccacgcaacggacccagaattttccggcagcaatctctctcctttccttggaatacgcaccatcggaagcacgtttacttaaagggattttggggatccatttgaagtccgtttgcaagaaaactctcctgccttctagcactcttcgtcttctccgctccccacaaaaaaaaaccctagctcacttccttcatcctattctccggcgatcctccggcagcaatggaccttgagaaatcttcctcgaacaccgcatccatgaagaagctacaggacgacggtgccctccccggtcgcgggaccatgcagagggaggctagaggtacagaacctaaacccatctttcaccgcatggttgtaattgaacattatgtttcttgtggttttcttcctccgccttccgagtttcttcttcttgtcttgaatttctacggcctttctttgcttcagtttaaccccaactccatcgcctttttgagcatcttctctcatctttgcgaggcctaaattggggtagtgcctttccttgacctcttccatttttattacgagctgcgttggatggaatccatcagggtatctggatgcgtcggattccgacttcgggatggcctgaagtcgcgttacatccccttcagtgccccacttctcgcagcaagtggcaaacgagatggttctacctccagatagagaacttggaccccgtccttgttattcctgaggaccagccagaaaagatcccagagtggactgctaaacccgccttgactccctccctccaatcctttatcgacatcattgatgatctccgaaaacgggggttgtcgggatatgaagtcgctgccgacttcgtaggtcggcggattcaaccgctacaggcccgtgcccatccggccttcgattactctgggccagatgacgtgacccgggtctctcctcggggtatttatcctcgtatttctaaatttgtttcaagtgcatctgtttcctctaacttatcgagttctcgttctcgatttacaggtctggacagtgacactgtggggcgccgcatcggccagataatgatcagctgtcacgcccagaaattcccgaatagaattccaagcagaatgtgcaataaaatccccgtccaggaccagccagggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaacagttgtaataagtaattaagcagtattaatcatccactgtccaacgctacaccacgttgcaacaggcccaaccatccacctaaactatccaaattaaaggattacactaaggtgagactaatcatggtgaatctggttgaccgcccatgaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagtgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtattaaaccaacattatcatataaacttatagtctaggttttaaatgagattccccattgtgtgctagttgaactaggcatggctaagcaattcctagtccaaagtctaatcatgttataacccaggctaacaaaggagaatgatatccaaaagcatggctataacaataggtaaccatcccatagtactattataaaacaatgcaatatttgaaagaaaacaatagagcatttgcaatataggatcaacatgttcaagtgacaagcatgacttgccttgctctgctgctggagggacctcggcgactatctcgaagtacaccgaagcgtcggaggaatcggaatctagcgacatacaaagcaaacattgcaaacaggctataagactactgaaacagagaacaaaaccatttttaatggattctacacatttttcttgatttactgagacttgaatggacttaaacggagctcggatgaattagttatgaattttagaaggttcactgtgtttattactataaaagaaaaaccttaaacaatttattgcgcaatattaaccagggctgacgtcagcacgggcggcgcggcgccgacatgcgggacccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgctggcgacggcaaccggcggcggaggcgacgcgaaagcggcggcagcggatggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctaccggagcgcgaggagacgggggttccggcggcgaacctcgacggggaaggggcggccgaggtagatctcgaccccgcgaacccgacggcgacgacggaacggtgcggcggcgaccctagcggtggctagcggcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgactgatccacgagcgtaggccgtgcttccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcgattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagccttcaaagtcagcgtagtacccggatatcagctggttggtcagctcatcatccaggcccgccatgaacttctcctgcttatcggggtcggtacgaacatcctatggtgcatatcgcagtgaggcgattgaactcgtggaggtactctgtcacggtcctgttaccctgatggagtgcacgaaattccctcttcttttgtgccacgaccccatctggcacttgtgcctcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctcgtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctgttcgattcgagctcatataaaccttccccatgatctcctctttcgtttgccccctttcccgagtcctcccgtgcctcctagcgccgtcgcgacgagctccaagtccgccgccgccgccggccatcttcggcatcgtcgcgccgccgtctccgtcgtcgccgtcggtcgccgtcaccaccgttaggtgcgccgtgaggagaagaagctcggccgcccctccgttttcgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctgctttggagattagatctgtatagccgggtatggttgttcaggatggttgggcctgagcagcatgggtgtgctgttcagtgttgattaaaattgatgattaattactctactgttttatttctctcaaatgttttgctaaatgctgcttttgcaaatgagcctatattatgccatcctttggaatctttgtgcacttgcatatttgctgtgtggcttgttgagtatgtcatatgctcattcttgcaataatcaatcaacctcagttgaagataaaggatccggaaggagaagacgtttggcttataccccagttgagctgcctgtgggagtggagccggagcttcgctagattttatttttccgctgcagtttccttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagttaaaagagaag

SEQ ID NO: 63730 - DNA, 8041 bp, Oryza sativa
tgcgccgcattactttcttattttagtaaatttatacacctaaagtttgtacacctcaagtttacacacctaaagtttaaagacctaaagtttataagtcaaaagtttatatacccgattcaaagttgaatttgaattcaaatattttttatatacagtatttcctatacatctaaagtttgtagacccaatgtttataagttaaaagtttatatatcggattcaaatttgaatttgaattcaaatactttttatatatagtatttttatacacctaaagtttagagacccagaaagtttataagtcaaaagtttatatatccgattcaaatttaaatttaaattcaaattttttatataatattttctatacatctaaagtttatatacccaaagtttataagtcaaaaaattatatacccgattcaaatttggatttgaattcaaatatttttttatatatagtatttctatacataaatttttcaaactttattttttttatctttttttaaaatttatggtgtagtatgaagagaaaaaggggaggagaaagggggagaggagcgtgttagaggggatggggggtgaccgcccattagcacacccgccatggactgctacaaaaacgaccaagtgatgtcttgcatgcatcccttttctgtttctaccatacaacaaaagtgattaaatggtaactctacttattaaacatggatgagagagaaatcccttgacctccactgtgcacaaggagcagtgcttttgaaagtcatgttgttctagttacatacaaattatattatagttacatgcaaattacagtgtaattataatatatttatatttgataaacttttagtaaaaaaaattatcgacacgagcaaacgcttcaggtggattagacccaagctatcctagagccaggtgctaaactctggtccaacatgtaaagtatggtaaatgaaggtggtgctaattaagtgaaaatatagtcagccctattttaatgtgctatatgttgcccacaatgaaatttacccacagatgagcaacattttccacaaaagcatgaaacggtccgataggcatcgcccaagcacaaaagaagaggccgatgggcaaaagagctgcatgatgtaaagatacataagatcatcacatgaactgaataatattttctattttcatcggaaaaaaataccattgttgaaaacagaaagtcatcactaagaaaatcttcatgtgctacagaaaatcaaatttctgatgtttagtgaggagtactaatagaactgaaacaatatggcataggtaatttattaatcgaacagtatggcagtcatcattggattccccctgcacaccaaggtttattaatcatggcagtcaatttctgatgtttagtaaggagtactgtagtaggctcttttgttcttctcctcctccaaagccggcaactgggcaacaaccagtagcacaatcgaacaaggaagatgacgccacctctttgagctaaccccaactctccggcgaccgacgtggatgtctatgcgtatgctgcgccaatctgttcaattgcatatttatgttccctaccactcaagaaaagtgagcccgagcaaaagaatccttaagtacgcactcaaaaatctgttataggtacgctgattgtaagtacgcactttttttttctttttgcttaattatacagttatacgtacatgcatgggatattagccggttttaggtacactataaaaagtgctcttgcgttacaatggaaaaaaataatgttataataatgattatagttattttatagttacatgggtgttatatgagattgtcctggacataaacaataaattaagtctatacctaaccctaaattcattccccttctctcccaccgtgagcgatggtggcggctccttcccccaccgcaggcggagaaataaaatgatatggttagatttaatttttattaaattaaccatgattaataacactctttgaaattttgttcaaattttcagagcttaattgctaattttgataatactaattatcatttcagtatttatttaaataaaaatctgaataaaaatcctcatttctctctgagccatttttagcccatttactttctcagcccacaactaaagtataattagcgtccctcaactcctctcactgtgttatgttggacccactggcctgccctcggcccattaagcttgcgcggcccagcagttatgcggcccgacctggaggcgacatgagcagtccgatatgatggatggcttggatctccttcgcgccgctgaagatgtagacgtgggaaaaccctaaccctaaccctaactttctcaccttctctctcccaatcctctatcccgacgacgagcgtaagcctcccctaccgcgaacgacggtggcggcgccctccctcagcacgagcagaagcggtgacagcccccttcccccatcgcgagtgatggcgtcctcccgtggcttccacaggcggatctggtggtgtcgtgcggcttcccgcgggcagatccaatggtgttggcggcatcccacagccagatccggtggcgacggtgacttcccacatgcggattcggcggcattggtggcttcttgtgggactgagataagatttgtgcgctttttattatgtttcctgttctttttctctttatttggattgtccgattggatttcgatcgaacttacggatgaaaaattgttgttacagacgaaaaattgatgtgacgaacggaaagttgcaatttttttatgtagttaagatatattattctatgttttaccatctcttcgatgcgtgcacttgtagttagagaggatattggccggttttaggagggagggtttacttaatactagatctaatctattggctgataataaagggtcaccaatttaaataaaaataaatagttggatgtattttttaaactttttatatttttttctaatttattagagtaccatatgatggcgtaggagcattcgtagattgccacataaaaacttgagagcgtttgtatgacatttaatggactttaaatatataatggatagataatacgtcgtccgtttcatattataagtcattttgacttttttaagtcaaacttcttttaagtttagtcaaatttatagaaaaatttagcaatatctaaaatactaaatttgttttattaaaactaacagttaataatacgtttgttttctgttaaaaatggttctatatttttctataaacttagataaacttttaaaaaataattaaaaaaaagtcacaacgacttataaactttaaaaaacttaactagaaatgagttgatgccaggcaattcatttggatggttgaattccatcaggttcatcggaccctggtgatattaatgtggctccactggtgtaacaacaagacgtctatggtgacttcgtcaatataaaaatacattagcctagtttttaaaggtgctcataggaatacggcatgcgtgtgtttatagagctgagtgggcaccactgttcatgcccccctaaatactgtgtacgccatatatatgtgcatattcatctagttgacttcagggataagaaaactgaacttctttagataatgatttggaaatgcattggccctaattaacatgattacattgtatgtgtgcgcacctaatacatttttgacgtagaggggttgattgaatctcagtgttgaaaaaatatatcgtgtgatctgttgttatgttaccctatcaatattctacaaacaattagctcaatttttccaggacacgttataaatgaagagcaacaaagttattgagttattactgttagtgatatgccctagaggcaatcatagagatgattgtatcacatgctatgtttacatatttatccgactttgtttcttgaaatagataactcattattggttaatgaatatgtgattctttcatgagactctttattttgtttgttactatttctaaatgatccctgatcaaatatcatatgtggaacaaatatgtttagatgatcagcacatgtattaattgatgatcatgtctcatggatcatggtataaagataccaaattaataatgtggacacatgttggggaacatgttgttggatagacccaacatgagacactgcaagagccatatgtgttgtgtcatcagtgatctcatttagtgttggtgttgaatccttagacctgagattatcatggtttccaacatgtgtagtagcttacttagggactgctaaacgctactatgtaattgggtagttataaaagtagttttcgggtatgccgtgaaacatgttgtgggatatgaataatcaagatgggatttgccccttctatggagagatatctctgggcccctcgatatcatagattatgcaagtgcatggccatgccaaaggtgattgaggagtcaatcacaagttatataatctatcacaggttcgagtgaatgattgagctattagaggatggcacatatctagcctcgagcttaatcgatatcgtgaggcaaaggggttcatacaagtatacactagaggttcagtcgatatgttctttatatatgcccggtgggtcaatacgttctgctaggggccgctgttgacacgtggaccaaaaaggagttttcgggttacagccgagtgtatatgaacctacagagtcgcacgcttaatggaccggaataaggggattggatagagatccaatatgagcttaattcggatagggatccgagtaggagtcctacgggccttggaggcccgagtgatggattctatatattcgtgaggggtgtgaccagcggaggtattgcatcacgtaagaaaccctagccatcactctcctcctcgagcaaaaccatagccgcgcgcgggtgctagcacatctgcgggtggcgttccgtccttgtacgtgtggataccggtagaggcgccgctggtttgcggtgctgatcggcgtgggagtacggcgaggagaacgcacgaggaggagaaggtcgagccggtgcgatcgactacttcctctacatcgacgcgcgctacttcgcgagagttccttcgacttagcgccttcttccgctgcgcagcgtgtcgagtggtaacgatctatgatctaatacttgcatggttgctggtttacgtggtagaaaaaatttgatttatgctatcgtagcctacgcgtatcctaacaattttcttaatttgtgagtatagacctagaatataccttgtatttgaaatcagaaaaaaaatcactagagaaaattggcaaacgaaggtttgtgaattgaacaaaaagcatgtaaatcaccctaaaaaaacatgcaaattatggttcaccttaatcaaaaccaaagtaatcaaaggtagggaaatttaacaaccactaatattagtaggaaggatatatagttcctagacctaccaagtacatagcaatgccaaaagctatcattggacgaagcatactgcagaactgcacaagtatgcgagacaaattaaatataccacaacaagctaattaagcacacatatatgcagtgtggagtacttcataagagtcttcatcaaccccacgcatttagctactgcagctctattatgccagcttccaggtcgggacgtgcagtgacaaagtcgtcattatacccaagcggaacattgaggtaagccggttcctgcggttcacttagtcccagaccgttgttgctcagccacatcgtaacctcgtgcatatctggtctatcgcccggatttttctgaacgcatagcagagcaatctgaatttgcctggttagctcctcttgaaactccaccctcaaataggggtccaaaagctcattgtatctcctatttgaccaaatattccaggcctattagagcacaacaaaaagttagtaccctaggcattacacttattaatcctcctttggagtgaagaaattttaaaggaattgaagtttgtgagaattaaaatagttaacgtaaaattcatgcgctccaaatgtaatgttaactagaggaagaacttcacttacataagtaagtagatgaatgatctgccatgttggttaaatattggagaacgaaccctcctgccacttatgatctcaagaaccaaaacaccgaagcgaaaacatcgtattttggggtcaaatccccatgtatatactcaggcgccatgtaaccactagacaacagcaagtataatcatgtcaatatataaataaattagtgcttgatatgttagcgaaatctgttcaaacattgctcattacaatataatttatggatatagatataaagtagagattgttcatttaattttgtgtgagtgcgcagtgtacgcccgtgttttggttggggtggggtggggttgggttggtaagtctctgttaatccaaaacataaggaaaaaatgtaatatttagcttcccacccaatatgagattcatattgatcatatatatcgaatcttcagtttgacttaattagtttttagagtaaagtctagctaccccttcgactatcatataaatttataaatccactctcaaccatgaaaccactaaaaggaaatagatatttcttgacaggcacgaaccatcaaggaaaacatcaaaatcaccggtacattttggaggttttattttggcaaaaaaaaaattaattggtcgctatgaaaattcaaaattctgatagtattactgataattacacccatcaactatacatatcaaaactggttaaaatatccccttcacgggtaatccaatctagtattgctaagtttaatattcaagttaaatcattttattttttcgttgacatggcactcaattagaaatagatatcagtaaagaacagattatttaattactagctagacatcaaaaatattttcaccggttttgataatggaagggtgtgtaaaatttcaggttccatagctgaaggtcgattggggtgtgagttaaatggacttcactccagtttcttctctgcatataacaggctcttgactacttacggtgttcctactggatgagtcacgtatggttctgttccatttaaacaaaatttccttgcaatcccaaaatcggaaattttgggattattttcactgtccaaaagaatattgcttagcttcatgtctctatgaataattataagtccttctggagcatggttgtgaaggtagtcaagtccttgtgctatcccgttgattatatgccgtcgcatgaaccagctcagcgatgctcctctttcacgatctgaaacagataactgttgtctatgagtatatataaaatcaagtaatgttctacgaattttcaatcggtgctatctactaacgaccattatattggcttacctgacaatacatagtccaagctcctgttaggcatgtattcatagacaagtatttgttctttgcggttaacacagcaaccaagaagcctaaccagattggcgtgttgaagccgtatgataatcctaatttcattcaaaaactcctccagaccttgccaagtagtttgatcgagcctcttggctgcaatctgaaggccgttctgtaatatgccctgtaatgattcatatatttgtttcaaatgcgacatgctaataactgttttttcatctaatatatatgtcccttctttctataaagctaatacccactaaatatctaaagctcaacatgcaatcataatatttattagcattcttaaaatctaacatgcaagcataccacatcaatcctctaagcacacaaagctcaacattctaaaattaaacatacacatgctaaatcattattttcaaatcattttcactatatttcaattcaaattatttcaccatttctacaatatctaacatatatatcctgcagcaacacgcaggacaccatttagtattatatacaagtgtactgcaattaaggtacaac

SEQ ID NO: 63731 - DNA, 8721 bp, Oryza sativa
cctgggtccacatgtcagcctcactttccattcaaacaaaagtgacgtgggatccggtgatgggtgaggctgacatgtgggttcgaatagtatttgggaataaaaattttggagagtggtatttgagcactgacattttgggaagatagcaaaaactaaattctccccatgcatggttcataggaagctctactaaccaatttatcctatcacactgtgattagggattgttgcttgcttgctttgtatctctgttcaagtttttgtaagaaaaaattagttatgttacactgttggacaaagtcttagcagtaattccaataaaaaaacaaattagttatgctactgtaggatgttactgtagaaatcatatcttattactacgttttcatagtaacattatcacagaacggcagtaatattatatgttaccgtaaaatttgtaggttgttattgcacttttggcagtaacatcataataaaaattgtagaaacagagacttgtaatagtaacagtgatgctatagtactaatgcttgtgtagagctaaaatcttttaaatatcgatctttagagagcaatatctatcacatcatatcacatcatatcatgcttttctaacccgaatgcaccatgacgttcgtaaaaaagttcttaacgaaattagatcatcatgattattttttgacgtcattatggtggaaagcaatcatgttactacacattagtcatcgagttactacaccattcctacgtgacgagaacttgaaaaaaaggtaaatctaaagattaaagagcaatatctctcatgttatatcttgtttttctaatccgtttgcaccatggtgttcgtaaaaaagtgcttaacgaaactaaatctgtcatgactattttttcacgttgttgttgtaaaaagcagtcaagttacttcacattgactgtcatgttactacatcaatcctgtgagacgagaactgaactaagctgggcgtggggggagacagcgcaagcgggtttgactggggtttgtgcatagctaaatttttaaatctcaatcttgtgcaaagtacaagtgctaaaaacttcatgtgcatggtcacaagttgacacaagtgctaaaagtactcttttcccacacaaagatacataatagcaagctaaaatacaagtaatacttttaaaattatagtcttttaaacaatgatatctctcaaattacatgttagagaccttttacggtgttcgcaaggtatttagaggtacgtggaggtggaacaacgagtaccgttgatcaagataggggcaaggtaccgaaaaaaattatggtaacatgatggcagtggagtaattaactagtaaaacatgggtattatatgtgaattgaatacctacatccatctatcagtatatcgttctgcagatcagtacgccgttcatgaggaaaaaaaagtaaattacagatacgacgttgattctgttccaaattaaataaacagaaagatctaatctcctttcttctttcccttcgtttcgttcttgttctggggtttgattggttaaccggaaggagacaaaggaaaaaaaaaatgtctacatggttgagggttgaagaggagatgggattgcccggtcgacgactagacgcaagctagcacatctgtaaattatcatatgcttatttgcacagttgatttgttatttatgtagttcataacaagttcataatatatgtcattttgatgttactgtagatctcatgttactatagtaatatatatcatgttactataataacaagttcataatatatgtcattcaaaaaaggtatagatcatgctgcctccattctataatataaagtacaaccacttttttagatgttccataatatatggcatgcatacaagcatgcaattaactgtggcatcttcttcattaaattataacttttttaaatcctccactctcatattatctaatcttattggatgcatgcattatatttatgtggatgatctaaactacaagatgataataattgtttcttggtctttgggttaagggtggttgtgtcttatattttatattttagaataaaggaagtaatagatatatgtggtgtgtctcatgttactatagtaatatattcatgctgatgttacactgtagccgtgtgataaaagatttgctataatgcagtaattaagacagtttagagtgtgcagtaatagctatcatagtgtcggtactacattttgtgccaaatactgtatttattagcacatgttataagataaaatttttctaagaaatatctatgacagttcagacatagtctacaggttaataatttgttggaattgaattaaaggtcttgggtttaattcccattgaatgtatattttaaatttattttgtctcttttgcatctccaaatagaagagatagtagggtgccggcactactacagaactcatttttccatgcgggcatatccatttttccatacggtcgtttggcccgcatgcgaaaatcagtattttcacgtgcgggcgggccgaccgcacaggataattgattatcccgtgcgatcaaattataataccacctgcatgaaaacaaaaaaaccaaaaataaaaaaaaagtgaaaatcgccgcccacccgcggccggcacgcaaccggccgccgcaactcgtcgtcgccgtcgtcgcgccgccacacgcacccggccgccccggtcgccgcctcgcccggtcacctcgaccagccacggccgcccggtcgccgccgcaaccagccacggccacctagtcacgtcgccgttgatgccgcccgccgccgccgaatccaggggggggacggcaaccgctgccggatccaggcgcggaggctggttgccgtcacgtccacagtcgtgccggccgccaccgctgccaaatccgtgcaggggatggccgccgcctccggatccgggcgcgagggggccggttgaagtcgcccctcgccgctgcccggtcgccgcgccgctcgccaacgtgcacggtcgccgccgcctcgcctcgtcgacaacgaaagtcaagagaggagaggagtgaaagtcgggagaggagaggagaggaagtgagagagatagaggggaggaaagtgaaaataaaaaggaagagagacgaggtgtgaaaattttaaaatgattgagagggagaggaggtgtgaaaattttgaagtgagtggagggagatgtattttcgcgtgcggtcggcttatgtcgcacgcacgggaaaatgcattatccggtgcggtcagggatcgcatggaaacaaaagggggcggcatccaggaaaatctatcatgtagtagtgcgaattgagagggagggcgcgtgtgagagggggagtgggagagagtggatggcggattgggagggagggcgcgagaaagagagagagagaggtagggaggatggcgagagagagagaggaggggacggacactaagcatatatagagggggcgaggaggggacatattttatgacattgttttagcacaagtttgtacatgacatattaaaatttatcttgtacaaggatattatgtacttttaaaaaaaaaggaaactaagcaatatcaggaagttcaattagaggttatgtaatattatcaacttactcggtaaacttgaccgaaagatccatgcccaagtctattttctgctgagaaattttctgtggcatctcttatcatggagaaaggataaagtgaaaacctttcatcaatttcttcggtaacggtcttctcccagtcacctaattctcttcttagcttgcaatctgcttttacatgtatataaccaggaaaaggttaggatttaatatttaagataaattttggtatgccatatgttgcaacttaacaatatatatataccatacatatgtatcccattcattagaaaaacaacattgagccacatatatatatgatatgttaactttcctgtggtgcgtaaaaaaaaccctgataaatacatctccttaattagtcaatcgagagaataaaaactttaatatcgccagacgccagcaagaacggtacaccttatacctcgtattttctttacgatgaatccaattagaatcaaaggaagaacaggagtaacaactccagaaatggtgatcaatgcgatatccgttttgctcatgccccctgcacacacacatatatatatatatgaaaattgagcacaacattttgaaaaggtaaactgagtgctgcactttgcatgagtgagattctcagaaaacttctgcaagttaaattttaaattacatgcttgtaaagtgatacaagcaacgagacgacgtctcctcgagagtttaaaattcactctcgtttagtttcggacgtacgtacctttctgttttggcatatgaatcttgatcgtctcgttgctttctaggaagaagcgatcgacctcgtacctcaggttgcaccggaccccgagaatccggccgccgaggcggtagtcggcggcgccagtgaaccacctcggcatctgcgaggcgatgccggagaggcagctcaggcagccggccggcgagaggtccggcgtgcactgcacgagcgcgaagatgacgaggtcggggctgcttctgcactgctgctcaaccagcccgaggcgggtcgcgcccacgtccagctccccgaacccggcctcccccgtcgcgtacccgcgcttcgacgagttccacgcggcgaactcggcggtggtgttgatcagctccatgacgcggtcgccgaacgcggcggcgccggccacgccgttcatgttccacgtgacccacgccggcgcgttggtcaggctggcgcggaagtcctcgccggagaaccggaacatgtgctcgtcgtagtagacggtcacgtccctgaagccggcgcagaagacgccgtggtcgatggcgtccctgaacgccttgcggaggccgccggcgcaggcgtcgccggcgtagtcgccgcggcagagcgcgatgccgtagaccgcgtctggcgcggcgccgaagctgtcggaggcgaaggcggtggccctcgcctccgcgaggagcagcgaggccagcgccctgaggttggcctcgtacgtgctgttcggctcgtacttgccgccggacaggctgcagttgtagtgcagcgggttcacctcctgcgaggccaccgcctgatcttcaccgccggccgccgcccatgtcggcgacgagaggagtactgtgacagcaaggaggaggaggaggatgtggagttgcatggcactggagagtgtgtagagaaattattagagggctttactcttgagagcaagttgtatgtgtgctacgtatgaatgctcctttgtgagcgtcctaccttgcattatatataggagcaatggagcatgtatagaaaatttcctacaatcccggcggcgctacaacacacaccacacatcgaactttcttaatccttttatgcgtctgaattttgtcttattttctacgtaatctccatgcctatttcgttagttttaactgtaagttaatcgataaatttattttctaaaaatgactacatgtccctcctttcttatacttttgtgttacatacttcataaatctcatgtcaaaaattttaatttagagaaaatttcataaaaccatagatactttgaccaaactatcacaaaactacaaatttaagaatgtatatcataaaactacaaatctagagcgaaatttatcacaaaactacatatttaaatcattgtatcataaaactacagatttagtaatgaagttatcaaaaaactacagattttagagtttatatccatagcacttgtgacatcatggtccaattaggaaaaggcttgtgtggcctatgtgagctgtgtgcgcatgtttagtactaccttgctagtttaccatgagtagaaccaacttataaggcctcttccttctaaccatatcactcccgggttaatcctttcacacgaagtgatgacgtaagtgtagttttgtgatagatagattaaagtatatatagtttaatgaaatttactcctcaatttacaataaaatcaaatggatatgattatttcaacaaaaaatgataaatgaattttatcaatttgaatatttaattaaattagtataagggtttcggctagcaattgagaaccaaatttatttattatttggttttaaatatttgtgaaaatttattcaaatttcgtcaaaattaatttaaaatttatttaaaagtttcaattttattcatttcaatttgtggtcaaataatttagaccctttttttttagaaataaatgttcttttttacttgaggattgagtttttatcactgatgtagcacaataaatatatatgagagaggaataatatagtcactttgaaaaattaatagccaacgcacgttcaactaaccgaacaagtatacagggagcaaaataaaattttagagaaactagaaaaatgcccatgcgttgcaacgagtgaaggctattttaatcttattattgttatacggtttagctacggtgaaattcactgtgggaattcgcttgatattctttttacaaaattatgagctgcaattaggggtccgatcgtctcaagttagcatgaagttttttaaagagatttcttatacgactccttctgtatttttaaaaataaacaaaattaaaaaccgattcaaacatgtatctgtatttgcaaaagcgattgaacttaaaaaccaattcaaacacgaatgacgtaccaaacgtaccgacaaaaacatcttcaatttttataatattagagatataacaaatgaggtaaaatttaggaacatatataagggaattgagcaaatttttatgtgcacgtaaggaattttctcataagagtaatatacgaattagatgcttttagaagtttacggtatcaacatcaaaatttcctataaatatatgtcgatgcgcgtgttcaatgggccgacatattcgtggattagtcattagtgtatgctgcgggatcgcagcaacggatgcttgtgctgttgtgcatattccctgtagtaatagagataacggattttgttaagaggacagctgttgagcaacctatggtttagtaaaatgtgttctactacactgtcgaatttacagctgtgttggcttaaccggctctgtaagccttagggcatgttcaacaacagagtcaatcttagacaatatatatttatttttagagactatgcttgctattataatagttaagaaaataaatactttaaccattattaatcccaaaaatatttttcattaccccttccatgccccatccccaccccatcctaaaatacagcagaacttccatttaagcctttgttgagccattgttaccataacaataatgtcagtggccgagtggcggagctagtgtgattcacgggtaaatatgtgcccctaaaattttagcaaagtacccattatttacccatatttatacacaagtgtatgcaaaattgaactgaaacaaattaaaggcccgttgcagaaaactcattgaacttttacagtatctatgccatttgaattatctttacccacaacgaatggcatcggcgagcgagacactagggatagagagctgccgaatttaggtcgagaggatccggttgaagggaaaggcagggtggcaaaagagatagtcataggtggatagaaagcggatgcgtgggacagcgtatcaagatcgactcagtgcggttttagtgtggcagggcttatcatgcaacataagggccgaagcttagctttctagtttgtttttctttgtctttgttgttaagtatacataaacattttagatgtgtatatcaatttatacatatagagaccggatttctattcattatttaaaaattgtcaattgaattatctcgtcgatttgttggaacgtgtcgctggcttaaattgttggttagtcatataagtgaacctccactttgaataagtgaacccccatcttctctctcttccatgtattagcagatgatactaattagaaaatctaagagccttctattaataattattgtacatgcactatgtttaaaacgtaccatatgtataattatatactatatagaatcagtgttcttggagattgtcacgccccgaactagccccgagcggaactagcccgtgacgctccaaattaacctgttaatcaataccagtcccaagaaacaatgctggtatcacaggaagacagtatatcatagcagcagaggtctctttattatagagtaggagtacagtcatgttgggctgcggacagatcccgagctcataactacattataatagggaaagcggaagccaagacttggaccaatcatcacaagcgtgacttgggaactaggccgaaaccctaaaactcatcgtaaccgacttgctcctggaagaactcctcgtcagcgggatccacatcatcttcttcagcgctggggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgagacagtg

SEQ ID NO: 63732 - DNA, 13530 bp, Oryza sativa
aagaaatacttagatttaaattataggtgcaagatgatgaaaggtgacttgccttgctcgagatcttgagcttgatcctcgaaatcctcgcactgcgggtcttcgggctccgaaactacacgcgaaacgggacaactcaacaaacggcgaaaataagccctattattgacctctaagcgtgccattagatagatctcgagatttgaggaattttggaagttgaacggagtcaaacggacttacggttgggtagatattgaatttctaagattattggatttttgatctaaaggaaaaaggatttaattaaacccttttgaaaaagaaaagaaaaaggaaggggaaatagactttcctcgggcggctagggcgtggcccgagagaaaaaggggcggctcggccgagcttaatgggccggccggcccgagaaggcggcccaaggcacgcgcgggaggggaggagagagggagccggtgggccgggtccatctcgcgtggtcccgagtgggacccgcttgtcggcggctcggctcaccgtgagcgaggagcacgcgacgcggcgctagggtttgggcgggcgcggtgcacgcgcgaggctcgcgggtgcggcgggcccacgcgcagcctcaccgcccaccgtggaccacgcgcacggggagggtggaacggagggagcggctgaccgggtcagccgactcggttgtgccgaggtggcaccgacgtggcgtctacgtggctgccacgcgggccggctggaggaagacgaaggcgccggccgcgaatggacggcgggcggtggcggtttctccgggacgccgtgcgacgacgaggggcgacggggtgtacaccggaatgacaagggggaacgagagggagtgagccaatggcttggattcaccggaggatgctcgacggtggcgatttgcggcggcggccaccggcggcaggaaaagagggaaacggcgacgagacgactagggttcaattcctccggactagagcatctacgcgacctcgggattcattcctagcaccggattgggcggagctacgccaagagaagctggcgacgagcggcggtttgcggcggcgagcggcaacggcggcgaggccgcgccaggcggtgggaaggtcttgggcggcgcctgcgagcttctaggggaactacgagtgctaccatacagtctaaggggaggaggaggagcgaagagggagaacggggagatgcactaccgtgcgggcgggcgcagtaacgagagccgacggtgcggaaacgtgatcgtttcggcctcgagccgaggaagaggagggggagggcgcgtctgaagtccccttccgcgtcctcgctcgtgccggctcctccgacacgcacgacgatgaacggcgacgacagaacaggggcgacagtggcgtggcggcgagagacgaaaacgagggagattggaggagggaggagcttgggtttataagggcgacaatgtcggtttgggataggggaaccgacattggacggtcaagccggcgagctggtgcccggctagcggccaaaacgacgacaggaggtgacgccggcgatgggaggaaaaagaagaaaggaagagggaaagggggcttgcctccttgcttctttgggaaacgaaagagggagagagggcgacgcggcagaaggaggaggagctctgcctccgtcccttggaagctagcgcgcggaggtggcggggccgggtcgtgacgacggcgatgacggtagacgcggggcaggcgcggcaggcgctgacggcggcggcgactggccggtcggccaccacggggcgcacgcgcgggaagcaacggcgcgcggcgatttgagcggcggcgagagcggagaggaagggcgctcggcttggcgcggctcacgtgcacgcgcacgcgcggacagagcgagggagagagggagagagagagggagagagagagaaggagaaagagaaagatgagccgagagggaatcggcccaccgaacctaagggaggcaaaatagacttttgtggaggaattgaattgggaaggaaaattgagattagggatttgaattcgacgatggatcggggattcgagatccggaatggcacggagactgactgcaagcgaagaaacaattttcgcaattagggtttttagaatttaaattttcccgttaggcgccacgacggaacgggcgctacagagatcgacttggatacactagttaaaataaagggtattcgcagcttctaggcattcctttctacgtatagacggttgaaaagttcagctatctatggtaatgcctaggctacctgtaggatcaaggatcgcctgctgaaatatatctattaacagtttataaaaaaaatacatatactagaaaataggtgtgcgcagttgacgcgtctaacactttaaaccctgtgtgtagtgtacatttctttcgaaatagtagtatatacaattttagtttttttacataaattagtttgatttctataaattactataaaatattctacatttgtcaccctcacgttgttgcctcgttgctgccctccaagccgttgtttcctgtcgtagctcggcattggtagccaatgttggcactcacgcacaaggtgagtgggaccttgctcacccaccaggtctactacaggggtaagggcaggtgaggttttccacccggttggctctgcagagctaggggtgaggggagaatgtggggagcgggaacacggtgttcctttcctacccagccccatcccgccccattgccaccacctctactaattgtttggtttttcgattttgatattttgatgaaccaatgaatataccattaataaaacatcctcaaatatgtttattattttaatttaaaatgaaaaaaattgtgaagaatttattatgaatttgattttgtgctatccatattcattttttatggaatttatttatatgttacttgtgaactgtataaatatgccctgattattttggaagacaatatttattttgatgaaagtgtcgacgggggatacccgtagatcggagaaatagggtattgggctatacgacatcaaaacaggcaaaagacaagggttatactggttcagacccctcataagataatagccctgatccagtttatatgagattgatatgaaaaatcacatagtacaaagagaacaaatgaattcgacaatactggcgagatccttgtagagatggttcgacgggatctcccggtggcttcggcttgcgtcctccggcttcgtagactatggtgggtgtgttgatgctatgattcgatgatcccgaacccctcccggggtgtgccttctataccatgagttgccttagtctccaagtagaactcggaggcaacaaaccctgcacgatatagaataatccctatcctcttcgagtaggactctgataatcgccagcccatgaggatactttccataatatattgtatactttcttatcgcataatgaaatatatagtatagaagatggtatgtcaatcttgcatattcggtaaatcgtaggataggaggtatgcctaggggtgggcaaaataagaccgaaccgaagaaccgaaccaaaaagaccgagaccgagaccaagaccgaaaagaccgagatcgagaaattctgttagtagttcggttccagccatcaaaagaccgaatttatttcggatatttcgatcattgggctctgttaaccaaattaaccaagaaaaccaaattgtggcccaataggcctaggaggcccattaagcccaataaattgcaaaaccctaaaagtccctactacctcagtccctcacttaccagcgccgcctccatccatccccaccccatccatcatgccgccttccgcctcggcgccgatccagcctccgccgaccgccacggtcccgagtcgacctcgacgagcgccgcctccatcctccgccggccgccgcggccctgacgagcaccacctcccgcctccgtcgaggtcccgacgagcgccgccgtttgcctcggcgccgcctcccgcctccgccgcgtccccgacgagcatcgctgtccgcctccagcctgcgctgcggccacgaggaccgccgccgtccgcctccagcctccgctgcggccacgaggaccgccgccgtccgcctcggcgccgcctccagtctctgccacggccacaaggagcgccgccgtccacgtcggcgctgcctccagcctccgccgcggccacgacgagcgccgccatccgcggcgcgcctggctagcggtggcgtggcgccgttgcgatagccatagccatggcctcgccaccagctctcgctgcccacacctgcgctgttcaagaattaggttagaccgagaccgagacggaaaaaaccgagaccgaatttaccggtcctgagtcggtcttgagttttcaaagaccgaaatgacctaagacagagaccgattttttcggttagaccgaacgcccacccctaggtatgctttatccgtaaccttgacagaaattatcactgaattcacatcaatattccctacttggtatctagaaaaaaaaagtggtagaccaatactgtatgtctacaatagtagagatatttaactatttatcatttttagatgtgacaattaactatttaccactgaacgcatgtgtctatgcatttactgcttatagcctacttagaacctctgtacctccacattcttttttttttctactgacacgtgtcgacattctatttctgattatctcagccaatcagctcgcacagaagctgccagagtaattgattgattgatatatgatgctgaccgattgttgacgtttaagtgcgtacgtatggaattccatatctctatcggtccaacaatcgatctcgcactattttatattagctgaatgtacatataggagacagatcaagcaatatgcccactggatacgctatatatattcctttcttttttcttagaagaaggggacgaccgccccccgggtccccgggcattatgcaattcactgttcttaattgtcgcagttcagccattgtttgacttgataggtcgttcgccttcttggataagcaacgcagagagtcagccgtatgcagataaaaattacacgagctgttcgattcgacgagataaaaattacacgcattgttgcgggacacgtagaaagatagataccaaattgagtgcgcgggtcaagctaagcaattggtcgaagaatcactaaaaggtcaatatgttctggaagtgaaagctaattaagcagagcagtccttccgttttaagttacttgtcagttgtcatcattctatttatcataagtctttgactatcaacttttataaactctgaaactcatgtagtttaacactacgagttttatattatatcataagaattatatatctttataatatgtaattcacatgttgttaaactacatgaatttctaaaatttaatggtcaaagataaatatgtttttatttaggataaacataaaaacgacaagtaatttaggaggaagtaatatttgttggagtttagcaagtgaaaagtaaactgcatagcacaccgaaggcactgcacagaaaatgcataaatcctgctgatatacttcatccgttccacaatataagaagttttagagttggatatggttattaagaaaactagaaaggtagcccgcgcattcgtgcaggcatgtagaagatggtttaaaagaacattgattggatatttattatagatcttaacttaactaaatatatatatttgtgaagtaatatattttacctttatattgtagaaaatcatattttaaataccgttgatttttatgaatgtatgcttattctgtctttttttatgtacatgtatatgttttttttccagtgaagattaggaaagttttgttttcaatcatgtacaatgtttgtatgtacggaaagaaagcagtggcatttgtaacgtaccaactcatacgtgtacctgaggaagtcattattttttaataatagatctaatctaatggtgtaaaataacgggtccaccaatttaagtgaaaatcaacggtgagattaaatagtgccatgtggcgactttagagcgtttgtagaagtgccacgtggcagcataagagtgtttgtaggaagtttaatggacttttattaaataataataaatagatatgtagaagtgaatggtggagggttgagattgaatgagcagtggaagtaggtgggaaaaatgaatggtggatgattgtgataggttgggaagaaaatattggtggagaagttgtaatattttaagacaaattttgatggctaaaagttgttatattttagaacggcgggagcagctagcaaggcaacgaaagtttgctggtctatcgcggcagctttagaaaagggcctatcgtggcagctttccaaacgatatcaatgtcggttatcgtattcgccagtatcgctgtcggttcagctgaaacggctatgatactcatttacacgaaaaagaataataaacgcactcgccaccatcacctgccatgtttgtcatctcccttcagctgcgcctcctatattcctctcatcgatctacttccacctccacccttaaggatgattgtggtggcatcgctggtggtgtgggtggcggactggcggtaagcgctgccaggtagatcagtgaattaatgagaggaaagaggggttagagaggatcgagggagagtccgggaagccattcagtggggatgggtgggggcatttagtttttttttttttttacaaaatttgctacaggacatataaaaaattttgtgtaattagctatgggacacggtaataaaatgtgtaatttgcatcctccattgcatgcaggacgtccctgctgctgccctccaccgcctacatgctctccctactgctggcccacgcctcctctgtacgccctccaccattgccttccacactccttctcagctagctccagctccatcctcaccatcttcctcacgtgctccacgtacgcctggtgtgccgacgcttgctgcatctgcatcaatagtaatagtagcagcacggcgagcgtcactggccactcctctacgttcacgtacgctcgacatgcccgccaccaccacgccatcctctgtaggatcgaatcacaagaactaagccaaccagagggggggtgaatggttggtatacccaaataccgaaaacttttagtggaaataaaagttacccttgaaatcgacggagatcggtctgactgagattgatctgtcggtctgaccgagtggatgccgccggtctgaccggtgttgaatctccggtctgaccgccgaagtcgcctgccgcgcctgtcgcctccgctggtctgaccgccgcttgccgccggtctgaccgccgcttgccgccggtctgaccgccgaaacccggtaaacacaaatcgaagaactcttaaagtggatgacgactttattgattctctctgtgtttacaaagtgcatcaacagcactcacaaaaatttcgactagactcgaaaccctaactcaaaactcaactcaattactctctaaagcgataccgggaagcctcacgctccccctctatttatacatgaggtaggcagcctaaagccacgaaccaaactcatactaggagtcctaaacaccttagtaaaccctctagtacaaaaaagaaactttacataaccaatcgtatcaaatttggactccttccaaattcgactccgcatcctatacgcacacaataactccatcgtatgccatatggaatctccatcaaccacgtgcatcaactctagcctaagtatcccacatgatctctgaccaccacggacgtcgtcttatccccaagccgactcccagtccatcactgcaaatactctcccgagacatcgagtcacctacacatggaacaaacaaagaaaccatattccgagaccaagctatctccaacttgactcattagcagcaaacaatagtattacatacgtatactatccatctagaagccataattatgaaataatcacggatatccaaataaacaacccgaaatcgaaaccgacacagcgtcggccggtcagaccgcgggctggccggtctgacggctaccagagcccggtctgaccggtcacataaaataacgaatcctgcgatcacctgtgaatccaatcatctccaaaaccacttcgtgaataaattccaaatatcaaaaccaataatctccaatgcccaattgttcatcacaaaacaataatcaaaaaacacctttgattttacatcctcctccccaccagacccgtaccatgcggccgacgtcgcctgggcgcccatccgtgccgctgctgcgccgtttggcaagaagggcaagctggagttctgccccgacggcgacctccactcgctccaccaccgtatgcccgacagccgcttgcccgcttcctcgtcgcgtcctccaggttctatgccgtcaaggttctcctcttgcttgagtatctgcacatgatggctaggttcaagtccagcagcagggatgacctgtagcggtggaggccgcgaactgaccgaaagaagggggaagaagacaagggcaaaactatcattttacatggttttctctcatcaattcagtggatattatctctatctctacctctactattataaaaattgttgtaaatgtttccgcggggatttcagtatgtcatctgtgtttgagttggtttctaattttatctttatctattttctccatcttcccttttttcgctgtttttttttcgatttggttttttccgtcttttttcgcttttttcatccggttttttgtcgctgttttttttccatccagttttttttttatctcatccgatctgttgcaaaccaccgccgcttgaccaaaccctagcgccatctcactttgatatgtctcccccatgaacctccaattgattgcaaaagtcgattccccacaattgattgcaaaagtcgattccccactcctcccttatcattttttctcaccgttttcctttcaattcggctttagttcactggatttagtcttagtcgccgatgatagccgaccgacctttttaacccgaattttgtggatacgttccgatttagggaaaaacaaaaggaggagatcgagtggatcaaaagacctcaaccaattttgggatataaaaaacatttggctagatttgatggggaggattgactccggcgtacgggcacatgactatctagaggttgaagacgctagatgtgcgagctgggcctataactccacttatgagatggatcggagagagtcagggtagtcgactgtgcgagttgggcatgtagctccacttgtgggctggatcggagagagtcaggtcaagtaaagggaggtagcgaactgggttgggactgaaaatgaaggaaaggatgggctttcggcccaaaccaaggaacatgttttattaactttttcaattacaatgtatatatatagtgatcctaacgattcaactcattgctcagttcctaattgcggttctaccactgaaaaacgtttttacccgttgcaacgcacgggcattttttctagtattttaatacgttcagtgtcctgcaacaatttaccacacttttaaagtgttctagggcaaattcacgtctttacggtgttttacagctaattacattttttttttgttgtcctatagcaaattttgtctagattttttgatgccccatgctcacttattggtcaaatgcccttttttttttcctaatttcctatcttgagactctatttttagtgaacctgcagtgattggccgatagtattagctttttgttttgtaatatatatgctcgtttcttgtgcatacggggagttaaaatctgcatgtttctttattctcccccaccatattgtcacgatcgccacagaatttggaacttctagagggatcgtgaggaaatcaggaagcacgagaggaagaagaaggtagttgcgacagaatattgagcaggaagagagaagatttgaattgagtttgagatattttctattacaagtcatctctctccactgccgactttatatagcatatcattattaggtctcactcactgaaattgggcccagccgatagctactggacccacactcctcccacatatcgtgggcatcactagcgtcctgtcagctgatgtatccaccatgacacatatactcacattaaataaaatatatgctagttaagtttttattggtcttgatgaaaaaaaagttactatatcaagagacgaaatggtttgttgagattcgcggcttgcttggaatgctattaattagttctgaacctggtacagcaaaaatacaacaatagactcgaattttccttttctaataattttacgccaagtggtatgtttgaaaaagaatcggaataggtaaactttaaatattacgaaccttcttttccttggaaattaacatgttgcgttggacaatgacgaacggcagcatcactgtaattgctttagagaaaaaaggttttttcaccctatgagtccattgtaactcaacaatcgaaaaggttgtttgcactagaatagggttccggttctaactaaggtaatactatctccgtaataaataaccatgcaagaacgaagaaatctccataaaacaaacccactaagcaaaagggcactcctccaaaggcttagaaatttctcatcctaatcaaacaagaatatacaccggtcaatcatgattgattaaaaatatatgagttgagattaattcgaactcaatacatacgttctaggaactgacgaggtgataataccatatcaagattcagtttttccttttgagaaaattggaactgtatttgggaccaatcctgaagaaacaaaaataggaacactatgatctactccctccatccagtatatcactaataatgattatctaatccatattcatagtaagagccagaggttgtatctgatctaatattatcgaggcacttttgtagcttagtctgtctgtaagaactattatggctttttaatgaaaattgggcgcaagcctttcctccaaaatattatcgaggcaactacaaatcgcactgctagctctgaactgagcctatcactgaccgcgtccactccgtcgtgaagcgggggctgctgatccgcgaccagtcgcacgctgccgcgcgcgcgcgatcagctgccccctctagtctgatctcttacctatataaacgtactatatgccatatatacatacgtataaactttatatacgtatatacaaagtttatacgtgtatatatatagtatatacatacgtgtgtacatatacataattttttatatgcatgcacttttaatgtataaaaagatatacacatgtatataaagtttgtgtgtatatacgtatgaaaaacctaaaaaaatacatgtatacaaactttatatatgtgtatacaaactttgtatacgtgtatataaatttggtatacgtatgtataaaaacccaaaaaatacacatatacaaactttgtatacaagtatatagaagtttgcatacatgtatacaaagtttatatacgtgtatataaagtttgtatttatacgtatacaaagtttgcatacatacgtattaaaaaacggacaaagagaaaaatatacgggaggaaaaaaaaaagaaaaaaacgaaaaccggaaaagatacggaaggaaaaaaacagaaaaaacaaacaaaaaaaagaaccgtacgcccgtacgcgacgtccgaaagatacggaaggaaaaaaaaacagaaaaaaccaaaaaaaaaaggaaccgtacgtccgtacgcaacgtccgccgccttctctatcgtgtcgcgcgcgggagggctattagcccacaacacgaggaagccaaaaaaaaaaacagaggcccgtgggtttatagaaacagtttgggctagaagtagtaggggtgaactcgccgcgcgactaatagcgatttcgtcgtgaagcggcacctcgatcgatcaatcacttgctcggtgctgtaaaatccgcaacacccgtgaatcatatcgctgaagcgcgctgctgccgcggcaagcgatcgatggtgtacgtggtgacaggtgagaaatcacacgagggctgcatggactcgatcgagcacatggaggcagatggatcatatctcgtcggcctgattaacagcaaccatagacgggacaggccagcccaccacttgcaggggcagatctaggggtggtgctgggtatgcaccggcatacccaaaaaaatcaccaaagatccaggatgtataattgtattagtatgctgtatgcagtgagcctaaacaatatatgggtatcttattgaacgaagaacaaggaccaatagatatgtgcgtttgtgttcctgttggggattggccagtgaaattagtaacttttgcggagtcacagtagggctttcgcgtgcgggcaacaacgagcaagcacgacgtacggccgcaagagctagaaggtgtagcgcggctacctgctggctgtgctacaacggcagtagcaaatttacaaatttgcagggctagctgttgcggtgtcgctgctgcctgctggctagttagtggctacgtacgcacgctggcggaggagccgcacagacggatcggatcggaggaggcggtgctagctggtgcatgcatggacgatcgatggacggcggaagacctcaccggcctgtgcacgccgcgcgcgcgcgctccactgcttgctgtcgatcgagtggaagaggcgggcgggccgggacggggacggcgcggccacggacaacgcgacgctccggccggcctccgagaagaggtgtggttggtgcggcaattaattaacggaggaaactccaatcagatacgcagacggacaaaaatcggtagaacattgagatcaacgtacgtacaccaatctccgatccggaacgacgcgcgcgacgtgcgatatggaagctcgaacacgatatcgattaggatgcgatcgatggatcggagagaagatatataacgagagagatagagatctatcgcatcgcatgtgtttttcgacctagctaggaaaagaccaatccctctcgtttctcgtcgcccgcccggtggatccactgccagccactagcgaaagtacccatggatccaggacccatgctggccgatccaacacttatggtgagggcggatcaacgaggaccaccccacatggtattggtggaccgctacgttgcactcgtggacgacatacaagaggtgatcgacgaaataggaggtgtgtcgttcgatgtgagcttgaaggcagccctcgacgccctcccgaagtgcagcgacggcaagagtgggacgaacaacaacagtccgccatcagggcag

SEQ ID NO: 63733 - DNA, 60730 bp, Oryza sativa
  unsure (1)..(60730): unsure at all n locations
catctatactctatggtggtggctgttggtatttgctacgcatactgataaatccgtaagcgcacaagtaatgatgtagcattttctcttagagtattttaagggtatcaaaaataaagacgtgtgtgtactatctacaaacagaattcccccaaggacaacaattgatgataagattggcaagagaggattcatatggacttcactagttgacttaagttaaagatagaactctatcgtatgtttcgcaccggctatcccttaatctgttaggttgagtctggccttgagctatatgatatgcccgaacgtggagggatgcaaagtacgggcagggctgtcaccacctgctacccacctcactttgcgtggagcacacaatctctaaccttccacagaaacttccttctttatagagtcctagtactagagcagttgcaactaagcaacgaacccgcatcgatgagaatatttatcactcaagtaaactaagtaaaaaaaaactttactttgttgtgtgttgtgaagtgtgttgagctcctcctttcatagtgccaaatgatggttgtaatggtgattagtgaggttggtgcacacataacagccatagtcaatccaatggggagctgccacattgaaaggggtagccaggggcaccacggcttgttcagccgaactaggcctccgccttctggccaccgattttggacagttactgatacgtggactcttatgacggttaaagatggtttggccctatctcaaatcggttttgacagtcaggtgggccctttagttcttgtgctcgcgcttgattagtcagatgggccctttagtccttgtgctcgcgcttgattggccagagcttcatttttgtcagatgacggatgtattttttccttatttgacccgcatacttatatgtatcaaaactaatggaaatggttagtagtaaactcctaccactaagttttgatagtgtattttatttttttaacgcaggagttgatggttaaagtttatacttaacgtcaacaatggcagtgaatccgccaccacatcaactccattttattttttttatcaactactccttatgtactttatttttatctaagggacaagtgtatccataattcattcttatccattgcaaagcatgaatatttagctagttataaaaaaagcaacagtatagtaacaactttaaaagtgattttcatataaacaaaaaaaaacatgtttttaaggtaaaaccgatctttcaggaatagatcctctacgaaagtagatagatgatcgtcatacatctcttttgtatatattttgtgaaaaactgtgctagctcaccgaactaaattctgtaacatatgctttagtccctaattcgtgtcttcacacatatatagggtttgtttgggggagcgtaggattccgaggagcagttgggtggtagtcagctcctcagaacctggaaaagctgggttttccaacttctaacttctagtttatttcctcgattttacaactacagcttctcagagtttaaattaaaagctagactatttggagaagcttctgattctgggagaagctacagcaagtagaagctctccaaacaagcccatactttgtatctaagtctgcttcaacactttatctccatctatttgagattaatcaacaccaagaccaacaaagggagaatctgcatgtgtggataatatataaacaaattctccacaagtacatttgctctaaattctgtctaaattttgtaacatatataaacatcctctccgaattaaattatgtaacatatgctctaagggaccacctatatgtttgtcgataaattttctcctacaaatttgacagatgcaattatagtacaatcgtagtgtaattacactgtaacttgcatgtaagtttcacgtaattttgaattgttagatatattacaagatttgttctaatgaggaagaaaaaaaatcacagaacaaacatatgtgaaatgatttgttcccatgaccttcattttaccgaaataacatgttacagagagatttttaaaagttacacacaagttacagtgtaactacatgtaagttacagtgtaattacactacgattgtactatgattacatctgtcaaatttttgggagaaaatttgtcgttaaatatatagcacaattgggagaatttcgtttctaaaaaagttttagggaataccatgtgtaggcccaggcgcccagcctattaacgacccaactagggcctgttcaatgcgggactttcagcttctcagcctcagtccgagtcgaaggccgtagtagatctttttgctcggtgagagaacccgttaacggtgcgccgctgctttgctgttgctgtgtcgtgtggtcgtgactcgtgtgactcggtgcgtgagcataatccacacttccacagagagagcaagacgaggtgaagcggcgcaagcaacagtgcaacacgccaggcaacacggaagcgactagcgagcgagataattatcatcgtccactctatccgcctccagcttgccccgcctcggtcctcggaggtgtaggagcgaccgaccatggggagcgcgggggcgctgctctcgcactcgcctccggggctcggcggattccctcctcgccaccatcaccaccaccgtctctccgtcctccgttgcgtaccgctcctcccctccccggcgcccgagcccctcagctgtcgccacggccggcaccttcgctgcgccgccgtcgacgggggagccggccgggagacggagcgtccctcgccgcccgcacctcagagggaggagtcgccgtcgggcagcctcggcgcagccctcgaggacccatctcctcaacctggtgtgccccttatccttctccctttatgttgccgatggtacctcaagtactcactagcgagccgtttccttggctggaacaagtgttgcgattgaactgggaactggacagctgcttgctaaaaatcatgagaaaaaaaatgttacgaagggaatgaagaaacttagtagaacttcaggcatcctcctggtgtaaccatacgtgctacagatttaacaatcaacgcaatgaaactgtagattaggaatacagttttgcatagcaataccaactacagatttaacaagtcgcttaacatgcaatagttgctgaccgtgagctttcattgattcatttgagcttcatatatatgttcgtgaaatcttgttctgggtatattgagtactccctccgtttcacaatgtaagtcattctagcatttcccacattcattaacatcaatatgaatgtgggaggggctagaatgacttacattatgaaacggaggaagtagctaaaaagcagggggctatcctcctttggcatatctgatactaatatctaattaccccacacccaaaagacagaaaatctttctagagtgcaaaaccccagctttgagtagctaaaaagcaggggcctatccgcctgcggcatatctgatactagtatctcattactccacacccaaaagacagaaaatctttctatagtgcaaacaaaaccccagctgataagcaatagagatgcatgtgatgctatatgcttggtcaggtcagtcataagacgtgaaggctatctacaactggtcttaactctgtagttatgctaaggaaatctgctctgaatatgtagttcgtacaacggtacaagtgggttccaaatctagtcgcttttgttcttaacccatctttatgatcacccattatagatgtcatttgtataatcacctgttagagttccaacattttataaaaccattgatgatctattatgcatttaattttgttttccttcacttgatagttactatttttgaaacagttatgctaaaattaagttgtcaccttatcattgtatcaggatttagtgaaccatattttgaatagcaatgctatatcagaagggccatttagtatgagaaaagctagatttttaggctctgcttcagcctttagtgttaaacaaactgagtggccatgtgctacaactgactcaaagaaatgttaccgtaagttgctaagcacgataaaacaaagtcagttaatgtgtaagcacatactttcaaaacttcaactcaaagtttgcataatatagtaacttaaacaatgaaatccatcatgcagacataattgtcatttagcataatatattttgcataatatagcataattgtcataatatccttaaatctggaagttaggtaaaaactttcatccaatccacaagccacaacagaagaacccctaagtcctatgtgtgtatgcttccaaacatccacagaagaatcagatgaaattcatcatcaacactagctgtgtcttttgtaggagtaaaggaaacaactggaagagttgaatggatgaaacttatacagttttagatttgttgtggctaaaatctttaggctcaattttctagaagtattaaagaaaaatctatgtcattgcattgtacttatcataactattttattcccattgtgtatttttctggtgataactgctacatttatattcattgtacaaaatgcccttaattagtattatacgttggtggagttcctttttagagtacttgacaactcaaatttaacttgtacagtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttttctttacaacattgaaggtaaaactcttaacaaattaacatgacatactctaaatgcaaattaactttgtaagttttgcatctccctatggaaccaaccttgatgcttgagtaaattttgcaaaactccaactactttgataaaactatcgcagaagtacatatttaagccacatcattacaaaactacaaatttaggacagtatcacaaaaataagtagatttggagttttatggtaagccatggtaaatctgtagttttgtggtattgtggcttaaatctgtaattttgtcatgtttttgtcaaaatatttgtagctgtgtgaagtttgctgtttcttattaaatgtttcaacaatgtgcactgcactttgaagttgatcctggtcctgcgtggtgcgtagcacatggactggttttagtctggggagtctatccgttgtaaaggcatttagtgcaagcatattgtcatgggcattaggccataaggccaaggcccataggcagcccataccagttaagttagagataagataagattaagtcttacttagagttcaagttataccatctatatgaggatgtgattgtgtctattatcgattaagcaatgaatatcaattagtctaatctctccctccccacaatgttcttctccctagcctaaatctacatcccttctccaggagccgacaccacccggctatccttccggcggtggttatctcgtcatggcctcgggtcgtgacacatatgaactgtactgtagctatcaaaatgactatcattaagattgaaaatatttaaatcctccctcacatggtcaggaagcttaaacacaagtcgacatgtgtgggactgtttttgcctcccaggcccccatataatcacaacacaaaactgcaagtagcttcatttgcctatgcctgttgaagctagctcaggaagtttctcacttctgagtgccatgggtagcaagattggtgcagaaggaaaggaggtgcaggtttatgactcgtgtttttattacgtgtacactaggctcacattcacaaaaccacacagtaatgcacactgcctcactcgtctataaactgctctagagaccactagagtatataatcatattcattataattttttaatcaatcttcttgtgtactagatgttaatgacgcttatatcctctcatgtggtcgttaagcaattcgactcttgctgacattgttatttcaatgatgtgcaggtctctggttattgtggccttctacttgggagtcctgttattctgtatgagataatagcatttgttcttccgggtttaacaagggatgaacgtaaattcctagggcccattgttctgggctcttctgtactattctaccttggcattttcttctcctacacggttcttgctcctgcagcattgaatttcttcgtgaactacgcagatggggcagtggaatcgttatggtcgattgatcagtattttgagtttgtgcttgtgcttttattcagcacaggattatcttttcaggtaaacacatggtcttataagttttcttttttaacacagtatcaaggttgattgttgtcatattgtcctctgtttccacatgttgttgtaattgtagcaaacatagtaggaaagccagttcatggtaaccattactttattgacgattgaactggttcggagggtactgcctcaccttctgcgaagatcgtcgtccagatttctcataatagaataatttaatgggtgactgcagatggttaatctccatctttaacctgagtctctaccttcttatcataaaaatatagagattaactcaatcaatcatagaataattatgtaatctgttgttcttgcgggtgcttttgttcaatccatggttgtagtgatagggcaaattcaaagcaactaggtaagtaaattctatggacaaggttacaggatatcttgatcttgcataatctactcggttgccaattggtgttggaacctgtatgcttgaacaaatcattatttgatctaactgtttcaatgctcattgacttgttatctggtgctaatataatcatcaattaaatggctggtgtggaaacttctctagatgttagtgatctgaattatcagtctgatttactgccgaagataaagaaagagaataattgtagcaggaccatctcattagaatgaatatatcccctctcaaagctgaatgaacataatatcttgtatatttttatagtttccatgctattttttccaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttcgtataaaattaactctttttttctcttcaacaaatctcataaatattgtttttcctcttcttttgttctcctacatgctcctgaatcttatgtgctccctccaatcatctatttgacgttgggagagctgatgactaagatctcctaatgtcaaaaaaagattgggagtacatatgcctctacactcaaaaagatgtacacaagcaaggaggggtacatttttaatactccctctgttttaggttataacctctgttttaggttataagttataagacgttttgactttggttaaagttaaactgttttaaatttgattaagtttgtaaaaaaaataataacatttccaacctaagacaaatttattatgaaaatatattcaattattgatttgataaaactaatttagtattataattataaatattactatatttgtctcttgaaacagtttgattttgactaaccaaagtaaaaacgtcttgtaaccccttaaacggagggattcaggagcggagggattcaggagggagtaataaataattcatttgttcttgaaagttaattgactattgccctgcatttttcaactcaccttgcttgtttaccccaaaattcatgacatgaccatttcggccttggttaataggatgtgctggcatgggagaaaattcgttctcacctataaaaattaagtatgatgtttggttaatacttcccccgtttctaaatatttgacatcgttaactttttatcacatgtttgaccgttcgtcttattcaaaaaacttttgtgaaatatgtaaaactatatttatacatgtaagtatatttaacaatgaatcaaatgatagaaaaagaattaataattacttaaattttttaaacaagacgaacgatcaaacatatttaaaaaaaagtcaacggcgtcgataacaaaatcggtagtgatgattcaacttaggcggcaagtactgtaccttttcatttctttcacgttacgactagtagccatcaaaccaatacgtttggaaaatatatagtgaaaatccattattactacataaccattattactgcataattactagaggtaagtataggtataaaatacatttacaccaaatcttaagtttatactcagcttcatttgatagggaaaaaaagataaattttaggtgaatagtgtcctactactattgatctgatctttttttaactccctaataaaattgagttcgaacttgagattggtgagaatatatttcatgcctacacctatccctagttattttttgcatgaatttataaaacttttaggtccaattttaatgggttttcatttatttgatggttttcaccggatatgctccgatgtaggtatttgtgcgcaaattatttagatcagtgaattcttgtaccctagattgggttcaaaccctagatgaattcttgtaccagtgtgttggtgatatgtcctagagacaattaaagagatgattatatcacatactatgtttatatatttatcatacgttgtttcttgaaatagataactcattattgattaataaatatgtgagtccttcaagagacttttatgttgtatgttgttatttataaatgatccctgatgaaatatcatatgtgtaacaaatatggtttaatgattagtacatatattgattgatgatcatgcctcatagatcgtggtattaataatgtagacatatgttggggagcatgttgctggataaactcaatatgaggcacatcaagaactatatgtgatgtgccatcagtgatctcatttagtgttagttagaaacatcagacctgagattatcatagttcccaacatatgtagtcgcttacttaaaggttggtaaacgttactccatgattgggtacttataaaagtagtcttcgggtattttatgaaacatgtagttagatatgaataatcaagataagatttgccccttgtcgatttctaatatcggcaatattatttatggggtgcactagatcgagaagagatggtgacacagatttgtactggttcagaccctgaatgtgaggaaataccctagtccagctggaatagattggatatataccggtgtgcgtaggttagcaacgaaatagccaatggcgcgtatgaatcatggagtgtctaaccccttagggtttccctcggcgccctttgtatagagctagggtcgccggtagttagatggtaaggttgcccttataatttaggcacctaccatctatttataagggataggattaatttccttatcctacatctttttcttagcttacaagttagccgcatgggcctagggcactcgccccatcctatactgcacggcccaaacgcctcctcttaggtactcgggtaccctgtacctcatactacctccgtcccattttaagtgcaaccatgatttttcgtgcccaactttaattgtccatcttatttgaaaaaaattttcaaaaaattgaaaaacataagtcacgagtaaagtattgttcatgttttatcatctcataacaacaaaaataataattataaaaaaaattcaaataagatggacgatcaaagttggacacagaaatttatggttgtacttaaaatgggacagagggagtagtagccaccgagtattgagtttgatgaaggctagtggcatccaatgaagaagacgagactggctaagtactcctcccaaaatctccaaaaaaaaaataatgcaatatgctgccgagtttgaatcagactgctgatagcgatgtttaccaaacgggggaggctttccagacttccttcttagggaaccctttcctgggctggcccgccgaagataccgagggccataaataccccgggcgggagtgccgttgccctagattcccaaatcaaacaattattttctcttcttcttcttcttcgtgcgcccaaacttctcgtcttcggtgatttagggttttctctccccaagcagatcggattgaatccaacagatccaacccaggtccgcctctcttgttgaagctctctactttccgctgtcgccatgtctcaatccacaacggagtccgtcctaatccgggactaggccgcttcctagacgcactcgacggtgacgatggtgatgctggaggaagctgttgaggaggggatcctcccttctcgggatctcatcggctggcggggggccaccggggaggagttcccgaccctgaacaccgacgatatcatggtgttcctccccttctttaggtttggcctcggtcttcctgccgacgattttctccgagggctgcttcatttttacggtattgacatccaccatctcaattccaacttcatcctccaatcgccatctttatccatctatgtgaggcataatgcggtataaacccacacttcacgttctttcgttacctctatcaactcaagccatagccggggaagaagaaccccatggtggttggagggagcggcatccagatctggaccgagcggaaagcggagtttttcgatctcctgctcaggtctagcacaagggctggcactctaggtgtctactgctccaacttgttgcaggtctgcctccatataatggccatgccccgggcgtgaaggattgttggtacacactccctagccgcgatgagatggaccaagttagaggggtgctgaggggagtgcgtcttctaatcgatgctggcttgacctgcaacttcgtcacttggaggattcaaccactgaagagtcgtgttcacccagtctgggaatatttaggaaaggatgacccgaccagggagagcaatgagttgattgacaaggaccaggcttccgagaggttgaactagtttttcgagcccgagacgttggtcagcatggaagggtgctccaatcctttcaattgcagcaagaaatggccggaggtatgccctacccatgcctgcttcatatatatgtgtataaattggattgtgatcttcaacatctatgtccttgcagggagccgtgacctttatctccaaccctccactgcttgggacctcgagcaagaggcgtgttgacgatcccccttctagtagctgctctttcaagcatgtggcctcaaagcagccacgcaccccgggtggccaaccggtaggtccaaggttagtgatggccattccactccaaggatcgccgagacgtctagcaaggggaaggacgtggtggtgactcccgacccggtctccaagaataagttgataggttcgccgggataacccgggaatctaggggcaacgacgagggtggcggcgtctgccgctaaggcctcaaaggcaccaggagtggtagcgaagacgatgtcaccccggtctgaccaagggaccgaggataggggtctgcaaggttcggcggtccaccaggttagttgtgatggtggtctcctcttgttcacttgtatgtaatggaatcgtcgtagactcgtggtgattaagcgtagagtgaatgtagcatgtcgtcaatgcgagatgatttgagccagctccagtcggcaaaggatgccgacagcgcctctacttaggccactctcgagtcgggtcaagagaccgccgcccgggtggatcggggctgccagagccggcacctccgggcccgaggtggccgggcagaccacaggggacctaggcgagctaggcggtgacatgacagcggcaacgacgaaggacgcgacggatcaagggaccgacgggggaattggcggtgggggctttgtgagctacaaacgagacatcgcatgcgcatatgcctcctcaccattctccgttgcgagcttctcccccgtgagcttctcctctgcgagtctcctccatggacttctcctccaccgagtcctcagccgcctccacaccactgacccgggaaggagccggttggcgaggatgaggaaatcgtggaagaaattccgcgtcggcagtgcgcgctgctgtcgacccagtatgtctcgcccctccaaactgcctggttctggggggggcaaaaaggggttcgatgatgccgctgacaaggccgactgcacgaccatgtatgaggcagggctggttctgctggagaagatgcaggttagtagttatatcccttagcccccgacttcaggacagagtgcgagtagttattgtgcgctgaagtataatggagagtgggtcttatctttgtttgcgtctagccgggtagatccttgatggcgtggcatagtgctgggtggcggtgcgccacatcgtcatgtgcagttgtcttgtttttgagccgggtagcccccgacttcatgttgggacgactataggagtcgtagcatggagttgacttgattgttgcattgattcttgcagaagatagtcaatcgctctactgccaagagcgaggcgctgcggagcgtgtttgacaatatcacagagatcgagcaaatctagcgggccatgtagcgtgtcgatctccaccgactgaaggaggtgaaggaggggcattaccgggagagggagctctagggccagatttgttagctatggagggacggtgagttgctctggctgagagactttgtctttatgctagcctttttgatggtgtgtatatgttcgcagtcgaggatgagcgggagaggggcaaacgctaggcggcagagtggaagatgctggtggactaggctgaagcaactggcgggtgggcccagatcgtcgaactggaggcgtagttgcaggagtcctgacagggtgcgcaggatctacaagacaagttggatggtgagtcctgtaatgcgtgtttggtctgtttttgtactctgctattattgacgtgttttatcttgactgccacgcaagctgcaggtgattggcccacaccatcccgctgccccatcccgcacgcctccactcggtgccgcgtgctcctctcctgatcgacgtcttcttttctctccttttttttcgttttctaatttcccttttcttttctcgcgatcattctgtctcctccctctccttctaatctcctctacttcctcctcttttctcttttcctctcttttcttctttttttctcgatgtgtgaggctatgaaaagttgtaataagggattcttcatgtgatgacgaatgaagtgagcacagccgagttcaatattatatatgatttataactttgttttgccattgttttgtttgtcttgttttggtttaccgtttaaattatcggagttttttattaatcatgaaaattattcatatgttgcaacgcacatgcattttcactagtataacaacataaaacatgcaaccatatatagtaaagtcataactcacttgagtaatatttatagtgcactatgatcattagatttataacaaatgtcgctctctaatttattctactttatccatataaattatagatatttatgtgactacatgtggcattgaatattatcttcatacataattagttaagagaattctagattatgttgaggtaaaatatctcctaaattctaaaaattagttatgcaacttgatatcacagtaattactagtaaataatgtaaaaattactactaatatgtcatgataactactactccctccattccatattataagtccttttgacatgaccaactttgtacaaaattattaacatctacaacactaaattaggttaagtaaatgtaatatattttgataatatgtttgttttgggttaaaaaatataatctatttgattaaaaaatattaattcaaataacatgcaagtaaaaatggaaaaaaatcaattagaaaatgttagaaaagatataaatataacatatttcaaggtggccaagtatccatgcgtaattgtgtccacgaaggaagagaaattgtcgtgatgggtgccttgaggatatttccccgtttgctcggcgtcgacctcgattccttgtgtggtgtggattccttagagttgttgctaaaaccacctactgtagttgcaaaaatgtctaccatccctttgtttctactagctaaaattatttcttaattaactctcataacaagtgttgatttagtgagaaaatattttccttttaactaatgtgataagcgacacaattttgtatatcctcatgagatctgtttatcctcattctacatattgaaatattttttcttagacaacgctacttggaattgatctaataaaacaataagaaaatagatatattttctagattacatcgtgtttgcatgtttttttgtgtaaagagtgtgttattttatttagtgttagctggagtgtaatcgctattgtcggtgacatggggccgggggtattgtgactagaggcttgggtagccgcgatcactcacgtggcccgacctcctcgggggggtcgggcccgacggtgacgtggccacccctccctctgtctccccgaggggtcgagccgctcccgtttcggccccgagggctggggcaccccgaccccccgtggtgttggcgccacgtgtgtgggttaggtgagcacaccgggctcacctaaccgcatttatagcaggttggacgagcgcgccacgccgcatttaatgcggcgcagcgcgcgcttatccggtccgtgactggtcgtggtgtgtgaccggtcacagaccggtcagatcgcgggttaggtggcaacaggtggcctgtcgcacgcctcgccccgtcccgtcggaatgatgagagcttcctggctctcgtctctagccggagctggcgtgctgactcctggagttggtatgtcagtcccggtcagatccattccaggcttcagcgcaagcatggcaagaaagtcgctggccattgaatgaaggttgaaacgggcgtccaccgggagagctgacgagcggagcaggaggcgtgtgtactgcttgtcagaggtcatttccggctgtagattagccctcattgtaaaaagcatgtttcctttcttaggtagcgggaggcccttgtggtgaccccggaccagataaaaaggaggcccaggcctaggaaagaggggagaaaaaaaaagaggaaggagaaagaggctgaactctctctcgctctcgatctctctggctctggagctctctgtattccttcacacacagatccaccagaacacaggagtagggtattacgcttctcagcggcccgaacctgtctacgtcgcccgtgtcttgtgcgctccttctcgctgacattcctcagatcgagggcgaagaacctcacatagcgcccccggccgaaccggcaaaggggggcctgcgcggtctcctggtgaggagcccccacgctccgtcatctggcgcgccaggtagggggcgcgcgtgtctttctaagccctcgtcctctttcgtgtgcgccaagcttctcccgctcagcccaatggccgaacgggcagtggcgcacagcctctctccgagcgctagcggtgacgacggggagcagaacccgcgccgtcgggctcgcaccccaccgtccccctctcgccgaagtcttcggcgagggaaggcgctcgaggaggtcgaaggatccgtgacttcgccacgcgcgggcgacgggggaggacggcgagacggggcgcatcgccgcctcgtctacggcggtggcaacacaccccagggcacgctccaggctgcgggcgcgctcctgcgtcacccgcccgtcgtccccgatccagagactccagcccgacgttggctggatgacgtggccgatttggtcatgacggcacagcagcgcctaggcgccggcaggcggtcctccgccaccggaacctctggcgctgccgccgccggctccacgacgtcgaggcggagggcgcggcgagcggcggccgctacccgccgttcgtccgccattccctcgtcaacgcctccgacccaagaagatgtgcgtggggggccggatgcccggctcgatatcgagcgccggcgcgacgatcgtcgcgccgcccacgcaacggagggcgcttcctcgtccggagcgccacttcggtccgggcacgggggccggccccccgtgtccccggttggcggtgctggctgtcgagcctttgtggcgagccttcggaacgtccgttggcccccaaggttccggcccaccatcaccgaaaaatacgacggaagcgtcaaccccgccgagtttctccagatctacacgaccgggattgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccggggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggcgtgcggcacaaccgtatgctcgagaagatcgcctccaaagagccccagaccaccgcgcagctttttgagctcgcggaccgtgtggctcgcaaggaggaggcctggacctggaactcctccggttctggtgtggcagctccggccgcccccgggtccgccgctcggtcagggcggcgggacaggaggaggaagaaggagttggcccgttccgacgatgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccaccggtaactggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcaatggtggtttcccccaccgtttgcaatgtgaagttggggcgtgtcctcaaagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggatttcgatgtggcggaccttagtctgccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcacgcggaccaccttgccgcggcgtccaagcccgcgggtggcgacgagagactcagcacctccgtcccggccgccccaaggcagcggatggtcacgtgcgacgaggtcccggtcaaggaggttgccctgggcgacggcccgtccaagaccacacgaattggtggtcttctggacgacaaataggaagacgcgctcgtctccttcctgcgggcaaacgccgacgtcttcgcctagagaccggcggacatgcccggggtccccagggaggtgattgagcaccgtctcgccgtgcggccgggcgtcggcagggcgtccccaggggtaccctcctgcttcctcttcccccgggcgtcggcagggcggctgccccccgggcccccgtcgcggggcccagaagcacgaccccctcccggggtagattgttcccccctgcggctcccgcccgcgccattgtggcctcggggggcccgctcccccgacgccccgaccacctgcatgatggtcaggatcttggcgcgctctggatcgcagcagagggggaggaccccttgggggatgagggatgcctccacggagctaagattcagcacccgttggaccaccatcctgaagtcctcagggtcccagtcccatttgcgcccctggtgggtcctcatgtagtcctcgggcccggtgtactcccaggcgccccgagcgcgccgctggagcggcgcgatccggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcacttcgtcggcgagggggtgtgtagaaccaatcgctcttccagtcgtcccactttttgcggaggacgcagggaatgtagcggttcggcacctgcccccgcggctggaagtagcagccaccgactaccgtcggcggtgacaccggctgtacggtgaagaaccaccggaacagccggagagatgggcgcaccccgataaacatctcgcacaggtgcgcgaaaatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccaggcgtccctcgcccagcgcgaccacctcccggccggtggcagattccggcatgaatcggcgcggcagcccggcctgcctctcgctcacgatgcgggaaggcggcagcacgctaccctcgagcggtacggagccccgtgccatgacgccggcggaggaggagcttgagagcgagcgagtatggcaagggtagggcgcaggaaacggagagtcagagcacaagtggcgaaggcaaggggaagagtggtgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggcagatgtgcggtcgtggcgtttgagatggggcagatcgtgcgcgcgtttactgcgctcgccaaccgcgaaaaacgccatcatcatgtccccaggcgaaacaaaccggctcgtcccgattcgcgcgctgcttgagtaatgtagcggtcttgaagaggccgctcattattgtcgatcggtttttcccttgccgatgcgcgcgatttgcgaccgttgggtttctgcccgcctgtggggaccggccccacctgtcaccgggcctaaggagtggcgtcacgcccgagcgcctccctcgaggggggcggtcgccctggcgtaacgccgggggctactgtcggtgacatggggccgggggtattgtgactagaggcttgggtagccgcgatcactcacgtggcccgacctcctcgggggggtcgggcccgacggtgacgtggccacccctccctctgtctccccgaggggtcgggccgctcccgtttcggccccaagggctggggctccccgaccccccgtggtgttggcgccacgtgtgtgggttaggtgagcatagcgggctcacctaaccgcatttatagcaggttggtcgagcgcgccacgccgcatttaatgcggcgcagcgcgcgcttatccggtccgtgactgatcgcggtgtgtgaccggtcacagaccggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattccaggcttcagcgcaagcatggcaagaaagtcgctggccattgaatgaaggttgaaacgggcgtccaccgggagagctgacgagcggagcaggaggcgtgtgtactgcttgtcagaggtcatttccggctgtagattagccctcattgtaaaaagcatgtttcctttcttaggtagcgggaggcccttgtggtgaccccggaccagataaaaaggaggcccaggcctaggaaagaggggagaaaaaaaagaggaaggagaaagaggctgaactctctctcgctctggagctctctgtattccttcacacacagatccaccagaacacaggagtagggtattacgcttctcagcggcccgaacctgtctacgtcgcccgtgtcttgtgcgctccttctcgctgacattcctcagatcgagggcgaagaacctcacatagcgcccccggccgaaccggcaaaggggggcctgcgcggtcttccggtgaggagcccccacgctccgtcagctattatggaagagaacatctttaaatttttttgaaaggttccctttaattcgacaccaatcaaattaattaggtgcgactgaggtgtcgtaattgatctcatcaaaagaaacataagaatagctagaagtttgctaaatccgcctataggttgtcaaatgggttgtgtctttctgtgtctgtctggacacacatttagacaactcaggaacaacatgatccgtttggctatgggttttgctggcacgaccgatccagccacaccgtgcttgggctgctacctggcttggtgtatcaacacgacaagtgcatgagcgagccagcacaacatggcctaggaatagcacaacacggcctaacccatacggtacgatgatgactggtgactgacagtcgccagtcatgaaactgtcatccaagcgggagctatgaggaaaggagatcgaaagaattgagtaagccaggagctcgagatagagaaagtgatggtggatgctcgtcgatataggcctaccacgatagcatggtggcgcggtcaaccctattcatgagtacaaccactaagcacgtggtcattgggactcaccggcttgggatgaaggaagtagaaagtgaagggtcacagcggtgcttgatgatgaggaagaggaatgtgctatcggtgagtgaaggactctctgcatcagagtgttctagtcccatggggcttcatttggagaatgcgattagtacttatattttttaggtttcaaccttttgcgtagggtgggaatggggtgtgcaagcaatccgggtggattgagtgctaggcaaaattactaattagggggtgtttagacgagaacactaataggcgatcagtcgcgcgcctcctctcccgcgcgactggacacgtggcacgtggagatgggcgcgggcggcggcgcggttttccttttttttttggttttcttttttcccgcacgttcctctttttttgtttgttctgtttttttttccgcggtttttttttcacacggtttcttttttttcggtttccttttttcccgcccgttccttttttgtttgttatgttttttccacggttttttttcgcacgttttttttctatccgtattttttttcagttttttcggttttttaatatgtatgtatgcaaagtttgtatacacgtatgcaatgtttgtatacatgtataaaaaagatacggatagaaagtttgtatatatacgtatccaaagtttgtatacacgtatgcaaagtttgtatacacgtatgcaaaacaaactttctatatatacgtatataaagttggtatattttgtatacatacatatataaactttatatacgatatatacaaacttagtatttatatacatcgtatacagattttatatttgtgtatatgtttattatacatataaaaaaatatacatatacaaaatatatacacatatatatacactttgtatatgtatataaagtatatacatatgtatgcattgtagatgagagagactagaaggccataactgaccgcgcgccgcgcgcgactgattgccgatcagccaggcccggtgtttacatccaggggtgtaaagttagttttgctgtgtcacatcgggtattaaatagggtgtcgcatatggtgttcgaacactaataaaaaaaactaattacagaatccatcattaaaccgcgtgatgaatttattaagcataattaatccatcattagcaaatgtttactgtagtatcatattattaaattatagagtaattatggttaaaagatttgtcgatgttacagggcgaaaattttggggtgggatcagggccttacccagttaccctcgccatttttgtgcgtatccctcctcgtcagtttgcccttgtccaccgcctccgcctccgcctccgccgatccccatccatcccgcgagcgagcagggacgccgtcgttagtcctgctgcttccgccgcatccatcctggtgagcacatcctccgcaccgccgcctgcgccgatccccatccatcgtgtgtaattgttcctaagaagaaggaaatcgtcgttcagtgcagtgcggtgcctcgaggatatttccctgttccctcggtgttgactcctcgtgaattcgcccgccgcctgtgccgccgccgatcaccatccatcccacgggcaagcaggggcgccgtcaccgcatcctggtgagcatccatccgctacgcacatcctctttctcatccctctttacccacgctttctcgaatttgtgttaccatagcttctcttctagaaatttgcattaaccttaattctaagaacagtctgtttgctcccaaaaagtttgggggttcaactgaaccccaatgtcccatgttagatccacccctagctcatgttctgggcagacatgaatctctgaatctcctccaggaccttatttgtatggtgggtcaggcgatcaaaatcagtcacctgagctcgaagcatcaacgggagctctaatccatcacattaatccaataagccggcagcactcatcaactgtcattgaagcctaccttaattgtcttgtactgccatagggaccacgttagcccgaagccctcttgttgttctgtagagctatacctcaccagccaccactactggcatgttgaagcttcccgccgaagcaacaatttgatgattaacatctccaatcactctacactttgcatggtttaatttttgtccctcaactccaaactgggtaaaacccatgtccgaactttcaaaattaggtaaacctcgtctcttcacctgttgatagttgttttgatccatgtggctcccacatgggatccgagaatccgagatagtagttgggtctgcttgtcatggagaggttttgacagatataacatccgcattggatgagagtgggagttggtttgattgtcttgaaaaccgtacccccatgtaacatctgcaattccgcattggctgagagtgtcattcatgtaaatattagttgttcacatcttcgactcaacttattatttttctagatttctttttattctttgctgctctgtttcaaacaacaatcaatatatttgatacatagctagaatttttatgtttacaacataataataacagcccgtgcaaatgcacgtgtaggtggttacaatgaactgattgttgactaagtagattgtattaatcgtgaattttagtaggattttgtgttaaatagtatatgcatttgaaaatagaaataacatgtactctttagttttagggggtgtttgggaactagggactaaatttagtccctctcacaaaagtattaagtccctatggtagggacttatgtttttgtgagagggactaaagtttagccccactttagtccctccaaccaaacaccaccttagttttccaaaaataataattctataattcaaagtttactatgaagctatacattggccattgtggactctcattttagtgtgaaaataatttgattcaaaattaaaaaatagcaagtggtaactaatttggattcctctttaagtctaagcatatataatttgaaaagtattcaatatgtttatatatctgcagtaacaacaataaaaacccaatacaacacacaggttggcaactaggagtgttaatgtttctaaactcagcgaaagctacagtaactttatagtaaacattgaagatatgggggaggccaagccattgctcgtctctgcctatctctgtccttggtcctactccaaccatgttggcactgttttgcagaagggaagaggaagatggatcagcaccacgtgcagcagcagcagtatgttgacccttatcggacaatggtgctgtcaccacagcctgaccacctcaatgccctccagtacaatcaccagcagcagccacagccaccaccgcaagcaactccaccaccaccacaacatcaccatgcctcactcgcctcccacttccatctcctccatgtaagtcacagtcctgatctcttaatgcttgtctttgtgtctaataaattgaaggggaaggatgtcatgacaaattttggctgccggagtgccggtagttggtcttccattatctaaaaaaagtctatacacacaaaggttcagctcattctgcagttgcaacttggccatagaagcatcctagaggctgttattcgcttgctatattataattggataacttaagtgcaaattgtctgctgcatcgtctcttgtgaagaaaaaggttgctacaaactatgcattttgctaattacatgtctttcttaagttgacaactgttgtaaatcaagtctgctcgagttatttatgtgtctgcaagagcattagtgtattggctgccacttttctgtgtatttggatgcttacgtgttgcttctgtccttttaggaatatagaacttcactattatgcatgctctacaatgctcagttttccttaattgttactaccttcatcccgaaatataagggatcttttttggacggaggtagtaccaaatactacttacacaggaggtcactatatttgcacacctttatcaattaactctatgaatcatgcaaattattttcttgcctccctgaacttgcttctattcgtatgttaagtcattattgagataactaacagaatgtggtgatctggtcagcaccagtggatggtgtcagtacatactccaatgtggaagagtacttttagggcagtggtggagctggaaccatattgagggtggtgccctactttactatatagatggcagcaattactctaaataatggtatttgttcatttgtagataactattgacacaaaaaatcattgagtagcaagtaaaagtgcttaccgaaatataagatgaaaagaaaccgcaaaggggaacatcaaaaaatacataaaagacgatcaatttatgcaaaatacatcctcggcctcaaagctgtcaatctcaatatcatcgataggtaatagcctacaataaaagcagaacagaagttagaaacatattaatttcaactaaaaatttatatccaatgaacatgtaaaaatataaaaataaatgtgttaccttttagtatactcgtgttctcatgttcataaaacggtcaactacagctttgttggttactcttctcatttcttctttctccacatagcaaataagactatgacttaagtagtcatcacccaactattgtcatcttgttctgaacaagaatttcgtacagctacattattggaactatcgggcgctttcctcttgagatacttgtccataacctgtcaattaaatagttttattatgttagacttacactgcacaatagaacaatgtatacccccaaaacaattaagcaatgatggtgtcacagtatgcttacaattttactaagtgatggttgatggactgatggctacaggacaataggactacttgtcccttctagagatcaattgaaactttcagttcttcaaactttaaaccctaccttatataaatctggatattgacagggtgctatcaacaagttacaaatgaaactaatatgattaaaaataagactagaactagaagagaggataaattgaaagtttggaactaattaaaaggaagataatacatctcttaatttagtctcttgcttgtgcactgctgactgctcggctgctggctgctggctgcaggctgcccctgtagtctggctgctcgctgccgcagtgccgctgtaatgctgccggcggccggctagggcgaccagcaccaggccaggacggcgagcaatggcgagtcggcgaccaacggctgagcatgagcagcaggagtagacggcgactcggcgagcagtggcgagacgaacagacacacagccgcgcagatgctgtattgtggtttggaaaaagaaagaaaagaaaaagcaaaaaacgggagtcgaggaggtgtgcggtgccggcgtggctgtgattgacgctcgaggcgtcgtctcgcttccagtagcccagacggtgcactgttttcatgggccttaggccttccacgacttgcttatgggccaggggtggtgcacgaatttgggccaaggggttcccatgtggtgaaaataagggggtaagtactaaatctgaaaattgggccgggtgcctgggaacccccctaggcccattgggctccgcccctgttttaggggtctatttattaaataataagttatcaaaaaggactagaaattcctgcactgttaaattaagcaataggtgaataggataagaggcaacaatgtagtaattggctgggagagggacaacagctgccattctgccacaagtggagtagatggactaaggggctgcttggttggcggcttggaatgccacgccacggcgtggctcgccacaggagtgtggcggacgtttcgtcgcctcagaaaacactgtagcgtggcgaaaatactgtagctatggcattcaatggctgggatccaaacacaccctaagatgtgaataattaaatatggatgctaattttagtcaggtgggtgaaattctgaaaaggagatttgctacaatcaacgaatgaaataccggtgtgttttttttaacattaaaaagctatttttgagctgcttttggaatttaacatgtggcagtgtaaatgatgattgcttgttatggaatatccgccaagcacatctacacaatggcgtatatctaattttcttatttcatttacaagaaagtactacctttacaaatcaatggttttttatttgtttatcagttgacgacaagattagctgatgctattggaaagggcacaagggatcaaaattctgatgcactggtaagaaattcatgcagctcttaatagtgttttaataaattgatgtgattctactccatgatgcatgattcttgttgtaaagaatgacattaatttctctttggagtgtacatattcttggaaagtttattgtgtaggaactatttttcagttgttttgcttcataaacttattatgaaaccacttcctgttgtaatataatatggaggaaatgtatggaatatgctaggtgactgattcttaccatataatattttctactgagagcgatgaatctgaaagacaatatgccaatgttgtcacattgttgctgtgtcatatgccgtcctggtgatgggtggcacttgcctggggtcctcatctaggatgagagctagagggagggagctgagtttatctgtttatgtgttgcgctactcctttcctttttatattttatttccgtagcattgctatggcctgacctggatgccaccctggctctgtgggcttacggtgccttgccagagcaccgtgacaacatcaatatacttgaattatattattataaactacatattttttatagttaatatgtacactgaactgggattaatgctctctgcgatctgtttccacactctttattgatgctatcaaactttccagttagtaaacctgcgtattttgtatctcatatgtgcctgtgcaaaattgtataactttccagtttccactatcctgttattgttgtactgcttataatgttatagcatgaatatctgagtaattagatggtctttttatatgtttgtgtaggttgaagatttgaccagtcaatttgctaggtgtcaacaactattaaactccatatcgggaacactaagctcgaaatctatagtaagttttgttacatctaatgaggtatttggcttgttaaatttgctatgcgatctgatcacatagtaatagatatcgttaaatcttctttgttgtagctaggctgtaattcaaatacatggtaacaaataacagcgtgatagaaatctggtatgtcccatccttggaaatcagtaatctgccgagtgccaacgtacacatcagatctagttcttgtgattttttgtctgaattgttgtcttgcctttcgtatttatgtggtgaattgcttgtttatatgttcattgcatggatgatcacttattcgaaccaaacgatggaaagggtttccattccattccttgattcagccagacaaagtcggcattttgcttaatccatttcagtttccagtgtttctaagttccaacactacctatatgactcctgttgcacgaagaccgtaagagtgaggagatacaaaatctaagaatcacgtaatggcatttcaaagttttgtagcattgaagcatggtaggcaggaaatattctaatactatgctcatgattcatcaattgacaagcattatatgaaatgacccttcgattataggtggagtaattttactaaacaagaataactaatttgtaagtagttgggcatacagttagctgttctgactaatatctaatacatagctcaatgtttgttttcatgaaaaaagatggtgactgagatgataataattctaatagatggtccggtaataaaatattttttgaaatctagcggccattttggtttgctaccaaaatgtgccctacgaattcatttggcaactttaatagtgctttgatattgtttggattgaagccaatttatagctaaatcaatgtgatattataccaaattgttggtagtaccaaaacttgcaaagaaccaaatgttggcgatatggcatgagacccttcgaccaaacctgccgaaagcatgcgaccaatggggattaaagcccgagacgtcagggttagtcaaggcgaacccccccatggcgaagactatggagcaaggatggcgagaggcagggaatcgcagccaagctagaggcctcctgggcgaaggacgcaaggcgaagagcatatgccgaagggggacgacttcgccgtagcaggttcggccccgggagggccgaagaaactatcctggcccatcaagcctaggggtcaattgggtcgccaataacccgtcggcccgctaagggcccatggactgcaattacgctatgtacccatgtaaatgtccctttcataagggcaaccatgtaaattcccctgcataacgaaagccctagtagtaagacctgtaatgggggctataaatagccccatagggccatgtaatggggggatcccaagtaaaaattctcaaattaatacactttacttcttttccaaccactgttgagtgaccacgtctttcgacgtatgcggttgtcgtttcgacaacagctggcgccgactgtggggacctccgagcgaaaccactgagagcgaatgccaccgaaggtcgtgaaggagaaggttacaagacgaaaggaaagcgaagccggggcggatatggccggcgaagagggagcagagccttcggcgctcgtcgccgaagatggaggagcgccatctgcttccgcacctgcgccatcactaccgccttcagcccctgccacctctgcacaggtgccgaatgcggctgacatggcgaaggcggctgcggcggcaaggtcactccagaccagggcggagatcctttcgacaagccaactgctggtgccccaagccgctccgtcgcagccggcagcggccccaactgcgctcgccgccgtgcaagcccaagtcaaccctgatcccgaaacacaaaccgaagccgacatggaagccatgcgacagaacatgacacgactccaagacatacttcgccaaatgcaagaacagcagcaggcatacgaggcggcaaggcggtccaaggtcacttcggccccaatcctccagtattcggcaggctatgtcccaccccaagtttatccacaagtaccgacccaaccctttccgccacaagttgtgcaagcgccaatgtacttcgctgggcagccatcgaccgcagcagcgcatccggcccctcacgtgcaactgcaagctcaaccggtcgctgcccaagtacaccctcaactgcctggccaagtgccacaaacaatggcagaaggggcttcggctctgcaggcacagctccaagctttccttcagcagctcagccaaccccacaacatttcaggtacagccccttcggctcacccggaggggaatacaagtcaaggtgcgcctagttggttgccgtcgaatcagctaggtctgggggcttcaccgtggagtcaaagaccgcagttcgacttcatcaatgctgcttaggcaccaaccgtttggccgcaagcaccaacgccaggcttcggagcaaaccgagcaccaaaccaggtcgctatgacatggtcagagccaactttcgacccatccatgacagctcagcaagcatcaccaatcggagccgggcaaccgaatgccatggcccaacctcacgcgcaagccgtgatttcgcccttcgcctcgccgtaaccgcagcaaggtgccgtgaatagggcagggggcgaaaaggggctaccgctaagtgggggaatcaagacccgtccaatcccaccccagttcaagttcccacccgtcccacgctactcaggcgaaactgacccaaaggaattcctctccatttatgagtccgcgatcgaagcggctcatggcgacgaaaataccaaagcaaaggtaatacatctcgctctagacggcatcgcccgttcttggtatttcaatttgccagccaatagcatttactcatgccagccaataccaaagccaatagcattgtccttaactttcgaggcacctatgaggagccgaagacgcagcagcatctactcagcattcgccagaggccgggggagtcgataagggagtacatgcgtcgcttctcgcaagcccggtgccaagttcaagacataaccgaggcgtctgtcataaacgccgcttcggccggtctacttgagggcgaactcacaagaaaaatcgccaacaaggaaccacagacgcttgagcacctacttcgcatcattgacgggtacgcaaggggcgaagaggattccaagcgacggcaagcaatacaagctgagtatgataaggctttcgtcgccgctgcccaagcccaagcacaagttcaagttgccgaaccacctcctctcgctgttcgccagcctcagccggcgatccaaggacaaccgccaagacaaggtcaagcccccatgacctggaggaagttcagaaccgaccgtgcgggcaaggctgtgatggctgtcgaagaagtgcaagccctccgcaaggagttcgacgcccagcaagcaagcaaccatcagcagcctgtccgcaaggtccgaaaagacctctactgcgccttccacggacgctcttcgcacaccacggagcaatgccgaaacattcggcaacgtggcaacgtgcaagatccaaggctgcagcagggagcagctgttgaagcacctcgtgaagcagctcaagaacaagcacccctggccgaacagcgccaagatgcgcagcgcagagtaatccaagtgattacaagggccgacccaccgatccagctgtcgaagcgacaaaagaagatgcagctacgaacggtccacaatatcacttcggcaggcgaaggggccccgcagtatctgaatcagcaaatctcttttgggccaggagacgtcgaaggagtaatgttcccgcatcaagatcctttggtgatctcggccgagatagctggtttcgaggtccggcgaatcctggttgacggagggagttcggccgatgtcatcttcgccgaagcatatgccaagatggggttgcccaccctagcccttaccccggcgctagcctcgctccgtggttttggcggagaagcagttcaagtacttggccaagcacagttgttggtaactttcggcgcaggggaaaacagacgcgaagagcaagtattgttcgacgttgtcaacatcccttacaactacaacgccatcttcggccgtgcaaccctgaacaagttcgaagctatttcccaccacaattatcttaagctcaaggtgcccggctcggtgggagtgatcgtggtcaaggggcttcagccttcggccgcttcaaaaggcgatcttgccataatcaacagaacagtacataatgttgaggccgaaccacatggctgggcgaagcacgcgccaaagcctgcccctcacggcaagataatcaagatgcagattgatgacgccgatcccacaaagctcgtatcgctggggggcgacatgggcgaagaagtggcggcaagcatccaagaagtactcaagaaaaatagtgatatcttcgcctggggccccgatcaggtgggaggtgtttcgacagacctcatcatgcatcacctagcagttaagccggatgccaagccaaggaaacagaagctgcgcaagatgtccgttgatcgccaagaagcagcaaaacccgaagtccaaaaattgctcaaggctggggtcattcaagagatcgaccatcctgagtggctggcgaatccagtgctggttcggaagtcaaacggcaaatggcgcatgtgtatcgatttcatagacctaaacaaagcatatccgaaggacgatttccccctgccacggatcgaccagctcgtggattcaacagctggctgcgaactcatgagctttcaagatgcatattccggctatcaccagatccacatgaacccggccgacatccccaagacagccttcatcacaccattcggcacgttttgtcacctcaggatgcctttcggcctaaggaatgtcggagcaaccttcgccaggctggtgtataaggtcctttacaagtagttggggcgaaatgtggagtcttatgtcgatgatatcgtcgtaaaaagccgcaaggctttcgaccacgcgtccgacctacaggagaccttcgacaacttgcgcgcagcgggtatgaaactgaatcctgagaagtgcgttttcggcgttcgcgcaggcaagttgttaggcttccttgtttctgaaagaggcattgaggcgaatcccgagaaaatcgatgccattctgcaaatgaagcccccgtcgagcgtacgtgaagtacaaaagctcgcaggccgaattgcggcactcagtcgattcctctcaaaggcagccgaaagaggtttgcccttcttcaagaccctccggggcgcgggaaaattcaactggacacctgaatgccaagcagcgttcgacgagctaaagcaatacctgcaaagcccgccaactttgattagcccagcaccaggaagcgaactgctactatacctagcagcttcgccagtggcagtcagtgctgcccttgtccaagaaacagattcaggccagaaaccggtctatttcgtctccgaagcattgcaaggagcgaagacaagatacattgagatggaaaagctcgcttacgccctggtaatggcttcgcgcaagcttaagcattactttcaggcccacaaagtcatagtgccatcgcagtaccctttgggcgaaatactccggggcaaagaagttactggccggcttagcaagtgggcagcagagctatcccctttcgacttacattttgttgcccgaactgctgtcaagtcccaagtgctagctgactttgtggccgaatggacaccggcactggcccccgagcccgaacccgtcgaacagccctgggtgatgcattccgacggttcgtggtcgcacaagggggcgggcattgcggcagtactcacttcgccaagtggtgtgccgattcagtatgccacaaggctgcagttcgacataaccaacaacgcaacagaatacgaagccattcttctgggcctaagaaaggcgaaagcaatggggattcggcgcctgctaatccgaaccgactctaagctggtggcgggccatatcgacaagtcctttgaggcaaaagaagaagggatgaagaggtatttggaggccgttcggtctatggaaaagtgcttcaccggcataacagtcgaacttttacctaaacctaatcaccggtttcgcggctgtgctggagatcgccaagagggtgttcgctacgacgatatcttgcagtcgcgtaggcgaaacatgagagcctgccccggatttcgcaggggtagggctgggggtataaccatgagagccatcctcctcagaaccggcctccgcatcctcctcttcctcctccccatcactttcgacggcggccttcgcgctacggcgagttcggacttggccgcctttcgcgaccgcacgtttgcgttttttcaaagtgccagcctcgtcatcgccggcccgagaggggttcgatcggcttggcaatttgccggtatagacacggttcactcggccgtcaacatggcgctggagcaagcgggcgaactcggctgtggttagagctccgatcatcttcgacgcctcaatctcagcgtcttccaaagtccgcactgcgaaaagagaggaacacaaccgtttagccaaaaaagcgcttccacgaaggaagtatgcggcctaagtcgaaaacaaaaaccttactttcgaccccggcggggagaacaaggcggggaagcccaagaacttcttcgccctcgttcacagaaacgtcccacacacgggcgagagggaaatccgaaggagacaaaactcctcgcaaagatcccgggtgctcagccgccgggcaaccttgcgaaggagaatgagtcgggactcaagagtcccgtcgatctccacgtttggcttcgcgttgatgcagacggcagaacgctcaaaaagcagccagtttgcctgagtattttcggtggagtaggggttgctgatatagaaccatttctgcatccagttcctgtcccatttcgccatcgatgcaggcactggccaagcatctgaacgctccggccgcagcatgaagttcacgcagccgaaaacggttttcctcggacccgccggcgtttgcacgtctttggtcgaggcgcatgcagtaatcagagcggcgaatagcttggcggtaggggcgaacccacaggtccggcacatccaagcgaaaaccgccatcttcgggaacgctgacgggctaagttggggaagcctaacgtcatacatcgaaagcaccgaaggcaagaagttgtcgcatgggaggcgaagcccagcagcgaagtatgcggcgaagacaaccggtcgcccatccccaggcgagggaacaacagccttgcccccacacgatccttggccctctatgagaagaccggatgataccagttcgcccaagtcggcctctttgacaagagatttgccaaggaagcacgaccatccttcgccaaggcttccaggatcttcgccagttgacccggccttggtaggcttgcggggagccattaggcttgtagcataggaaagagaggtaaaaagccgaaaggctaggagcacgacgatggcgaaaaagctaaaaaacaggagagcgaagagagcacggagcgtgtaaagcggtaaaaaggggaagagcacggggagagtgaaaaatggcaggccggtttgggggcatatataaccctgtagtgagaccgttcgcctgccaaccaatcgagctctgacacgtgtcaaagggcagacgaaacggtaaattcccatcgggacggtgctgaacagtaaaaagcccgattacggagaaggaaaaacccaaagggcctattactattcatagtaataaaagagactaaataagcccccatcgacgctttgcaacgaacgtgaagaggagatttttctgaaagaaattttttgtaaacgtagaaacaaacaaactttacttgtaggaacaatataggtttcgacaggagcaccggtcgaaagggggcgccacataccataccacatggtttgcacggtctcggccgaagctcctatctcacccttgcccgtgaggggcttgttggcgatatggcatgaggcccttcgaccaaacctgccgaaagcatgcgaccgatggggattcaagcccgagacgtcagggttagtcaaggcgaacccccccccccctggcgaagactatggagcaaggacggcgagaggcagggaatcgcagccaagctagaggcctcatgggcgaaggactcaaggcgaagagcatatgccaaagggggacgacttcgccgtagcaggtttggccccgggagggccaaagaagctatcctggcccatcaaacctagaggtcaattgggtcgacaataacccgtcggcccgctaagggcccatggaccgcaattacgctatgtacccatgtaaatgtccctttcataagggcaaccatgtaaattcccctgcataaccaaagccctagtagtaagacctgtaatgggggctataaatagcccctagggccatgtaatggggggatcccaagtaaaattctcaaattaatacactttacttcttttccaaccactgttgagtgaccacgtcttttgacgtatgcggttgtcgtttcgacaacaccaaacaagccctaaattaggttatctacccccattatagttattcttgaatcagggttgatattaagaccttgtgattactgtgattacaagatatatcataatgttaagagaatttcttcagcatccctgaatattaccaaaaattcagagctttccttcacttcaactgatttttttttatttctctggcctgccattgagaatttaagctttcgtttaatgccatttgatagcttgttcctaactttatgtattcctcccattaactttattggaggattgatttttccctttttctgcaatgggtgaaactagcctgcatattgtgttaggtaatagggccaatgtataatcgtcttccttctctctctctctctctctctctctctcttccttctgtgtgtgtgcgtgtgcgcgcgcgcatgagcgcatgccagtgtgagggggagggatgctaaaggaggtcaaagtggccaaaaggacacgtccacaccccactaaattatagctgcaatctggagcagaagaggggggaagaatgtgaagaaaagggagaggagaagatagatgccagagtagggtgctcagagctcaaagtggctgacaaggtattggtttctactgtatgccacacctgcctgtgatgcagagcagaagggaggggatggataggggaggataagtgagaaataagggtaaggtgcaggaggataggctaggcaatagatgtagtgaatgcaatgtacagacagatggctggacgtaaagaaggtaaaggctagatctaggaggtgagcttgtttcagtggagatgggatcagtttctaagggaaaatggtcacacttgacattgctactacaacatgatggaatggtatcactcgacaaaacgtgaacactggatggtaactaattgtatcaatgaacttcactgttataaagctaaagtcactgttacaataccaaatttacaaaagaaatattaactgtcagtataaaattgttatttttagctcatttttccctgttagaggtttatgctcagtcttaatgtgagtccactaaaatcttggctggtttttactttgtttactaataaccaagagaaacagtaaatgagcaacaatttgaccataaaattttcaaatattttttgcagataaacctagatgcctttgtaagaaattaaaataggacatttatgtattttgtgaaaatcttgacatgtgctacttaacttctttctgagaggaaagaaccagtgttgagcaagcctactcatggcaattgtttctttttcttaccaatagacagttgaaggacaaaggaaaagtttggaagaaacgcagcagctccttgatcagaggaagtaagacaaccattcggtgaaccaagctctggatatttatttatttggtactgaccagcgtttaacctgacagggatttgatcacaaagtacagaagctccgttgaagacctgctcaagggggatacaagaagatagtaacatggtgactgtatggtagagttggaatgttaaagaggagctcgttgctacatgtgatcgttttctaatcagcatcggctacttttgtaatcgaggtagccttgaagttggtctggcttaggaacatactttcagtttgtgctatctcatattgttggtgggtaatgggttcatgggtttctgagacgagcatgctgcccagcttatattgaaggtttactgaggaccagtcattttgtttaatgggtaaatttgatccatgccattgcaaactcattgtattggaaaattgccattagtatttatctatttggaatttcacgcttattcgatatatgccgctacttaccccttcaagatacattctaaaaattttggactgaattgtccgttttcttcattcatcccctcctctcctgttcggagatattagaatcttatgaatatgagagatcctatcaggtatcttagtaacttgcaatcttatgatcttgctaggctgaaacgatatcgatcttattaaggtatagtttcatagtattctaatattatgcgagagatctatatgattccatgagattggtaggatatatgtttcgattggtggtattatttaaattaaggcggatttgaaagtaatgtgtataggctttaatttttataatgtattacatctcttttgataggatcctgatcctaagatacagtaagtcaaaaaatgatcttatctgaatcttcctacgtgaaattcatttctttgaaacaaaatgattcgtcttcattaaacctcacatagaaaagtttccagatcacagccaaagagcccacaagcaatacaacatttgaaaattaatgacgcaagagtatgactttttttcttgttatcacggagtaatttgggtttgataatgcgtcaccaagttcaagagaaaatgacctatgactatgagagcaagtacaaaaggttgagtcagccaaatgcaatattgtcaacgtcaaaatcctacacgaagaaaagggaagggagagagagagcaaagcagatgctcatgcagaatagctctgagaaaagatgcagtatcgtttgcatgggaatcctctgacatccgatagctctagtaacttcattcggcatcggacggagtcaagctagaacagcggatagcctcagcacatctataaaattatattctaagctcaacatgcaaacatgccaccttatcatccacatgcatgcaacatcatctgtaattcgttgaattctataaatcaacatccaatcatcttccttcacaatattttcacaatatttttaacacacacatacacaaacacatcatttttataataattaacatatattcgtccatataatcaaagtacgggaatatcatatttcatctacaatctcatacagagtctactaaatatatttcttctctttgaacatggtttgacaaaccatttttatttgttgggcctgttaggtaagctggttgcagtggctgcggctgcgctgcagcacatgcagccgaacaggcccgttgttaataactaatattatttttacttttagctcgattattaaaaaatattaaaagttagttaggaatttccacagcaaagcgtggggaatcaccacagcaaagcgcgggaatcacccagtatgacacaaaatcatccacaaccatcgatgccacctctgagccacagccactggcgcggtggcgccgctaggaagaaactgggggagaggggaaggcctctgcgccgtcgcagactccatcaccaccgccacagcttgcgcctccccggcgaggcccccttcattgctgcgctcttcctggccagcaaaatcgagatggctcctgattacccatggtcttcggccgctcgccgtctcctacggcgcatgtgcgggtggagctgatccccgaagatgcaatttatccaaagcaacgatgcattgttatgacttgtgagattttgcattgttgtgacttgtgagatttattgttaagagcatcctgagtgctgcaatttcgtcacagatttgatccaagtctgtattcatgtcagttgtctcaaattgcagcactacatgatgtatatgtgtacaccttttatttttatttttttgccattttgcaagcaaacattagagtatgtgaccaaatctataaagaaatgctaggtgggtggtctacttgattcttaactgttatcagataatcaggtcaggtcaggtggtctacttgattcttaactgttattctcatttgcacagaaagttcataaagaaatgcatagtacagaaaggcagattatatcagataatcagagttggggtgggttggaatattaggcttggtccacacagctagagacttcctaccataagcgcatttcaccttttcctgcaattggagatttggatcaagaacaaagcgaatatatcagaatgcaagctatgaatcgagttagttaattgtttgctgaacagtagaaactatacttggtagatttttataattgctactttaagggggaataaaagaaactctatcctgttttcgattgttttgacatgcggtttgatcttttcttagcagttaccgacttactgtaatcaagcgaactctccgatgagaactttggatgagctgtaatgttgccaaagcaattctttccatgtttttccctcaagcctggagagatgacagatgttgtcatcagatgggcctctctcaggttggcccattgatatttcctattggttggcccattacgcggcttcttttctagtataatctatacatatccagtagaagatgctatattttaaccagcaaagttgctatattttagggacagaggtaatagctagcagggtggcactattcaacctttagcatttgacggcgatgctatgcactacagcagatgccaatggcagaaatccaagaaccggtgtatgtatatgcactggtgtctggtgccaataaacaaatctctttcaaccgccaacaacttattgaattagtagctccattttccatataatgttttctagggaagacaccatttactttcaaagcagtacagtacatagagagtgggaaggaaaactttcaaaaccagggtctagattaatatattaggctgcagccataaaaacaccatcatttgtatccctgacaacaatcccacacccaccagaatctgcatcttgtagaaaaataagtcatcacagtttacctttaaaatgggaggcaaatttgcattttcagctcatttcacctttagcctactctttcctcagtttctccacagcaaaacactaatcaagacaacaaaagttagtaatctgaagttgataaaaaacaaataaaattagtagcacctttagcataccttatagttgtattttgtgttacaaacctagcagatatctcaggtccaacaagagtggtcatttgtgccctgtccacgctggcaggcacatgtgacgctctaaggtgccaaaagtggcaaaaaaaaattagaaaagcttctctccaattaataatcgatccaaaaaggattcaatgattagcacacaatatattctatcaataaaagttatggcaggatgtctaaatgcttagcacatagagaagcctaacaagtacatacagtttcagatgtccttttgagaccaattgcaagagctccgtcataacatcattgaacaaacttgagagaaataaatctgctggttacctgcaacgttgaaatgacataacaaaatattatgatatgaagtcagaaaattattataaatataattgatgagctgaagcgctagaagagactatcatttgctatccattctgtaagacatcgagggaagtagtttgcaaacaaacatataagtaacacaatgaagggcaaaggttgtgtctcaaataaattaagtatgcataaaagaatatcactaatccatgaaataacaaaatgcaaaaaaaatttgtagacagtgaccagcagaagccatattccaagggtgagcaacagatacagcaccagccacaggagtaccctcaccttattctctgtgacacataacctaaaaggataacagataagaaatacaaaatgaaaattgcagttcaattattcaataccaactgcagtaaatagcaaattgcatgcacgtgaggagattatggaaaataaaacaagaatattggcacctatgcttaccctaacagcaaacaagggagcctgtggatacttctaatgaaggtaattggaaaaccacatggatatcttctgtccatccagcacagtagaaacaatcatactgcaaggataaatagtttgaggaacaagcaccagttgaacatgtttcagcaattgctaccaaacatgcaattctgtgacatcttttttcctggtgcaagattctgtatttgagggtttgctaatttccacatgctccatcattgatttaggcttaactccacttctcccatttccactctcgtgaagggatccaagtttcaaccaggggatctggacccatggttagaaatcataataaaaaatagggttaatttgatccatgccattacaaatatgcagtgacttgccattcgctatcagtcctaacatttaccatgtaagacatgattcagtttcaaaagaacaaacatgaattactcagccacacagtgcaagggatcacaaaaaaataacaaataaatttaaatgatgttacaaagatactctccaccatattcagtttgctctcctagaaaccaccatattaattctaggggacaaaaagctgaattcctacattaattaaaaaattagaaattctcactgtaatcagtaaaaagaatagatcatatatgtcgaattttctcacatgtgaatcctacagcctctattaagcaatgcaaaggaagagattgttttccgcatagaagttaaaattgaaataaatagttgtccgtgcaaattaacattacacaaaatttgcttgctcgtgcaatgaataggttgattatataactaactgcctagtcaatcacttaattaatactccagtttttaatagatgatgctattgacttttagacatacgtctgaccattcgttttttggcaaatgcctttttgaaacttctatctgtagttcattttttggcaaatgttatcatcttttgcatctctagacattggtttacacaattacgtttaataaaagcaatgtcagttaaagcagatgaatcttcaactttctaatgccatatatcattaaaagatttgcctatgaagaaacttgcagttgtggaagagactgctacatcatgtttggaacaagttcagaaggtaggcaaacatttaaaatggattttatggcaaatttctagatcttatttattaaaccaaatttggtagcgcaatcatagggacttacagaagcagtaaaatcactagttaatccagtcatcacaacaagaggtgttgaatcatccccagaaaggactacatctcaaaagccaatatctgcttctgcaacatagaactaaatcatcaggcatctcttgctagcctatcaatctgaagcaatcaaaaatcatcagcaccttcacaatcagaagctagtaactaatgtaaagcaatggttccaccatcacaaaccatgtacggttgcccatgttacagaaaattcaacaaatatgataaactaacaaaaactatagctgcagcatcgttctagctttatctcatggtgtccaaactaaacagaacatgaatctctgccatatagtaaatttaagtcagttaggtttctgaagtaaactcacacaaaggcagtataggagtttccttttcaaatattggctgctcaacagaagactaacagtatcatcagtttaatcattccagtaaagtggcattaaaattaatgccgatgttcatcaaaattaatcttaaattcttaatacaagacttcgtctcattcctttgctcctcaatgataaaaaaatttaaatgcaacgaacaaattaaaacaatcaagatatcctcacaaccatcttgttcttctttccagcagatagcaacagcactttcccatcaactacatcaccttcctcaaccaacttatcctcgctatcaattcttatgttatttaagtatagccccccttgcttaataagccgcctaaccgctgatttgctagcaagcaaacctgtggagactgctagatcaaccaggggagacttcaaaacttggccatatggcaaaaagcatgatggtacgtcatctgctatcccctcaattgtttgtgaatccaactgagtctgtgccccaggccgtaaggcttccgtggctttcaacgcttcctccaatccctcctcaccatgcacaaaacgtgtgacctcttctgcaagcctcctctgaattgtgttcggcacatagccaggcttcttcatcgactcttccagctcctgaatctcatccaggctcatgaatgtcagtatcttcataaaccttatgacatcaatatctggcactgagaagaagtactgatagaatttgtatggtgacaacatcttgggcgaaagccagattgctccatcctccgtcttgccaaacttcgtcccatcactcttcagcagtagtgggaatgtcaggccgtgtgccccctcaacctgtaaaatcttccgaattaactcagtccccgctggatgtttccccactgatcacttcctccaatctgcacattaacacccatattgcggaacatgtacaggaagtcatagccctgcaannnnnnnnnnnnnnactcagtgtagctcattccgtcctcggacataagccgcttcttgacactctccttggctatcatcgtcccaacacgagcgaatctccccacctccttgaggaaatccagcagcgtgatgtccttccaccagtcatagttatcaaggatctgaaaagaacccatcttttctcccgaattgaccaaagcctgctcattttgctccaagttcaagtttttaccggattgcgaatgttgggagggctcgggtgcacggtcaaggatctggccgatgagcgatttgatagcgttggagttggtctcgacggcggcgaggtcgagctcgggccgctcggcgctctttccagaggggtcaccgacacggccggtggcgccgccgacgagcgcgacggcgttgtgaccgcagcggcggaaccaggagagcacgacgagcccgaggaggttcccgaggtggaggctctccgccgtggggtcgaagccgcagtacgccttgagctccctagggctcgctgaagccgaccccagagactcagaagtggtggcctccacgagcccccgctcccggagcacctccactacgctgcgccggataaccgtggatgcggcggcggcaccggccggggcggcgctggcggagaggctgcggctctggcggaggaggagacggcaacggtgagggcggaggaaggttcgcaacgaggcagccatagcgatggaagccatcgcccaagggagaaacggattaggaggaaatttgctgtgcgcccccgcccccctcttccctggtgatagggtttccgtaccaccccaccccctagtcaatacaaagggattgtttagagcatcgggagctcatccaaatatcatccttcatatgtccatatggatagctatttaaaaaagattcctcattcatatctctttctactctaacaaatcatccatatcacatcctcctatattttattaatatcttccaactaatcttatacttttaagagatatattttgaacgactaaatgctaacggtattatttatcgcgataaaatttcgaaataaataatttttaagagatataattttaacgggtaattttttaattgatatatttgatctgagtgaatcatagcaagaaaaatcataccaatacaaataaaatgaacatactagtactatctctactcagattcttttctctgcttgaacatactagtactatctctgctcagtattctctactcttctctactactactactactattttctcatagctagtgagggcaacggcgggcgagcgggggcggtggggcggtggcaggcgggcgggcaagaggagcagatgggcggggaggaggcagactgcgacgggcggacgggcgaggcgtgggcaaggcgccgtcgggcggggaagcagcagcagtggccggtgggcgcggaaccgcgcaggcgaggcggtggatgcttacacgggcgggtggcgtaggcggccggcgggcggggaagcggcggcggtggtcggtgggagcgaagccacgcaagcgagtggcgtaggcggccggtggttgcggtgccgcgcaggcgacggcggcggttgctaaggtgggcaggtggcgcaggtgggggcgggatcaggagcggcagcagctgctgcaggcgggcgcagaagcggcgtcggcggccggcgagcaacgacgacgacggagggtacgttgatccggaaatcccgatgagggcgggagcaagaacgttgaggtatggcgtgaggagagtgaattgctatatttggccgaactctctccgatttggtgcaacgtctattttttggaggcctcgatgccgtatctgttggagggacaatttcttatcccatgcgctatatttcgaatggagtaccggatagaggatctgctagggatttttttttccacatcgaatctttcgacacatgcatagagcattaaatataaatataaaaaaactaattgcatagtttgcatggaaatcgcgagacaaatcttttaagcctaattagtccatgattagccataaagtgttacagtaaccccacgtgtgctaatgatggattaattaggcttaataaattcatctcgcggtttccagcctagttatgaaattagttttttcattcgtgtccgtaaacctcttccgacatccggtcaaacgtccgatgtgacatccaaaaattttcttttcacgaactaaacacacccaaaggagaaacacaacaaatcacacgatatctattatctatatgtctatttttatctctactattataaaaattgaagatgtttttgccgatacttttggtacgtcatccgtgtttgaatcggtttttaagttcaatcgcttttggaaatacagatccgtgtttgagtcggtttttaactttgtttgtttttagaaatacagaagaagtcatataagaaatctctttaaaaacttgcatgttaacttgagacgaccggacctctaattgcagctcatgattttgtaaaaagaatatccaagcgaattcccacggtgaatttcaccttagctaaaccgtacaacaataataatattaaaacgttgcaacgcacgggtattttttctagtctatactagtataaaaaggagtagttcagtttaccccttccaattcaataggttaaatcagggcctgtttagttcgcgaaatgaaaattttcgggtgtcacatcggacgtttgaccggatgtcggaaagggtttttggacatgaatgagaaaactaatttcataactcgcctgtaaaccgtgagacgaatcttttgaacctaattaatccgccattagcacatgtggattactgtagcacttatggctaatcatggactaattaggctcaaaagattcgtctcatgatttcctccctaactgtgcaattagtttttcttttaatctatatttaatacttcatacatgtgtccaaagattcgatgtgatgtttttgggaaaaaaattttggaaactaaacatggcctcaatggtgaaatccctacccttcgcctgcccatcacggcgatcgtggttccctgtcggctagcgtcgatggcactcttccttctccccttgatattgccctcgatgtcgtgccacctacactcagatttcgccatccgcaattaaaaccactcggccttctccctcgctcaatctcgctggccgtctctagcaccgtagcccgccagccgcttccatccatgcattcgctactaccgtaacggtctctgccttcccttcgttgctgcggcgccacgccaatcttcgttttccctttcgccgccacaccacgggctcaatcagtcgcccatcccgtgcatacgctgccatccgttgagcctcctctgctacatcgcgccccaagggtcatcaagtcacctccactagccgtcgtgcggggcaagccttgctgccgcacggcatggagtaagtggttttccgtcggagtccttgctgctccgtgattctgccaccagagcattctcgagtccgcatatgacaaaaaatgacggaccaattcgatcgcagttcctcttgacagcgggttagtaatatcaatccattgagtgctaattccattatttcagcttacatgttatgttaatgattattgaaacacgtcctaatttgattactacttcctgacaacatgattggcctcgactggatttgaataatcacccaaggtcagaaagcgactggcctctgcttatttcaatgaacatacagagcactgtatcacaatcgcctgcactaacaggtaaaatacacactgaatagggacattgtgttgttatggatgtattgatgtcttctttttttgccaaaacatttgatttattttatacatatgatttccttcatctgaattgcttcctgtattgtacatagattttcactaatgttatgtatatttttttaatttgctgaactcccaggattaaacttggttactaaatgttatggttcctttaatcacagccaaccaacggatatgcacatatgaggtaaaatttgtcatcggaaagttaataaaattttctttacttttggagaaagtgtaacttgtgggttttgatataccatttgaattgagaaatttttcaaccttcagatgtacctcttccttatatctgatcccattgaatgatagagtgcagtggctaccgatgatgtggctgaacattcatataataggaaaaatcagaacatcattttcttttaggacataaagctcaccactaattgcacatcggcctagaatgtgttggatatggttctgactggatgtagtcccttgataacttcttctacatatggaacatatggaagtaaagaaatggtttaatttttgataatattgctctttttgtttcctcttagagagttctctttaagaatgatctctcccttttagtccataggcttaatttatttgagagagatacacttactaattggattaatatgttgtaattattttccttttattttttttcaatatattaactgtgggggctttccctacagtgttttcccttaaaaaaaaataacttcttctacaatcacatattcttttgaggatgggataattattaggaaaacatagatggtaaaattattgtaataattgccacttagaccggtgctatgcctatgagcatgtgacattatcaaagtttatgcttttgtaggtgtgacagaaacatctgagggccagtttcagggggacatattgccatttcgcattagtttctcattgttgtgtgcatgcataggcaaaggagaagagtgtagggaaacactaatcattccttaaagggatatctccttatttttacatgtcccttaaaaggttatcaaaaaaattgaaaaaaaaatagtaagatagatcaatatgtgatatatcattccgtaaacatgcatattcaaattcaacttatacaattaaaaacaaaaacaacaaatttgacaatgaatagaatgtgtaaatcatggttaaatttgttatttttgttttgaattgtataaatcgaattttaacttacatgttcgtttcaaattatataagtcaaatttttaaaaaagataacttcttctacaattacatcaagatgtgctttgcatttagacaaaaaaatatagatcctaaattagaaacatgcatattcaatttcaacttatacaattagaaacaaaaacaacaaatttgacaatgaacagaatgcgtaaatcgtggttaaatttgttatttttgtttcaaattgtaaaagtcgaattttaacttacatgtttgtggaaaggtatatcatatattgatctatcttaacatttctttttaaaatttgttgatgattttttaaatgaaatgcacaaaatgagagggtgccctctcgagggataaaaatccatctccacgagtggtctttatagtggccaaggacttgctatcgacatgccaaaattcacctttttaacattatcaactcttgttcctgggtgattgggagagaaaacacctcgttttctgtacgcacacttccgaaactactaaacggtgcgttttttaaaaaattttctatagaaaagttgttttaaaaaatcatattaatccattcttaaaatttaaaatagttaatactcaattaatcatgcgttaatggctcaccttattttgcgtatcttctcaatcttctcttttcctctcctctcaaacaatccctccgtggtgtgaaggtaatctcacttgaattagtataggctaccatttacacctgaacattagaaaccggaaatctattgggcaaatacttattttgcgggtgaacatttttttattaaatttcagacttcggtgtgtcctatggtcagaatgcagtaccttttagacttattcattctggattacaaactctggaaaacggttggagatacacagatattacccaacaagaaaaaccaggacattccatttatttctctactcctcctttcatatatatctatgttcgttattcttcaatttctttcatgtagatatttattctaaagcgatgttaatccattaaattatgcatgctacatattaagtcctataccaaactgtggagattatggataccccatatctacatgacagttataatttagtcggatatatggtaccaaatatagatagaatatctctatgaggactcgggttagattctaaacttgtatgtcaagaaaatacccgggatcctagtcggttacgattgtattttatctataatcccatattccgttaggatatggacggtactttgtaaagcgaactccttcccctatataaggagggtccatgtgcctctcggggcgcgattcttttttccaatttatacaatcaataacacactcggcggaatcatccccggacaggagtagggtattacttcttgaataagaagacctgaacatgtataaaatcccttgtctccaaacccatccactttcctagcttgatagccacccccttttattattgtcgaaatcttgcttcgacagttggcgcgccaggtaggggcagcgtcaagtttttgccgactaagtgcgatgggttccgtttctggcatcgacgacttcgccttccctcctgagcagacgttccggttcggcagcctcaacttcatcaccaacgacttcggcaagatctctctccttgactcggattccaaccagtcgggaagagaccaggtccctgtgccgttcggtattccgaactcggccgaggcctactccaagatcatctctcccgagtcggcttcaaaccactcggacgagatccaatctacttttccgccaccagatcaagacgacgggtcctatccctcaatcctgatgaaacttcctgatgatttggccgctgtcttcacagtcaagacatctcccactcgaagatctaggcgagctccggcttcggccccgatccgatctagatccagggaggttggcgttatactccaacctcttgggacagtctcgacgtatgagatttttactcggattcctatcaaacatgtctatttttggacctttgagtatttatcactcaacccttcttgtattttttgtccttgatatgttcaagttgagaagcagtcggctgggtatcttactaagtaccatgcgtgcttcgctataaaaccactcggttcttgactatatgtttagttttttaactaatcacatagtcgggggctacacctaattaggtgcatctactcgatgcaccatgttttattttcgcccttcgcagtctttgattttagcactcggcaagctggagcaagttgaattgaagcactcggattactgttttttgttttgagaaggctattactgtcaattgcgaaggtctcggggactactgtggagatgatggataccccatatctacatgacagttataatttagtcggatatatggtaccaaatatagacagaatatctctataaggactcgggttagattctaaacttgtatgtcaagaaaatacccgggatcctagtcggttacgattgtattttatctataatcccatattccgttaggatatggacggtactttgtaaagtggactccttcccctatataaggagggtccatgtgcctctcaggacgcgattcttttttccaatttatacaatcaataatacactcggcggaatcatccccggacaggagtagggtattacttcttgaataagaaggcctgaacctgtataaaatcccttgtctctaaacccatccactttcctagcttgatagccacccccttttattattgtcgaaatcttgcttcgacacaaatgtccctgtgttttttgtggtgtttctttttgctatagtctggtgtggaaaatatggtgaaggaaaagaaaatgctagatttctttaaattaaaaaggtaggttttcttttgctatccagattcaacatttctcatggctcattattttacaagatgatcatcttttggtgtaataatatttgagttttttgcaattaaccggtttacactaaatttctattaactatggaaagaatggtaaaacttcacttagagcacgtggttgtgaacttgtcaggttcaaatccaaatcttattatccatttcagaaatcaatcacttgacatgtgaagtcacatttgttcaagctaccttttggcttatttagtcatttcactgtcgaagggaagccacatttgttcctttcttttgtaacatagccattcagtggatataaaaagctatataccattctagcttcattcttccctgttattttcggtttgacatattttagtccatgggttgttgacagagaattaagaaataatttctttagtttttttttgtttgttgaaggtgaaacaaaaagtcggcagaccttgctgtgtggcaaacgaatgaggttgtggggtcaagagagatgagcaatccatattgcttgatcctaattcgggcatgatggtggaggcggtgagaagttaagtagcgtgaaaagcatagtttctcaaacctttggtttgagacttttacttttattttgtatattgattctgatggcggatattttgctggctacctagcgaaattcaattgccacacataaacaatgtgtggggtttaattccttttttatgtaatagttttaatttatgtttttcaatacgtgcattgcacgtgcactactactagtcttacaaaaaggtaaattgatacaacgatttggaattaggtaggtacgacttattgtagcaattagcaagtgggtgcatcttaatacaataacttaagaatgttcctccgtctcacaaaaaaaccacacctaggatactattgtgtcaaatccaatcctagattggtttttttagacgaagggagtactattttagtgcagcaatttagctaagtatgtgttattttggttaacgaatgctagatgagttttttcatgatatcatgttatattataatgttgaatttaatctataaaaaactaattgctcatccaatttataccgccatcttggatttttttcttcaccttctaaaatctcaaccaaaatacataattcttttgatattaaaatataattgagagttaataaattgaagtatgcttatacaaatttcacaagtatattgaaaaaaggagtacttaattaagtttagttttttgcatccatatactcacctattaaatttttgcactaaataacacccacttgtcaagttattacactatagcacgcacttctcaagttatttcactaaattacacccacctgccaagttatcataccatggatgcaatttactcttttacaaattgtcgaacaatattgcaccacgttattgcaaagtgttttaacatgtatcaacaccatgaaaaaattttcaataaaaatgtttcggatctttcattgattgaagaaaagtgtttcattgctcaaagaaaatatattgaattttcaacacagagaaaaggggaccaaccatttaaccggtaaaacataatcgaagcacacttggagcatttaatttatagcgattgaaacatcgagttttctctattgagggcctgtttggcacaactctagctctacccccacctctcctggagctggagcccagccaaacagtttcagttccacctaaagtgggagcggagctgggtggagtgctctcataaaatgaactagagaggtggagctggatttagacagctccacaactccactccagactcaactcctagagctaaatttaggagttagagctctaccaaacaagccctgagacatccacggacctcgcttatcaaagatatatatatatatatatatatatatatatatatatatatatatatatatatatatatatatatatatatatatatatatatatatattataccatcaaaattaacgttgaaacattttgatccaacacaaaaaatcgaaaaaattgcaaaaaaaaaaatgtaccactcaagatcctccttcctcctctccggtggccagccatcaccgggcttgccactagagcactcttccatgctgccaacggattgtggctgccattgtgtcacaccaccgtcgaggaagctgaggcctagctcgcaccaccaacatcgaggatgagagatcatcgttgtcatgtcgcactaccatcgaggaagacgtggccaaccacgtgccaccctcaaggaagttgaggtagagctctctccatgttgcccatgccatgctgatgacgagaggcgaagctattctatgccgtgtcgagcgttgggaacgagaggcggagctcgttactttacctccatcgcatcaacaacgagagagcacatctgttggggatgagatatggagagagaagatacggataggggagcaagaggaaacgatttttgtggtgagaaatgtctccaagagatgttgggcgttcgatatttggcttgctatggacactcgatatgaagcgtttctgcaatacaagtagtaagattagataaaactttttaaactttctatcgacttttgaggtcacgactacgatatttggatggtatggagatcttcgatatttggtgtctattctgatttgtgcatcttgtgtcttggcttgtcttggtttttgttggtttgtccatttcctcctagggtgcttgtatttatacccataggtgtccccttgtccaagtagactagggagaccaatatggatacgatccaaatagactagagttgccctcagcaatcggagttcggtacccttcctagcccctagctgtttttatggaaaagccattttccacaaagacagcttaaatcttataaccaagcaagctgaagctgacaaaatcctagcccctagccatgaagttgggaaaaccaattcccgattgcacggcttagttaatacgcattcagaatagagcaaaggaacgatatgatcgacttcgagacagggcgatataagaaaagaggatcaacggacaaatattgcatatacaaacacttacagaggttgtcggagaatccatctcttgaacccatctcgtggagaccttgaagcatcaaaatccccctagcgcgccactgtcgactttttaggttacgactatggtagttgcatggtatggacatcgttggtaccagggtatatgcaagattcaggtaaaagagatagagacaagggtttttatataggttcgggccccttatctgataggtaatagccctactcctgttggccgaagccggtgttgctcttattcatctgaatcacacaagtacaatatttgggataacctatctagctgtcgtcgacttggcggcatagataaccaacacgtagtcaacgacagggtagtcttccttctcgagtacgaactcaccgagatcagagatggcgcaaatccctcttgtcggcttccgcaggcaccatattgggtatgtctaggctcatctctgatgtcaatgtctagcggcgtgtgttggtttgttctggcttgtcttggcttagtccctcctcctcttaggggttttgtatttatacccatagatgtccacttgtccaagtagaactagggacaccaatatagatacaatttgagtagtccttatcatttccacatagaattctacttgtccttccttatccggaactccttttatatacgaggtatgattccatataagacttagtatatggtgggtgatgaaccctaagttccactcgagactcaaggctgttgttggcccgatctttcggtgagttgagataactacgatttgggagacacgttgacggcccaactacaaccgtacaagacattgcgttgcgccttagcaatcgatacacctctccatgggttgttgatcttgccggtacaaatcaaccttattcctgcaagcaaatcgaagaaacaagcaagaacaagataaaagcaatctgaatttccaatagttgttgaatacgaatgataagttggggtttcgaatacaagcagatggatggtctagccgacgcgcgcgctgcaaggaagtagcaatggctaaactttcatctaaacaaaacccgagaaacccttaaggggtacctagctatttaaggaggtgggaggacgaccaagagggtcctagggtcgtgctccaccagcttggggcgcaccccacatgggccccacctggtccggggtcccaaatgaagttacaagcccacaggcccattataggtgacgcagcaccttgttcctgtgattccggccacacgagatggaattcggagaagaagctagatccgttggaaagagggctccgagagctttccatcaaatactcacgggccgaaaacggaggtcgtatgcagattcggcggctgtttgaagtcaacagtgtagtaggtggccgaatcggattccagcactgggaggacttgatctcgatgtcttcttgttagtccatgatgtgagcaatggttgcatccgtggtagccatggtcacatcagtgggccccactgagcttagtcaattactattgggtatgtggtatacataaccatgatagcggccaaaatggctctcgcgcggaaacagcctccatgcggctccgccccacaagctatatgacaaccatcactgcttccaagttcacttgcgaaggcgatcaacgaggccgcactaccagggcagtctccatgtcactgcatgctccacacaatcagagctgcatcagctcaccgtgtccgctacgaccggcggacggctccacagctggcaacgtcggctgaagcaagccatcgaggccaactcgtcactccacgcggcagaagctgccttgaccttgctagctttgcggacggacaaccccgctactgttgatatttcttaacgacattactagaaatataattcctagcaatgatgtagaaatattcatggtatacttatggttacagatatgatccgcaagcgcacggatataccatttttttaatccaaagtgaagatatgataagagagtactatgctaataatttatatattacttgcgtacatcaaggtcgatgtaggggttaagtaattcaaaggttaggtgacacacagaagaaagaactatgatactctcactaaatataatccaagctaagtggaggaagaataagaaaataattcattcctatacttctaatatgcaaacatctttagtctacacttgttagtatacagtcatgcaaccaataccccctaacagtgccctcctggtgtttcgagagaccaccccgggttgccgagttccttacgacaatctgtaatggctgtccaaccggggctaaatacggaaaagtaccctccccaggaatttgtcttaggaatatatactatcatggaggaatacctgtactgagctgtcaccattagcgacccacctcgactgacccgtagcatatatgctcagatagggatacttaataatctagataccacgtctacattattaaatactactctatatcccccgagatgacatagagcaaccgagcaatcggacactaaacccacaccattgcacctctctgatagactagctacacaactatattgatacaagtataaaatgaagtcggtactcagataatataaatggaataaaataccgaagatgtataaagaaaaatattctattaattcaataagtcttacaaaagaagagaggaaagctactagagccatacccgaattctcctgaagacccgaggactaagaatactattctaattcctactccactagcactagtatactactaaacttgagagagggagagagctcttcttcttgagtgtgtggagagagtgaggatgtgaggtccttatatacggcagttatgacggttataagtatgcgaaatgtccattctgccccgcaactgccatcaggacatcatctagagcgtccaagccaaaacctggaatcaacggcagagatgggggtgccgaaccatgggcttggccattctggcccccttaactcctcataagtctggatctcaacagcgtccgattgattgatcgtttattttgctgtcgattctcgtccatttatatgtgcttcttctgcatacatgttagtagcatagtatatagtggaagtagatattttatttggaaattatgcatcgcaaccatagctagtcttcattaatggggtaatattgacggtcgaaattggtcgataacgaccgtcaacagctaccatgtcaagcgttgccccacacctcagtgcctgcctggctccacgggtgctgccagcactccgtcgctgctgtcacgtcccaaaacgaccctaaaatgcattccttaaattattcctaaaataagaaaaattcttgttaaagtcttcaacaataaaatgtgtaaacctaaaagtcaaatgaggcttggagaatttttgtttattttctcaaagcctaaaatgcgtaatcaaatttagtggaattttcagagcacaaataataattatcaagaaataaacaaagtttaatagtttttctaaaaagaaaaccctaaatcccttcccctctctctgggctgaattcggcccattcccctccccct

SEQ ID NO: 63734 - DNA, 4305 bp, Oryza sativa
ctttacgagctccaataactcagaaaatgccttgtcactcataccatttttagccttccattgcaagaattacagcgtggtacccaaatttttgtggccctgctcacaacctgggtacaacgacgttctgtggtccgctaacatgagctctagttattgcacctccttttcactttcgcagtcctcaggtatgtcccgcaacatttgaccaagatcatctgcaccgtcattatcttcaacatctacgtctgcctcgcccattgtgttttcttcaaatccctagtacaaagccccgtccggaatgttctcgtcttctacttcatcttcttccattgcaacccctagctctccgtgcaaggttcaacaattgtagctacgcatgaacccccactgaaacaggtgggaatgaatagttcgtgcagtggaatactccttctggttttttcacttatcgcatggacaacatataaaaccgttacgcttgttatcattggccacactcaaaaagtaatgcacgtcgttaataaactctttcgactgccagtccgcgtacatccattgccgatccatctacctgaaatcttaaaaaaaaatccacgaaagacaaactcattaaataatcatacaataatttaaaacatcatccttaaaatcattaaataatcatacaataatttaaactattttccaattaacttagttttcaattattttgtacaaataatcatataataattatacaataattccacaaagtatccattttttcattatttttaaatttccaaacataccttcattgtttttcaatagttgtttatattttttcctttgtcaatgttggcgatatggcatgagacccttcgaccaaacctgccgaaaacatgcgaccgatgaggattcaagcccgagacgtcagggttagtcgaggcgaaccctccccatgtcaaaaactatggagcaaagagcagccaagctagaggcctcctgggcgaattgcgcaaggcgaagagcatatgccgaagggggacgacttcgccgtagcaggttcggccccgggagggccgaagaatctgtcctggcccatcaagcccaagggttaattgggtcgacaataacctgtcggctcgctaagggcccatggaccgcaattacgctatgtacccatgtaaatgtccctttcataagggcaaccatgtaaattcccctgtataactaaagccctagtagtaagacctgtaatgggggctataaatagcccccgtagggccatgtaatagggggatctcaagtaaaaattctcaaattaatacactttacttcttttccatccactgtttagtaaccacgtctttcaacgtatgcggttgtcgtttcgataacagtcaacttttctataacatatttatccaaattattttaacctaattttccctcaacaagttttctctctcatcatttcccacccatataccttgttggagaaaatattgaatacaaacaaagccataaatgtaacatgctaaacacacatcattagataatgaagttgctaaccttctcgattcctccgatttgtatattatcaacaaaaaaatttattaaaaattttggcagcacctccctccctcaaagctccattttgcagcaatgacttgggctggaggaggaagaaaggatatatatagttgggtcaccaaccgggactaaagatctccgggactaaagagatgatctttagtcccggatggggttagttccccagccccccgacaggagtctgacacgccctgtcagagggaaaaccagccctaaagatcacttaatcccgttggagtaataaactgggacaaaaaaacctctttattcccggttcttgtttgaacacctgtatgaagtattaaatataagctaaaaaataactatctgcataggttgcgactaatttgcgaataatttgcgaatgtggtcctacagtaaacatttgctaatgacggattaattaggcttaataaatttatttgctaatgacggattaattgctccatgatttgacaatgtgatcctacagcaattagtttttttttataagtgcccgaacaccctatgcaacactttatataatacccgatgtggcacgacaaaactttacacacccttggatcttaacacccccttagttgggaaaattttttgggtttagttatcacatcggatatacggatacacatttaaagtattaaacgtagtataataacaaaataaattacagattccgccaggaaactgtgatacgaatttattaagcctaattaatccgttattagtaaatgtttaccgtagcaccacattgtcaaatcatggcgcaattatgcttaaaagattcgtctcgcaatttacacgtaatctgtgtaattatttttttattttatatatttaatactctgtacatatgtctaaatattcgatatgacagcgtgaaaatgttttgttttagaactaaacatgctacagacgtcgtagccgagggagtgggatacagccgagatcatgctgcactttctgccggatggaccgtacagcaggaagccacgcttccaacgtcgaagtgctatttcttcccctcccgaaacaacgtacgtgcttgatctcatccttcttggcggggtccatggcgagtgtggaacgaacgtggctgggtgcatgtttccacgggatgtggctccacaggaccacatcgtattaccaccactgccacagttggtgaagagccacctatctctcagctgagccggctcttggttcctggctcgtgcccccgcaggattatgtcgcgcaggtaggggctctgcatgagctcacggtggcgcttgtggaacacgaacaccagcttgtgctttcaattcccgcttgtccttgagctggttccaccacgtgttggcgccggggaagctgtcgatgacctgctggttcttgtccaaccactcataattatattgcgttataagatcgagaatacttgtcttcgggctaccgggcggggggagcaaaaatagggcgctccccccgccccgcctcagtgcgcggtgatgtcgttaggccccaccataatatctgcccccacctgcaacaaatcaaccacatattttggaaaccatctattaaagaaatttggtttattttttgatccacaaaaaatgtttcaccgagtgtactcacaatgtttcactatgtatagatctaatgttgcagtgaactgaaatctttcattgcaacaaaaaaacctacatattttggaaacccctattaagggaattcgttttattttttgttccaccgaaaaatatttcacctattgtacttataatgtttcactatatatagattaaatgttgcagtgaactgaaacaatctttcgctatttgctgaaacattgtttttatataaggtgaaacaacactcgatttaaacgagtgaaacattttcgatctacttagtgaaataatttcgatataccaggtggaacatcgtgtaacatttaaaaataattcaaaaataagctaaaaaaatttttcgtcggaatatatccatgtgtggtcttgttttgaagatttaattgcaatgaatttaatggtgcaattggatcataatttggataagtaatttaagagaaaaaacagttgaaaggagtttttgcacgtaaatcgggcgctgacgtcaccgaatttctcgaaatgatcgggcgcccgagccatacaggttcccttataagatgttgtaacaccctgaaaattcgaccgataaaaccaaaactctaaaaatacggattttcaaaaactttttaaatcaattgcatcatgctgatcttattcgcctatttttggatttgatctcgaagtttattaatcgtgagtaaagaatagttaattagaaataaaccttaaaaataaattggtaaaataaatataaattaaaataaagattaggtgtggatagaagtaaataaaatattgtcgcgaccatatttggatcaattaaatttaaatacgatggaataataattaaccctaattaaaaaacttcaaataaattatataaataataataataataataataaatgtgtgatattaatctagggtgagttcattagttgagataacacaattattgagtaaaatgcatatatgcaaaaattaggaattgtggaattaaatttatatgggaaatacacaaaaatcggtttaatagaaaaaaccactgttcattggccgccacacgtgttcgacgatgtcccctagcctt

SEQ ID NO: 63735 - DNA, 1891 bp, Oryza sativa
cctcccctccatccccaagcctctccacacccatccccatctttcccctccttctttttcttctccacgcgccgccgtcgttgtgccgccgcgccgctgttgccatgccatcgcgccgccgcctttgaagccgccgcgccgtcgcctcggagccgccgcgccgtgcgccgccgtcgctgtcgtcgccgccgaccgtcgctgtcggtaagccgccgccccccccccccctgcgtccatcgtcatcgccgcccgggaggaagaagccgagagagagagagaaaagaagagaggaagagagaaggaagccgggaggagaaaggaaaggagagagaaaaagaaaagaaagaaaagagagaagagagaaaaagagaaaaagaaaagaaaaagaaagggaagaaaagaaaaaggaaaaaaagaagtaaatagggaattagagggagattgggaagtttagaaaatttaaaataattagagtatgattatagattagttatagtcgtagaattgcaaaatttaattatagattattcttagtaatctctataagaaatcaattcgcggtagtaatttagatgtaattaataactaaacaaatgtatgaattctcgtaaattattatggattatttttgggtaatctctataagtaatcgattaacggtagcaattcgtatttaattactagggattttagccgtgtattatatttaatcatagactaaattaagtcgtataatatttctaggatttcgtccgatgtttagctcgcaatagaaatttctagcctattatattggtatattgatcgggttgattaaattaaaaacttatgacaacaaaatatttatacacgcaaaatagtttaaatcaaaatggggttcgccctaattcgcgaatagtaaagataatataagagaattgattttcgcattcgacttccatttggatttacttggatttttatttgaattctaatcgaattcaaattgttcttacgcacgtaactacagagaccgagggagccgcggatccgggcgaaggtcaagacccacaagacctcgagcaaggcaagtcatcactattccttgatcacgttgatcccaattgcgaaattaattttgtttacaaacaagattgcatgcaatgatcaacatcccacttgtggttatgccatgccttgttattgttttccttcaaatccttgtaaccataattacgtatgagtccctagtcaattatgacacttgcttagaaaatgctattctagaatcttgcatgttcatatttatcaaatgctatatgcttgggcaattacctttgggaaggtaattgagatgcggcatgtggaggcatgagcaccacattgccatgataatggtgacatgaaaggaattaaaaacctatgttttagaccggggcggatggtggatttgggtggtatccgggaaaggctagtaccgtccctggtcaattaaggaccgagccatgaagttaagcatgaaacgaccccggatttctcgaatggggatagacctagcggagttaatagccgagcggaagcagtatccatgcatagtggtttctcatgtgtaaggcaggggctctacaatggtgtcgccattgttaggactgtcgtgtgttgagttgaacttagttataacttaattgcatgggtgtaaaacttcccttcctgggtgcgccagaactcctctcactgctagaaaccgtgtacgcctagagtgcatgaggatgaaaagttcatggagcgggtactgccaatgcgaggttatcgaaaggctttgccgtgacgcgtctcatgtgttgagacaaggctcatgtgttgggcagtcgcagaatgtgggtaaagtgtacatccactgcagtgtgagtgt

SEQ ID NO: 63736 - DNA, 9199 bp, Oryza sativa
actgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaaggcttagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaaaaatctatcctcgaaattgtgcaaagaataattaaaattcaatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttaaaaaggtttataaaaagaaaatcctaaaagaagttctttttcccccccttccctcttgggccggctcggcccacttctccctctctctctctctctcctcccccgcggcccatcggcctccccgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgttttcccctctctctctccctcggattcgtccgatttccttcccgcattcatcgccggcgcatctatggcggccgaaatctccgcggtcggtttccttcctccccggccgccttctctccctcccgacgctataaaaccgttgcccgagctccgctcttccgtttccgccgctcgccgctcgctctcgccgtcggattcgtgctcgcgccgtgctccgctctctccgccatcgccgccgagctccgttccgccgccgccgccgctccggacttcctccttactcggcgacacctccgtccgcttcgccgtgttgccgccgaccccgtccgccgctccgctccgtccgccgaccgtcggagcgccgtcgccatcgtcatcccgagccgcgccgccgctttcctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggtgccgaccgccgacagccgtgtgcgcccggtccaccgtggaccgagcggctgacgcgtggccccacttgcccgtggacccggtccgcgcgcccccttccttcggcgacgcaataaatgggttttttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattatggcattatcgctttatttaaattcccgcgttatcactgttttatttagccatgcctatttacctttgttatgaccatattattattgttattgttattattactaccttgttcaccctagacaaacaaaacctcaactagtggacactctactcatggtatccctagtataattttaggtagatgcttcgcaatttaattaggtaaccttaggtggttttacaactttagacttgggaattatttcatatcacctggatactctggaattgttggattattgtggaattggcttcacaccgccccctctattcaaaatcccctaaaatggttttaggctgggctcggggtgcatggttttgatagtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcagagggttggtgccctgctgctaggggctcagtcttgcctgcctgtcccgggggttccggccgtaggcaggattgggtcggtactcttgtctaaggctaggatgggttggaaactatgtcatgtctttcgtctgtataccgtggtggtatgtggcacgtggttgcacgtgagaaagatgtgtcttgtgggtaaagttgtacacctctgatcagagtataatctattcgaatagccgagccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaacaactttgcatagttctaagatcgtgtttacaaaatagccctgagcaactaaatgtctttaaatgctgtttactgcaaccctaaccctttatgttataattcccttgtactcccttgcatttattctgcatttgtgggtgtgtcttgttgagtacggtggttgtactcagtcttgctcaatttttcccaagcccagatgaggagttcctggaagatgaaggcttcggtgtctagctcgtgcctgccgtcaagcgcctgtggtcgtcgccctagtcttccgctgttcctcgtttgtcttcgtgtgttgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacagtgagtaaaccaaatctattcgaatagccgtgctcgcggttattgagcaccgggacatgtattacacttggctagactctgaattcttaacttgtgtgggatgggttatcgcatgatgaatttttatgctgttggagtcacttcctgagatgggggaaagtggacgtcctcagaaaaccataacgactcaatggcgggaagctatccttgggatcacaatggatggtggacataaccgtcattgtttaaatacaaacactggtactaaaatttgatcagttgatgctaggtcttaggcttgtgaaaagaattacaaaattggctttgcgcaaaagaaccatagccatcctttgaaatacccctttcatatgtattgttgctgtggtggcttgcggagtacggttggtactcacccttgcaaatataaaattaatcacaaacgggagatgaagctatggaggatccctatgcctactaccaggagagagatgaagacgacggtgcccaataggtcttagtacggtcgttgcctgtggcaatggcataccgctgcttaaattcccctgccttatctaaactctgcttttggttgtattccggaccgctcggtccaataatttaagacaatgcctgcgggctcatgttgtaataattcgtactagactctcgtgtatgagcatttggtattaaactctcgtgtatgagcatttggtattccggctatgaactcgtgtgtaccagactacttgatccagggaaatggtactgtttacacgattgattcctgttataaaaacgggggtctacagatgtgcaccaataaaacacaattttcaattatggtaacaacatgttgtgtgtcttctacctaactcattgatatggttgtaaaagatatgtcccataatcgaattattaagctgagcatctactcatggatccatactcgaaaggctcataaattgagtttaattaagataatgttctggacaatacatgtgtaattaaagtattaaataagatcatggataaagggttgttaaatttatcaatcaacaaccaccagtttccttcccaatcaagaaagaaaaaaaaagagataagatcttgtttttgtgtgatcggtgcaaaacataattcaaaactaatcaagccccaccagtgtcgttgtataagaaagatgagaagaggcaactgatcgagtttgaactctctctctaaccctaagccctaaatcaatcgccggatcgatttgacactgaaaggggttcatgaggtttctctttgtttccttttcatcaatagaaaatcagtacagagaagaagaagaagaagaaggagaaaaagcaaaaggacgaacaacaaaccaaataccggcttcaatggcttcacaaataaggtcagttagatcaattttcgcattaaacaaaggtgatcatgtttaggctaagatcttaagtaattaagtaagattaaactccaactacattttgttaattaggtgttacaataaaataacaatattacaaaagcgtccgtcaatgcagtttttttacaaaataaggttgagaacacaaattctagaacgtgaagtataaggtacataagtagttttacactgagtagttatgtatgactcgccagtttatttatcacacaccacacttgtgcgtctcctaacacacgcaaattaaaaaggatggagacctgcagtacatattactggtaagtggtaattaaagtgggtttatttaggctatgactctgcagagtttaaccgactaaacaaacacgaaaatgcattgtaacagaaaaacacagaaagatgcagctagctagcttgctaggcaattccccaccacacaagagccagcatcgatcccactcaacatatattccccggtgtagctctcttctgccttagattataccttgatggcctgtcggtaggactcggcctcgggagaggcgcgttccagattccagtttggccttcttcagcttttgtattaatcctgtcaagcatttgttcgtgttcctcttcctcttgccctgaggcatgaggttatgggcaacatccgccggcgtcatatcagtctcgtcgagcagtcgttggattttggtgaacaatgggtgctcggtgatgtctaggtagttgttggcgagcaccttgaaggcctcaaaccggcagtaggacatctcgatgtgcttgtccatcctcccccggcggatcagtcccggatcgagcttatcaacgtggttggttgtgagcacgatgatccgctcaccgccacatgctgaccacagcccatcaataaagttgagcagccccgacagcgttattttctttctttcatagtaccactggaagtctgtgctcatgcgtttatcctccaattccatcgcatgaatgtcctcaatgacgatgatggattgctctgttgtctggaggaagaggttccgcaggtcggtgttgttcgtgacggtcgttaggtcgaggtcatagacgtcatatttgagaaagttggccattgctgagatcgtgctggacttgcctgttccggacggaccgtatagcaggtatcctcgcttccacgccttgccgaccttggagtggtactcctttcccttctggaacatcttgagatcttctatgagctcatccttcttgccggggtccatggcgagcgtgtcgaacgtcgccgggtgcttccacgggacgtgggtccacgtgctcatatggttctcgtggtgggtgtacagtcgcctctgcctgttcttggcggtgagcgcgcgcccttgctggaggatttcagggagatatgagtcttgcacgagctgacggtggcgcttgtgaaataccagcatgtagttgcgccgttggatcttacgtccatacaaggaatagtcatcggaagccttggacagtttccaccacatgcgggtgccgcggaagctgtcgacgacctcctgcttctcgtccaaactgaactgggtgtcgccgttgtcgccgagcttggcattgagcttgtgggccccttccatgcatttgctgcccaggtacagctcgttccgacccaacttcgtctcgttgtcgtcgatataatcggagatggtgttctgctcgtagggattgaagtaggcaacactggtggagaaaccatctttcgtcggtcggccgatttccacaataatcccggatgcaataaaaactggggctaaagatgatctttagtcccggttcaaaagggtaacgggcatatttgatctttagtcccggtttgtgttaccaaccgggactaaagatcatctttagtcccggttcgaatgctgtcaggtcatgtcaggccccaccgggatctttagtcccggttggtataccaaccgtaactttagtcccggttggtataccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattataagaataattatttgtgtacggtttttttgactcatgtagatggatcggcaatggatgtacgctgaccggcggtccaaagagtttattgacggcgtgcattattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagcaaatcaaacgggcaaggaggaaatagctgctgatggtaacgatgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggacaggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcatgaaacatacggtttggtttgagtacgtgtcgcgaccgggaaaattgccttttcccgaacgctagtgtattaatccccgtcccaggaaaagccggggtacaccacacaaacatgatataaaagacacatttttattatatcgataatatttacattattacaaaggcgcttcaggcctggcaatcaaaaataaacagcagcggactagcgggcctacggtttggtttgtcgatgtttcgacagaaaatttaaagaatttggaaaggacgcacgaaacatacggtttggtttgagtacgtgtcgcgaccgggaaaattgccttttcccgaacgctagtgtattaatccccgtcccaggaaaagccggggtacaccacacaaacatgatataaaagacacatttttattatatcgataatatttacattattacaaaggcgcttcaggcctggcaatcaaaaataaacagcagcggactagcgggcctacggctccatcttcacaggcgctcaactggggtataagccaggactccacctaagacatcttctccaacgcttctcttactgaagaggggaaagattgagcaagaatgagtacaacca

SEQ ID NO: 63737 - DNA, 10788 bp, Oryza sativa
catagccatgcctctctctctttttttttcctttgaaagaactttggaggaagaggcataaatgacatggagtatgtattttgtggactatggatgaaatgaatgacaaatgaggaatgctaacttccagtgtagaagtaaagcattagtgggtgtatgtggaatgtgtgtgatcttgaccatgaaagtatgaaaagcatttcactagggtcacaaaacttgacaacgctcaatgtgatgacaagtagcgtatgtagcaagctaatcatgaatgatcaacctatggctttagtgggaatgaaaatatcaatgaggagtttagcatcgttatatatattttttctttttataaaattaccaagtgtgcaacatgaagagcaggatttctatcatcagactataactcattcatcaattacctagatagcatggggtccctattggatatatcaccacaagtaacaagtaatgagcaaagaataataggcatgcatgtcattttcagggagaccatagactctaattgtaccatccctagcttgggttcaattatcttcgatattttagaattgatagtcaaattaaactcaagatagaatggatgtccaaagtaaaaattgtgcaaacctacgctctgtataaaacagaggacgattcatggtagaggtggttcagtcaaactggaggttcgactgacccctcattgggtctggctgcatcaattttcctcgtgtggttcgtcatggctcatcacttctgggtgatcttactttggttatggcgttgatgtgcaagatcacccccacacttgtctttgtatctgggaggctttattggacacaaaaagaaaaataaagacaaaagtgaagcaaaaagaactcacttggttggaagaccaaggagccaactttattttattttattttattttattgaatctttttttctttttattttatggcaacaatggatatggtgggtatcctggcagaatggagaaatgagatgaggatgcacatggtgtatgagattcttaccagatagatcttaccaggcttagaactggatcgaatgtaacaaagttttgcatttgttctgcttgattccttgtgcatctctttcccatggaccaaggagcatgatataagtgtttgaagttattgtacactgctccttgattgtctttttatttcctgcaaaaggttagtggacaacaaatacccaagggactataaagatttgaaaagattttatcgtagccttgaaattagttgttcacatccacgccaaaatgaaattggattcaaaacatgagaagcgtggatcccataagtttgctaatattttattttatttttcgagagacagtccttttattctgaaacattttttttcaaatttttattattcaccagattttcgtttaagcacaacttatacagtgatgaggtaaatttgcatgaacatgctaaaggagcaattagtaatatacgcaccgtgcaccttcataggtgatatgtttctccttttcatgttagcaattgatttgttcctggccctggcctacctccattgtgaattgaacttgaggactcacccgtcaatttgaaaattttcctgcaggggttagtccacataagatatatatccaatgtctatgaacatattaactctgaaattcattaatcaaactaaactccatgtccaatttgattaaaatagactattttaacctaagcaccatgcttaatttaaaaagcctatagatgtcttgcgcgaacacccaaaacaaagcatatgcaaatagacacaagaaacataaccatgtaagatcaagtctcattcaaatgaaaataagtatgagtaaaaggaatggtgaaccttgttttatctttcgcatacctgagtgtacttaccgccagcatgatgtatattttgaaatctctggggcagtggtatggtcacatatggttgtcgatttctcctccatctttatgcagattgtaccggaggaaggcgctttgaccatgctaactcaggcaagcaagttggtcatgcacacacctcaggtgcaagatccttgtgccttgaaggcgtgatccgttggcacaatacgtaggatgcatctcttttcgagcaaatgtgcaagtgtcaactggagtggagtagccaacacttagaaatgaagagggcaactcctcttgcttgtatgcgcgtaggtgctacgggagcgataagttgtgcacagctagaagtagataaaggctgagccaaggcggcacatgagctcgagagaggcactaggtgttgccgggcagcatgattgctactagcgaggtgtatagccacatttcaaagacacgcacataatgcagtctttgatctaaatatagctcgtcagctctcttgctcttttcttcttctcccatttttttctccttttcttctatctctcttttctcctcttttttatcttcttttttttcttttttcagcaagctaggactaacaccaacttcaacccaagatggccttggttgatggaactcatcatgaaaagctcgtcgaccttccccccacacttggacttttgtgtcgcaagacatcaaaaaccaagtgtgtgatgtcggattctcctatagagtgtgttccaataccaaggatcaccaaagtgtacagttgatgtagctagtgttcttagacatcgcatgaccctcgttcttaatctcaacctgcaatggttagtgaccaagaatacccgaaggtgcatattatcctaaaaaccggttcttgcttttattggaaagaaagtgtaacgctccgcttttcatgagacgttaaaaactaattcggcaaaatcttatatgcgaaaatttcgttctttgtgtgcgagtctaagttgtgccatggatctcaattcaatctcccgttgttccatctcgttgatatcaaaatcccccacctcaagatttcaattccgattcaagtctccgaaacttaattgtctccattgaatcctcgccaaatacttgtcccgattccaaaattatccgagtccactttgaatccattccttgactcctccctgttttcctaagaccaagtatcaagttcgaaacccaaattcaaattccaaatctcctttccctccaaaccgatttcctggacaagagtctactttgcctccctcaaatccttgtggaccgattctctctcggcctatcttctcccccggtcgtttctctcctcacgtgtgtcgcccgtgcgctgagcgagagacgctccctccgtttcctttctctctctcctctcgccgcgctatgcgccgtcgccgtgattcgattttcgccaccgcctttgaaatcccgccgccaccatccaaacctccgccgctgttcgattttggcccgtgaccgcgcgtcgtggtggccgactggccggtcgccgccaccgtcagccctgtcgctcctgcgccgcgcagccgcctggccccgctgccctgccgcgctgcgccacgcagccgctcggccccgcgcgcgtgcccaagccgctccacgcgcgtcctgccaaaaccatgaggtcgagctcccactcccatccctctccctccccaaatcggcaaagaagcgagctccttttcccccttctttttctctttttcccaacctcagccaccgcacctcctctgccgccgcttggccgcttggaccgatgccagccgagctagcgcgactgccagctcactccccttgaccgccccaatgtcggttccttcccctcgaagccccatccgcctataaaacccaagccgagctcctcctcctctctatccctctcgttttcgcctgccgcgcattgtcgccctgctctgcttgcaccgtcgtcgttcgtcgtcaagcaccggggaggccggtgcgtgcgtggacgtgcgacgaggagctccgggcacctcttcttccccttccccagccgctcctagagagcttgctcccgcgccgccgccgctcgtcacggcgccctgtcccgacgcggtgaagcatctaggcccccgttattaattttggtaattaatgacaagcactaattgtggactaactattgtctttgagctatatattttaagttaggaccaagtcatatgtgcgcatggatgattatcgatggattaaaattgacggcgcaaagcaaagagaaagaagacggtaaaactagtgctttaatttagaactgatcgaggtgtagggcgatcaaatttgctagtttatttgttagtttcaccgtactatcaaggggggtaatgacctagcaaagagatgattaaattgccacattaggtcattgcattttcactttgctctctttttcatcacacacacacacaatcatttgcccttttactgggctcggcctgaccaggggtggtcagaccggccacattgtggcggtctgaccggcgcggcatggccagtctgaccggcgccacaactgcggtctgaccggcgcataaggccggtctgaccggcggcacatgcgcagtcagaccggccccctaaaggccgggatggtgctgctcggggtggccgatacagagccgatggagccgtattcggtcagaccgagccgaggccggtctaaccacccactcaacaccggtctgacaggccaagccgatggggccctctgacagcgctacaatggctagttttctagccgttgtagagtagcacggtctgaccggccgcatacctccggtcagaccggcagagcacaaagtttggggatttcgcccccaacggctagttttggttggtgggagtataaatactccccctccagcagcaagggagctctcttggcacccaattcaattgcatacaccccttgcacctctctcacacccacttgagctttgtgttcatccatttagtgtgttagaggtttgatctagccaagagtcaagtgcattgcttccattgtagagctagtgtggcacttgattgatcatctccacgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctccgtgggccggctcccgccttgcccaccccttgacgaagggggcatgcggtggcttcgtggttgagcggtagagttgggctcgcctcaacgaggagtaggaaaccggcgagtttccgaacctcggtgcaaaatctcttgtctccttgtctcatttgattgtcgtatttatatttgtgcaatttacatttctagagacaaacttgagatcatatcaccctaggattgctaaacattgacataggagtgtgatttactttcctagagatataattgagccactatcaccctaggtttgaaaaacataacttagttgcttagttagagttgaccctcaccaagcctagcaatttaggttagttttgattaggtgtcatttagttttaaatcgcctattcacaccccctctagtcgacatctcgatcctacatgcggtagccctccgttcctcttcctcgcttgctctccccctcctttaactcgcttggtagctcggttagccttccggtggttcttaggcgccgccccaagccccgccgccgctcgccatagccttgctgccatcggcgctcgctcccggaggccgcctctcgtcgccggacctccacggcacctccccatcccatccgacgctagaaacgggtcccctgagtcctagagatgctcccactccgccgaatcgaactcccattgctccggtggattttccccttttgctcgccgccagccgccgccatcgcaatccatcgccattgacctctcccaaagaaatccgagccgttggctcactctctcttgtcttcctcgtcattccggtgtgctccctgttgcctctcaccgtcgcaaggtgtcccggtgaaaccgccgccgtccgccgtctatctcggcatcccccttcttcctccgccagccggcccgcgtggctgccacgaaggcaccacgtcggcgccagctcgaccggaccgagtcaagctgaccccggtcagccgctccctccgtctcccgctcgcgcgtgcggtccaccgcgagccgtgaggctgcgcgtgggcccgacgcgtctcggtccatccagcgcaccgcccgtgcgccatccccaccgaaccctagcgccgccctcgcgtgcgcccatcaaaccgtgggccgtgtcaccgacaagcgggccccacctgggaccccgctcggtgcactcggtccaccggacccccccccccctctcccgtgccctaatgggccgacccccgcgctcgccaggcccaaaaaggctcggccgagccgcgcaagccatcgggccgcgccctaagccgcccaaggaagtctgattcacgtctctcctttatttcttttcagaaggatttaataaatcctttttcctttagacagaaaatcctttaatcttccaaaaatcatatcttccaatccgtagctccgattgactccgttccacttccaataattccgtaaaattcagatctatttaatggcactaattattagtctaaataggatctttatttggtcttttgtttaggtttttattgtttgcgtttagtcgcggttgccggattatcatcagtcttgggcctctcaaagattcgtgaagcttcgtgaagaccttgagcaacgcaagtcaccctttgatcaattgctcctataattggaaaatcattattattttgtttgcaatttgcattattagaatcacacacttaacatgcttggcctcggtttgtgtgccaaaccgacggacctacctagtagttgcacaaattcatgtaggctgtactaccctgattccttgtcgctccacccttgtggtacttcagtatccgtgctctctgagcgtgtataccaaatatcccacatacaccgttgtttgtcgaaaacttgggaaatgggtttgtgaagccttgaaaacccgacatgtggtgtcggtgtgtttgaaaataaaatgaattgtgaaaactcacgatgtgggagccgtgtctacgtggcgctgtcccgtattcgcatataaggaccgattcctatgggaaactcatcgagcataatcacagtgcaaccacaaggtggaatgggacaccctggctaagtaactagtcggttcagggaaacctcgcatgccaatagttgggaacaccggggcagggtcggttggagccaaactgggttcctggtaagcaagaaagagaagcttgcagaattaccgatcgaggtggttggagtttgatttgtgaaaactaaaatggcctatatttatgtgaggatttgattcttctatgtggcatgaggtgaccctaagtcggcttgagaaaggctttgtcacaaacctctcacaccggccagtgtctagagtaagttcgtgtcttgtgggtaaagtgtacccctctgcagaggttaactaactgttcgaacagccgtgcccacggtcatgggcggatgtgaggtggttcccgttgcgtagatttgattgcctgtgctttgcgaaaagttgttgtggaatgggaatcgtaaccagaatcaacctatgtggcagatggatgacctgagtggtcagaaacgaatctgtgtgattcgggatgtctgtgggcatcatagactaggcttcccgagtggaagcggattgcttgctgcttggcagctggactctgggagtccgcaaaaatgaaaaaggctctgggagccacctaatcaagtgaaatggctctgggagccgataagtaatgatctaacccgggaggtcggtacattaccatttgagttgttgaaaagcatctcttaaagtcgaatcgagactcaagtctcttttcggcccgaacttagaaagaaataaataacttagtgatttcataatgatttcagacaaaagatttgcaaaacaatcttgccactcttccaagcttgcattaaacacctaaatttccgtgacttgctgagtacggaagtactcacccttgctctatataaatatatatagttcctccgccctgaagttgaagtgaagtgaagattagggtttcgtcctggttcccagccgtcgcctgtggtgttgggtgttagaccattggttcctctgctgctgctattgttggtgtttcctcgtccgggtcgtcagttgcattatcaggctgttttgagctgcaacctatgttaaggtaaataagtcctctatttattttaaggattgcaatgattcatatttgtcaccgtgggtaccagcgctatgtcctgggactggtactgagatcgcggtttcgtaggaagcggttcgcgccgtttttcctacgacacgctccagtcaggtgctgttgtacggcggtgccggattggggtgtgacagaaagcttaccatgataatccggggtatctcctagcagtgctttgtttattgtcacaagctcgaccttagggacattgctctgcaagattagtgccacaaacaaatacgagatttgcagtatttatgataaatataagcgtctacaacaacacctctatacatgttagaaatgatgaccgaaaggtggttgtggtcctcacatagggaagtggtactaatcgaacaggactctgggtatttcttatgtgagcatgaatcctggggaattttgaaggaaaaactttcatgctcatttgcggaatgctttctctcgtcctccagagtcgatgtctcaagcttgtccgtagcctgaaggttttccttctcaagagatacatcatgcaagaatcgggttgtttcttgatgataaacaaaaacaacgttctgaggaccagagggacaaggcttaggcttgatcgagggtgatgagggtcgttcagtttcatgatgatgggaaataggttcagaagaaacgaacgaagatacaaaaatcacctcctcgaacggttcatgcttgggatgagccttcgttttgctgaaatgattcagggtgtttccataatcttcataaagatcatccctgaattggaatggaatttccgaaggatgaatttcttcttcttcaggcttcagcaattggaatgaggattcggcagttgagtcgggttccaactccacgtgcagaggttcctcatggataatctcgatctctgggatggcttcgctttggccgaaagaatcattctctaagatcagatctaagagttctcttccttcgacggttgtcttgtgtgcgaacgatcctccggcggaaatatcaagattttcagcaaactccttgtctaacccataccgaaaatgtcgtaacaacacatggtcgggtaaagacaagtctgggccagactgagttaacaatgagaatctggcccaggctgcaccgagagattccttctcattctatcggaaagagaggatgtctaatcaaagattaattacacgggttaatggaaagaaagcaaggcagaatttgcacttgagctcctcccattcaccgtggaatttcttgacagacatagtgtaccattgcttcgctccatctctaagagaaaaaggaaacaacttccactttatagtttcatgtgtcatgcctacgatggataaacatgaacacactagctcaaagtcccgaagatggcggtatggattttcaccaataccaccagagaaggtttgctctcgaatcatggctataaagccaggaccgatttcgtagccatcggaaaggattggttgtgaagaacaggatggctcacaaagatcagcccgagaagcagaaaggttttgaattgtgggttcctccatcaaggaaaggaataaaagaagaagaaataaaaataaagatacgaggatgacctagactcggataaattagcaaccgttccccagcaacggtgccagaaatgcttgttagtatttcttacgaccatagataaatccgcaagcgcacggaataccgctgtagcactttaccttcgggtgaccccaaaaggatatcaaactcagggaacgtgtgtaatctacctaaggctaagactatccaaggacaacaactgatcataggtaggctaggctagagaggactttctatgtgttttaattatctactctaagtaaggtaattccctatctgttgcttcgggcaccgacccctgctggtctgccagcgtggttccggctatagctctatgatgtatccgaacatggaggattactaggacgggattcagggctgtcaccacttgccgcctacctctgacaaatccggtggatacacaacaaacaagggtatcctctaacctagacaccatgtctaagttattaattactactctaatacttgtacaggaacttccttctttatccagagtcctagtactagagcacttagtataaatactaaacaatgaacccgcaaagatggaaatatatcttacttaaacaaagtaattaaataacataagaaataaacacgaatgcttactttatagaagaagttctccgaacccggagcagagtgtaccgacagctctggtactcctctcaaattcctcctaggaagctacactcgtcagggagaagtcggatgagcgccaaacttccgggcactcctccagagcttcccctcactctctaccttattctaatatagggctgcagg

SEQ ID NO: 63738 - DNA, 2255 bp, Oryza sativa
ctcctagcgccgtcgcgacgagctccaagtccgccgccgccgccggccatctcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaccagttgtaataagtaattaagcagtattaatcatccactgt

SEQ ID NO: 63739 - DNA, 2403 bp, Oryza sativa
tattatatatttgaacaaacgttgctacacaatgagtttcatgtgtttttgtttgcagaggtacttgcttgggcgaaagaaaagagaccgagtgtaaggaatacatggataattgaagaagttgattgggaccaaaccaataccttctccaagtcttcttttatctcaccacgtcacttttggtccatagaagacaagagataaagttctacacgttttggattcggattcgggcctcctgacagcatcaacttcaaatggacctagccgctgatctagaaggaatttcagggcccatgagtacttgttggaaagcttatggagtctactttcaaatggttttggtcccatgtcaaaattcctaccgagctgccgggaatctgcaaaacaagccacgtacctcatccagtccgaatgtgatttgggttttgggccttgtaattgtgtcatgggcttagcccatgggggtgtgcgccctagggcaaccctaggacgtccctaattatacttaatccgttgccgtcatcgtttagagttgggttttgcttagattattctattaaggacagtttcaccgctagatcggtttgtggaaccccaaattcgtgtactaaatcattcatatgcaatttggttgcaatctatgttgttcttgcttgtgttattcgattcgcatgcagggattagccttctcggcgaggtcaaccgggtttcggcacgtttgataaccagaggagacgtggtgctacgattgcggggctcagtagcatgtttgttcagaagccggatcgagttgtgtcacgactccgtccaaatcgactgtttatcattacctattggaagatcgggacctaactccctcattaacgggcttgcctacgcatgcgcttgccttctccttctcatggtcacgccggttcctccatgcccgcgccatcatggagcttccccatcatcactacttcgccgggacgggaacgttcggcttggctccatcccctagccgacaaactccagagttgcacggtgcatgactgtcgcttgtgcgctcccacttcttcaggctgtcgatgccacctaagctacacagctcagcgccgcccttgaactgtggcccccagccacgaagatggagcaccacggcggaatcaactccgctagcgtgcgcactgctcgccggaccaccgttgccgctatcgtcgtcgttccgctcgctcgccggttctttggatgggaggagagagaggggatcaagagagtgattagggttaggatttctcacgcacctcgttggtcacttcatcggcgcggagcaaatccgagacatccatcagatcagccccgcattgggctgccaccaccgatgggccacagaagatcactgggccacgctcgccaccgcactcggctcgcgcttaaactggccggcccggtttttgggccagtttttagaagtaatgggctgaattgaattttttttattttaacccgccgattaaatgtttaatatttcaagaattttggttatatccctcttagctaatttaaactgctaaaaattattttgattagtaagtaaattatttctagttaaatgaaaccatgagagaagtttagctacaaaggaataatgatatgaaattattttttgaccaaagtaattatagttttatgtcaattatatttgttgttctattccttagttattttctgcccaacggtgttttgacaatgaaaattctaagggtgtgtttcggcactgctggttcccaactttctcctctcgtttttcacgcgcacgcttttcaaactgctaaacggtgtgtttttttgcaaaaagtttctatacgaaagttgcttaaaaaatcatattgatccatttttgaaaaaaaaaactaatacttaattagtcacgcgctaatggaccgctccgttttctgcccgcactgttcctagttgggcctccagtagcgaacacaccctaagtttattttatatgtaattgattaagccaacataaattagttatatgcattattttcagcaatgggacaacttaagaatggaagaacaatattgtcaattcccttgatggatctacagtctcaaaacatgttttggcttatgcttatgagccaaaatttgaatattcaaccttaaatttagagttgaatttaggttttttttttctcttttagatcgctaagaacacgtatatataaattatatttacatattacttttcgtttgcaaaaatatcatttcgcttattccgtcgataagcgaaaccatagagtccctaatttcactgaatggaagaacaatacggttttgaatttagccatgttagattttgaccagcgagagctacagtgccgcgctgcactgtgctgctgctcgctg

SEQ ID NO: 63740 - DNA, 628 bp, Oryza sativa
ccgaaactccttcatcagtttttggcacttctcattataaactacaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccc

SEQ ID NO: 63741 - DNA, 666 bp, Oryza sativa
cataaatttaaatctattgatatggatctatatgaaggtttctagtgcatttcatcatgagctcttttggttctaaatttggtccatttaagatcaattagaacactcagaaagaaaatggattatacagagctaatttcatactcggtggaataggaagagcatcatagagctgaaaaacaaaagcttaaaaaccaacccaacctcgctaatgccaaccataaaggcgaaagaaagatgtatcaaggagaacgctctaacagcaacaagaacaagtcaaacaactctcagaagccaagtgggagtaagcaagatagttcaggctctcaaactaaagatgccccttttaagactccacactgccctttctgcgaggtagatggatattggcaaaggaattgctcatgtttcaaagtgtggttagctaagaaaggtaaccataattttgaagaaatatctaatgttaatgaattcctttatgttgaattttcccttaatacttggtgggttgactcatgtgacattgtgcatgtttctaacttattacagggattcaataccgtttagaaagtagcaaaagaggagcaaagcctaacagagtggctgacaaactagccaaggaagctataatgcctagaagtgttcattcaatgtgtgcttgtcaaa

SEQ ID NO: 63742 - DNA, 7204 bp, Oryza sativa
tttctccgatgaggggaacgaaaaggtttaaggtcaaaggaaaactagcgccaagatatgtgagaccttttcaaatcacggctagacgaggagaagttgcataccagttacagctaccagaaaatatcgccgatgtgcacccagtctttcatgtgtctcagttaaagaagtgcttgcgagtgccggaagaacaagctacgttggaagaaattcatatcagcaatgatctcacgtatccagaacacctagtccggatattggatgaagctaaaaagaagactagaaccaaagtgtggcgtatgtacaaagtacaatggagtaatcacactgaggatgaagccacttgggaaagcgaagaattcttgaagacagaatacccccacctattcgaaaacctgtaagaaatctcgggacgagatttatttaagggggtaggtttgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaagaatagttaattaggaataaaccctagaagtaaattggtaaaataaatataacttaaaataaagattaggtgtggatagaaataaataaaatattatcacgatcatatttgtatcaattaaatttaaatgcgatggaataagaattaaccctaattaaaaattcaaataaattatataaataaaatatgagtaatattaatctagggtgaattcattagttgagataacacaaatattgagaaaaattcatatatgcaaaaattagaaattgtggaaccaaatttatataagaaatagactaaaatgagaaaaataggaaaaagacactgttcattgcactctaggtgctcgatgtggttctgtagccctgcccctcctccatcgcctgtccctagccgccccgagccgtgccgacgtcaccatcgccgcctgccgtcgcgtcaccgtcatgtgcattgttgctgtggtggcttgttgagtacgattggtactcacccttgcaatatacaaacttaatcagtggtcggagatgaagcttcggaggatccctatgcttactaccaggatggtgatgaagacgatggcgctcagtaggtcttagttacggtcgttgcctgtggcaatggcgtgccgctgccttaactccgctgccttacctacttctgtttttggaatgtattccggaccacttggtccgatgatttaagactatgcctgcgggcttatgatgtaataattcgttctagacactcgtgtatgtgcacttggtatttcagctatgaattcgtgtgtaccagactacttgatccagggaaatggtactgtttacacgattgatttctgttataaaaacgggggtccacacttacccaatcggtgcccaaccgtatcattacagataacgacacccagttcaccagtgaacttttcggcgactattgcgacgacatgggcatcaagctgtgctttgcctcgcctacccaccccaagagcaacggccaagtcgagcgagccaacgccgaaatcttcaaaggactcaagaccaagacgtacaacgtcctgaagaagcacggggattcatggctcgaggaactgcccgccgtgctgtgggcgaatcggaccactcgaagtcgcgccccgggggaaacaccctttttcctggtgcatggcaccgaggcggtcctaccttcggagctttccctgggtttgccacgcgtcacgctgtacgatgaggccaaccaggatgatctttgccacgacgacctcgactatttagaagagcggagaaggtgcgcggccctgcgagcggtgcgctaccagcaaagcctgtggcgctaccatcagcgccacgtccgggcccgatcactgcaagtcggcgatctcgtcttgcgccgcgtacagtcgcgcttggggctgagcaagctctcatcaatgtgggaagggccatacaaagtgatcggcgttccccagctgggctccgttcggctaaccacggaggacggcacggcgttgcctaacccctagaatatcaaacacctccgccgtttctatccatagagtcgcgcgtcttttgctttcttggaactcaggccaagccccacgctaccactgttaaatatgttgtatcttttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaacacgattccagagctatacaatattattaatcaaggccgtgaacccacatgaaccagccttaacccaaggcctacgatgattcagaccgaactggcgacccgaccatgggtcccagctcgtcccaagccaacccaggccaaccattccatattttaattgttaagcaagttttaagaattaaaacactaacttgggtacattgctcggcttgcccataactgagggcgcggctattcgaatagattatactctgatcagaggtgtacatctgtcacgcccggaatttctatccaaaattccaaacgcttacatgtgtgtgaaccctcgtcgaggaatcagccgaggcacacaataacaaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacaccatcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgacaagtgtgaaactaatcacgaaagacattgttagacccgctcataaccgcgggcacggctattcgaatagttttactctgatcagaggtgtaccactgtacccacaagacacaaccccacatcatgtcaccatgtgcctcaatacaaccacggtatctcggaaaggagttgtgacaataccccttatacaacacaatccactgcagcgcaccttcctggatcataatcacccccttataaacaaggcatggctaaaagggcatataaacttttcccaaatatccatttaaagagcatataaacttcaaatggccataacttgtccatttgaactcggaattggaccgttcaagtctctaatttttccttaagaagtcaagaacccatttttgtgctttgtttctgcttgttatatggagtttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattgttattgttattattaccttgttcaccctagaataaacaaaacctcaactagtggacactttactcatggtaccactagtatgaatttaggtagatgcttcgctggttagttaggcaacattaggtggttttacaactctagactatgggaatattctcatcacctggacactacggaatggttggattattgtggaattggattcatacctccccctctattcaatatcctcaaaatggttttaggctgggcttggggtccctggttttgatagtagcacctcggccatataaggatcagtcttcgggcctctgttgcaaagcactaccgtacttccacatgtctagtgggtaatgcttagtttgtggctcagtctggttacaaacaaaagtacatggatggagatggacgaagtcgggggtcgatggacatctctaggacaaatgacggctacacgagctgcggcccggtagtcgagatgtcatggcacagggctggtgtcctgctgctaggggctcagtcctgcctgcctgtccggggggttccggccgtaggtgggattgggtcggtactcttgtctatggctaggatgggttggaaactatgtcacgtcttccgtctgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccatgataaataatatggtatagttctagaatcgtgtttacaaaatagctttgagcaactaagtacctttaaatgctgtttactgcaaaccctaaccctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagcgcctgtggtcgtcgtcctagtcttccgctgtttctcgtttgtctctgtgtgtgctgggccttcgctgcccatgtaataaattaactatttacgcttccgcttgttaaactctgaattgtattaacttttggtgtaccttgcctcctgggacaaggaataatacacgcacgtaaggaacacccgttgggttatttccggtcgtgacatgagcccacaccacaacaatctcaagcaacacctcagcagcgaccatgggctgatgtgataggtgatgtaatgagggagcaatttgggcttaaaccaaaggagactggaaatttgtaccgacaaccatatcctgaatggtttgaaagagttcctttacctaactggttcaaagtacctgatttctcaaagttttcaggacaagacactacatcgacttatgagcacattagccgatttttagctcagtgtggtgaggcatcggctgtagatgctttgagggttaggttattccggttgtcattggctgggttggcttttacttggttttcttcgctgccacatgggtcgattaacagttgggccgatttagaaaagcagtttcatagttatttctatagtaggattcacgagatgaaactgtctgatctcatgtcaatcaagcaaaagcatgatgagccggtacatgagtatattcaaaggttcagggaaatgaggaataagtgttacagcttgagcttgactgatgcccagttagccgatttggctttttaagggatgattgctccgatcaaggaaaaattctcatctgaagattccgaaagcttgtcgtaccttacacagaaggtaggtttgcatgaacaaaggttcgcggaagctaggaagaactctaggaagattaatcatgtttatccttatatgtatggatcggatggtgaggatgatgattctgaaatagctgcagctgagtgggttaggagcaaaaaggttataccttaccaatgggtgaaaaactcaggaaaagaggagaggtatgactttgacataactaaggctgataagatatttgatttgctagttcgagaaaaacagattcaacttcctgctggacatacaattccatcggctgaagagttgggcaaaaagaggtattgtaagtggcataattctgggtctcatacgactaatgactgcaaggtcttcaggcagcagatccaaacggatattgagggaggaaaaatcaagtttgatgattcgaagaggccaatgaaggtcgatggtaatccttttcctgttaatatggtacatacagctggccaatcagccgatagcgtccgtgcaaagggttttcaagtgaattcggctaagataatcaacaaatatcagaggaagtatgagaagcagcaggagaagcattatgaagaacacgatgatggttttgatcctcattggggttgtgagttctttagattctgctggaatgaagggatgaggttgccgtctatcgaaaactaccttgggtgcaatgatatcattgagagctcaagtcagtcatataataggagtaatcggctgaggcaggaaagagtgtctgttcgtcaaagattgggcccagtgaatcaaggtcgtggccaggaggatgacgtagtcaggacaaatcaatggtgtccttctagtattttcatgaagaatcagaagagaagggttcaaagattgaggaacagggagcgccttcaggaggttgaacaagaaattaaccatcggctgaagaaagcaaaaccaagacaggaattgcgtgttaagaatcagattcctatagccgatgatgtgtagccga

SEQ ID NO: 63743 - DNA, 5654 bp, Oryza sativa
ccgcttgccagaacgccgctctcctcgccatcggcactcttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacctgaagatcctggagctgcgtcaggagaacctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtatctatgtcggagcctgtcttattttatttgcctaagcaacttgaacattaatgaaccaatttaatagcagtgataaatttaagaataatggtagtcgtgggtggttagttttaatcgtcagctccttctctgtttgctggttccgtgtggggttttcagatggtgacgaccaggagaaatgttaacaccggtgaaggcaaccaacccgaaggcagcaaccccaaccaccaaggcaattcaccttcgtcaccaccgtcagacaccaacgccattctcacccaaatcctcgcccagcaacccaacatgatgaccgctttcctccaccacctccaaaacccgccacaacagaatgctccaccaccacccccacaacactctaaactcgccgagttcctccgcatccgcccacctaccttctccagctccaacaaccccgtggatgctttggattggttgcatgccgtggggaagaagttagacacggtgcagtgcagcgatgaggagaaagtcgtcttcgccgcccatcagctgcagggacccgcatctctatggtgggaccatttccaggctacgcagccagaggggcaaccgattacttgggctcgcttcaccgccgctttccggagaacccatgtgcccgccggagtcgtggctctcaagaagagggaattccgggagttgaagcaaggcaaccgctccgtgatggagtatttgcatgagttcaacaatctagcccgttatgccccggaggatgtgcgggaagacgaggagaagcaggagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgccccgacctcaattcgtggtgcgcgtcccacagccacagcagcagcagaatcagcaagggactcgtgcaccccgtcctcctacgccagctgtgcagcccgttcaaggccgcagggacgctcaaggtcagcagcgtctgtgcttcaactgcttcgagcccgggcactttgcggataaatgcccgaagccaaggcgtcagcaaggccaagcacctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgctcatcaccacccctggaggggttatgacagcaaagtattatagccctgccgttcctatagaaattcaggggattccttttccctcggatctgattcttctagacacaaagaacttggatgtgatccttgggatgaattggttggcccaattccaaggggtagtggattgcgcgaggcgcactgtcactctgtaccgaggaccggaacaaccggttgttttctttgcaccctcaacctctgtcagaagttcggaacttcatcagatagaactgtcagaaatccccatagtcagagagttcggagacgtgtttccggaagaactacctggtatgccgcccaagcgagagattgagttccgaatagatcttgctccaggaaccactcctctgtacaagcgaccctaccgtatggcagcaaatgagctggccgaagttaagaaacagttggaagagttgaaagaaaaggggtacatacgtccgagtacttccccatagggtgctcctgtgatttttgtagagaagaaagacaagacgaagaggatgtgcgtcgactacagagctctcaatgaagtcaccataaaaaacaagtaccctcttccccgaatagatgatctgttcgatcagcttaaaggtgccactgtattctccaagattgatcttcgttccggatatcaccagttacgtattcgtgaagaagatattccgaagcccgcattcaccacgcgatacgggttatatgaattcacggtgatgtcgttcggcttaaccaatgctcctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatattaccggagattcatcgagaacttctccaaaatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtactcatgcaggacggtcatgtggtagcctatgcttcacgtcagctacgtcctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaattcactatcatcctggtaaggctaacgtggttgccgacgctctaagtcggaagagccattgcaatactcttaacgtccgtagcattccgcccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaagcgggtatgcgttccagatacccgagaacttaaacagctgatacttcaggaagctcacgaaagtccttattccattcacccgggcagtaccaagatgtacttagacttgaaggagaaatactggtgggttagcatgaagcgggaaattgcagaatttgtggctctatgtgatgtgtgccagcgtgtcaaggcagaacaccaacgaccggccggacttctccaacctctccaagtgccggaatggaaatgggatgaaattgggatggatttcatcaccggtcttccaaaaacccaaggtggatatgactctatatgggtaatagtggatcgattaaccaaggtagctcgattcattcctgtgaagaccacctatggagggaataaactagcggaactctacttcgctaggatcgtgagtctccatggtattcccaagaaaatcgtatctgataggggaagccaattcacctctcgcttttggaagaagctccaagaagagctgggtacccgattgaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccatatgaagcgttgtacgggcgcaaatgccggacaccgctattgtgggaccaagttggagaaagtcaagtgttcgggactgatatcctgagagaagctgaagctaaagtcagaatcattcgggataatctaaaggtggcacagtcccggcagaaaagttatgcggataaccgtcgccgtgacctggaattcgcagtggatgactttgtgtatcttcgggtcacgccattgcgaggtgtacacaggtttcagacgaaagggaagctcgcacctcggaatgtgggtccctttcgtatcactgctcgacgcggagaagtcgcctaccagctggagttgcccgcctccttgggtaacgtgcatgatgtgttccatgtgtcgcaactcaagaaaagtctccgagtgccatccgagcaggccaactcagagcaaattgaagttcgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgaactgaaggcagcccatcccgatctcttcgccagttcttccgaatctcggggtcgagattccgtttaaggggggtaggtttgtcgcgtcccaaaacgactctaaaattgtcacaccccgaagttttcctcccaagccaaattgtaaattacaaatgaccccaagaaaatgcagaggaaatcaggataaaaccctaagaaaacaatgcaaacaataatcgggtttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttct

SEQ ID NO: 63744 - DNA, 1876 bp, Oryza sativa
actactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctcgacacgagcagtcgcgtactagactcaccccaatctgggccaggagcctcataactcggatatatatgatggggctgttcactctaacgaaaaaaaaccttactaaattttagcaggattttttatatagttaccaaaatttgacaacaaactaaatgtagctaatttttttttttataactttaccaaaacttggtaaagttgaaaatgacatcaaagtaaacgggcccgatgtctctagctggcctacatgactcggcgggctattaggattaggctaacaacgtgctatgcggcgacctatcacgccaaagtcccaagcacgagcgtggcctatgtacggcctgaaatcgggctgtgcctgaccaccgccttggaccaggctaggaaagcatggcccaattcctagcatccggcaaacagccaaacaggaaactttgggcttcttcctcctagtcagcaaccattattctagatgctttgacatggtcacatggggaaattttttatatttatctgtatctctgtctttatgctaatggccactaactgaaatcaaaacctaaagctcaaacctcacgcttctatatcatcattagttgtaagacgatggatcagtgcattatatcacttctgagctgataaggaataagttcacttgtggtcccttaacttgtcaacgaatccgattttcgtccttcaaccggaaaaccagatacaatgggtccctcaactatcaaaccggtgcaaagcaggtccctcagcggttttgatggtggttttggctaatgtggcgcctacgtggccggtttgacttggtcctcgtcctacgtggcgctgaccgggcactggaaggaaaatataaaactaaaaaataaaaacaaaatgtggggcccacatgtcagtcagacaaaaagaaaaaagtgaacccaccgttagtgggtcccaccatcctctctatccacggacgattggactacgggagactgggagagggagcgaccaacgcctcttctctctccctccagcatccttcctcgccggccggcgagcgcgcacggagagggaaaaaggccccgcccggcgagtggggcgaagacgacagctggcccccgcttgctgcgcgcctcttcggcgggctgcgcccgcccgtcgccgtcgagccccagtgccccacccacggcgccccgccattgccggccaccctgcgtgtcccccgttcgacccatgcagcgaggcgcgccgcatatgaccttgaagatctctctctcatgcacagcacagtgcacacacgatctcaccacactagtactagctactttgagagtgtagtaggataagccagcaagggatctggtatggcaacgtgtttccggtgaccagaagcctctcggccaagcccatcgcgccgcgggacgcggcgacttgcagtcggcgcgcgtagaacctcgtgttgggaaagacggtcaagggcggcccggcctccgccatggagtccgcggcgagtcgtaacgaggagatgggcgtcatcgcacatgaccagtccttggacgccaccgccgagcatggcgtcaaagtctccaataccctcgtcatcggcggcagccgaatcgtcaatgagttcgtcgccggccaggtaatcac

SEQ ID NO: 63745 - DNA, 1421 bp, Oryza sativa
agtgccaaatataaacgaaaaaataattaattatacggattgcgtgtaaattgcgagacgaatcttttaaacctaattgcgccatgatttgataatatggtgctacagtaaacatttgctaatgatagtttaattaggcttaataaattcgtctcgcggtttacatgcgaattctataattatttttgttattagactacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatattatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaatagaacacttgcaattagggcactaaccaat

SEQ ID NO: 63746 - DNA, 10457 bp, Oryza sativa
gcagccccccaaccctatttaaaccctccccgagctccccacccccgtttttgccactcaccgccccctctccccgtcggaaacgagcccgcgccgtcatctcctctctccgccgtcgccgtcgacctccggccgggcctagccgcccgccgggaccttctcccgcctcgacgtcgcctcctccagcttcgccgcaccgtcaccgacctcgtccacccctccgtcccgctcgacgcccgccggaaccccgccgccctcgtcgacccaagccgcgccgccacctttttccgctccggctgcctccttcgtcgccgctgatgccccggggtgagccgtggaccgccgcctccttttccccctccccttcctctcggccgacgctccaccgcgccgatggtcgccgccggcaaccatcggggtgcgagggccgcctcccgccggctgtgccgacgtggctgccttcgggcgcaccgcgtggccgccgtgtggggctcgcccgccagttgcccgtgcccttgggtgcggctgacgcgtgggcccacggcgtcggtggatggcgaacccgtgcgcccggtccaccgtggaccgtgtggctgccgcgtgggtcccactcccgtggacccggctcacgtgtgtgcgcctcggtgctgacacaataatgtttttcaattcaaaaagaaatgaagaaaatcgcaaatattcacattaagaacatataaccttcaaatggttgtatcttggtcgtttgaactcggaattgcaccattcaagtctctaatttttccttaagaggtcaagaacccatttttgtgatttgtttcttttggttaaatggattttagtagagtaaaagccttttctttatccgttggttgtgtagacgctgtagcttcggaagatccgctctacattgaggttgaagccgacatttgggaaagcgagtaaggcaagtcatatctcctttgaacatatttttgtcccatgctttaaaattattttgttttaaattaatgcattatcgctttatttaaattcccgcattatcactgttttatttagccatgcatatttacctttgttatgatcttattattattgttattgttattattaccttgttcaccctagagtaaacaaaaccccactagtgtttaccgtactatggtctcactagtaccatttttaggtagaagcttcgctatttaaattagacaaactttaggtggatttataactttagactttgggaattctcatatcatttggacattatggaatggttggcttatgtggaattggacacacacctccccctctattcaaaacccccaaaatggttttacgctggctcgaggtgcatggttttaatagtagcacctcggccatcataaggaccggtcttcgggcctctgttgcaaagcactaccgtacttccacatgtctagtgggtaaggcatactttgtggctcagtctggtcgtgggcaaaagtacacggatagagatggacaaagttggggtccgatggacatctctagggcaaatgaaggctacacgagctgcggcccggtagtcgagatgtcatggcacagggccggtgtcctgcagctaggggctcaaccttggcctaccagtcccgggattccggccgtagacagggttgggtcggtactcttgtttatggctgggatgggttgggaactatgttatgtcctccgtccgtatgccgtggtggtatgtggcacgtggttacacgtgaggaagacgtgtcttgtgggtaaagatgtacacctctgatcagagtataatctattcgaatagccgcgccctcggttatgggcaagcctagcaatgtacccaagttagtggtttaattcttaaaacttgctgaaccacatgtgcctgccgtcatgtgcatgtggtcgttaccttagtcttccgctgtttttcgtttatcttcatgtgtgctaggccttcgttgcccatgtaataaattaactatttacgcttccgcttgttaaactctgaattgtatcaacttttggtgtaccttgcctcctgggacaaggaatattacacgcacgtatggaatgcctgttgggttaattccggtcatgaaagctaccaacgctcccttgtgcacaacaatagtcaccgttgttccctccgttgctgatccctccaccgtggttggtcgcagctccctccaccgttggcaacgaaacccttgaatcaaccgctactccctccgcttgggacggattggggatgggattgagatatggttgattagtaatcaggtgtattttggtcactttgggttagtattttttttttattttcctgaatgaagtcctgacggtagagtggaaacagggcagaccaaaactttggttttgaaaagcagggtcaaatgaaaaaacataaaaaagtagggtcaaattgatagttaggtttcataatacggtcaaataactaattgtcgaaaacatttatgttgtgtcttagagattgatacacctctcctataaagaaaggaagagaaggactaggattggaggaaaaaagccattctttgtttcggcccttcgaggaagagcaaactgaagtattgccgcttcatcccatcgacgaggtcactggtttgactgatctggcatgggttacatgtcgttgttgtttcttgggttacatgtcaggtgtaaccgtcccggaaaccaccataactgccacaaccgtcgtagggacccacttgtcagtgccccagagaagtttggagtcctgctgggccggcccagattcggccgaaccgccaaacccttgtgacgccggctccggctggccttacacgtggatgctcttgatcgctccccaatgacggttgcagggcatattggacatttcgcataggctacaaccgtcatacctgcctatttaaggaggagctcatctacacttcaaaacacactctagcaagctcaacatttctctctatagtttagtgtagtattctagtgctaagtggagtagaatagaatagctctcggaatcctcggagtcttcgaaggaattcatgtatggctctagtagcttttctttattcttttgtaagactttcggaattaatggaatattattctttatatactctcggtactttagtttatctaagtatcggctttactttatatatgtatcgctatagttgtgtaactaggctaccagagaggtgtgtgggtttaatgttcgattattcggttgccctatgtcatctcgggggatatagagtactatttaataatgtagatgtggtgtctagattattaaatatcattatctgggcatattatgctgcgggacagtagaggtggatggctgatggtggcagctcagtacgggtattcctccacgttattatatattcctaagaaactctcctggggacggtactcctccgtatttagtcccggttggacggccatgacaggttgtcgtaagaaactcgacaacccgtggtggtctctcgaaacaccagaagggcattgttagggggtattggtcgcacaactgtgtactagcagatgtaaactaagattgagtgtatactataagtatttgaattgattgcttttctatttcttcccccacatagcataggattgtttaacgagagataagagtttttttgattcctgtcactctacccttgtgaatattttaacccctgcttagactctgatctacaagtgacatatatacattattagcatagttctctcttacaatcttcccttgggattaaataaatacgataccttggaatactcccgggtgaaatgctacaatggtatatccgtgcgcttgcgaatttcttctgtaaccatatatataccaggaccatttctggcgccattgctggaaattcatattttagtaatgtcattatgaaataccaacacacgcatgcgaagtgatctatgcaaaggcgatggatgaaaagtgtcatgaacaaaaaaaaacaagcttgttaagtaggtaaaagataagatgtgattggttgtattcataattcaagatagtgttgacgtaaaacacgaggcctgagagatctgcttaactccagtgcatgtccaaaactcgccttcgggtatgcaagcaacaagaaacaaagacaaagaaaccgcggttaaacctataaacgatagccgatcggctaagggccgatgacatatcatttatctttgacccgatatcatatatgtatcgatcggcagccttgaataaataagaaggaactaaatctactcgattggttgtagatattaacaatatatactttttatatcaatatatacttaaatcaagtgattgggatagatcggtcgccatgccgaaacagtataaatcacttagatcgaaatatatattaataatgggactatatatgttcatagcatagccgatcagatagatctagcatgtatcggctaatacttcgataccactctatactaagatattaaatcaagcagaatatatcaaacaaaggcctaatatacttaaatgcaataagatcttaaaataaagggcagatttaacatatcaatgaaacatatatagagtaaatatagttaaatcaggtaagatcggttgaaaccccgatactaccctaatcggcaaccaagaagcaggctagagattaagattctaatcacgacttataagatcaaactcaactgatgcagctataagtatgaaaagaaggacaatatctaaacaatcaagccattggaagtttcatagagtggtggatacctcatataatctaagtcaacatcgatatctaacctaatcggctgccctctaccgacagatgttagccgattgtagattagattgtagattagatagcgatattactagagattatgttagatatatgataactcgacaaattacataaacaagactagagtatcataaagatggaagcactaatcccgagaacgtaagccgccataacaagttttacctcttgttgaagatcgaaaccgatgcagctcaacccgaaagtaagaactcgtcgaaacaaaataaaagtaaaaagggtggcgatgcgctgagattgcattgaacgtctattcattgattacatggggttcggggtctatttatacccgagaattacaaactatatccatatcggacacgtctcttatctctaacaaactctaatatatcataagtctttatgacagacttttgcccaaacatatctctaaggaaattacacaaaatatcctaattaatagatacaattgccttctcaggactatccatgcgtggcaatcatcttgaagcatatcaattcaacccgatgacgtataccaagtcgtattgtcggaatcggctgtatcatctaacccagtctgactcggatttagccgatcccgattgtagccgatttggactccagccgattcttactctgtttccgcaacgatcttcatcttcgattccgcttcgatctaatcttctttttcgatactgatattaccaaatttggtcattaacagatagtcttggttacaacaggactaattatttttaggtctgcttatctaacatttgacataattttttttttaaaaaaaggcatatgtacctaagacaatcatatttaattacaataaaactaaggtgtaagtagtatgtaactacatgaaaactgctatagcttgatgggatagacaagcgcacctaatcacccacgtcatgcgatttactattcgcaagggaaaagtaggacggatgtattattattattattattattattattattattattattattattattattattattattattattggaatgtggcgttccaatggcttaattgcgaagactagtactcctagatgggacttttttttgacaaattggccatttacaaaaacttattttgaaactagtccctaccaaaaaacttcaaccaaaaaataggccgtcggctcagcaccaagagcgctggcactgaggttatacccagaagcgctaacaggcctggcgctgacatcgtgtcaccgtgacggccgagcgcctcccgctgccaacgtggcagggatgtcagcgccaatttccatggcgcattggtgctgagatacccaacctcagcgccaaacacattggtgctgactgttggaacttaaccattggctacctcaacgccaagtgatatttgggaaaacgttcaatctgaaaacgttctatttcaaataatgcgtttttgtcaaagtttcatggatgagctgtatagatattttgggcccgatcaggtattcctatcagatataatatctttttttttagattatgtcatttttctatatcagaaggtattccgattagaaaaatggaatcaaattgttttgatctaaatcagaaggtctggttctagtttccgaacagaagctactggatacggactggtaaagtgttgccttaacatttcctgtgagcagaaactattgtattccctccgtcactaaatatttgacacagttaactctttttaacatgtttgaccgttcatcttattaaaaaagtaattattaattcttttcctatcatttgattcattgttaaatatacttttatatatacatatagttttacatattttataatttttttaataagacgaacggtcaaacatgttttaaaaaatcaacggcgttaaatatttagggaatatttggggacagagggagtatatcatgttgcttgctactatcattctttcacaactttccctttttgttcctgttgaaaagagtaattttataacctgttgcaggtattctttgcacgtgtagttcttgctgatatgaacaaggaactcaaaggattaagattttaacatagatctatttagtttatttgtatatagttttgtaaccatttgggacttcctaatgtgcatggcttctgcagatgtgtgataagtggttctggaaggatagcaatgcatgtattggaaaagcttctgatcaactaacgtgccccattacttctgttacatggtactgacaattgcctacataatacaccaacatctctataaggtcctcaatgcatggatgcatgcctgatgaatcaacatatagaagtcttatatgagatttgcttaaaaacatcctttttgtgcttgcttaaaagtcaatggaacaattctaatgcatattgaatttacaaccaccggtcacaacgttcctaatatctatgcctatcaacatcaaaattaatcaatatgaatccccaaaatatttacaatacacatccctctcaagtctcaacttcactctaagcaaaatagtgcataacttacaaaaaaaactatatgaatcctctatacttacaactataacatcgcatacttacccacattccctaatccacaccacaacccgagccacatttaacaacccatgatttcaacaaaaaaaactctacaaaaatgaggaaaacattgagaaaattagggtttttagagaggatttaccttgcaaattaatatccaacgcaatgcccaccaaatctaaagtcttcaaacctccccccggctgctcgtcgctcagcgctttgcgctggcgtggacgtggccggggtgcgacacgtcgcgcggcgctggaggacggagggatttcgtgagcgctcctgcatccgcgtcgtctctagaattttgcataaaaaccctcgcatttatagatattttgttatatgtcctcgctgcaatttttttggtttacaaatattgcgtttaggcccttcgtgtcatatgaaatccaatacgaaggagataaaagggaaaaaaggaccgcgccctgaatcgtgtaaactgatgggtctttgcgcaaaaggctctccccgagaacctccccagcccccaggcatgtcaaaacaaaaaaaaaaagaaaaaaaaccccagccgccgcacccctctcatctctctcgttctctcctacgcgccgcctggatgtggcagggcgtggccgccgcccggtgtcctcccagcgccccttcctcccccgctacgccgtgcggccccctctccacgtcacgtcgtcgctgccaccgccgcggcgcactcttgtcggggtagttaaagatgagggctatctgctcgcaccacagaattttggacggcgtggacgcacgcacgtgtatccacgtccccgcgcatgtatccacgtcccccgcgcgcgctggaaggctggtgattttcgtacgctctggttgctcgcccgcagcgtcgtccgatcaaacatctagcgaccaaagagtggagaaggctacggatcggacatccgataaaacttaaaagattggatgtcctacctactgcaattctgacgattcatgcaaaccatgcattatgaaccacctcttccctattgtatacatgtacactctttatcaatttttgaaatgatttttctcctaacctatctatctgatctatgatctaattatatcgttatattcgttgtaattaaatttttataacaagatctcacatgagtatattacgttgagaaaaacatatgaaacatttttatactataaatgaaacaattgagttataagtactgaaacatcaaaagaacactattgcaatatttgcaaataaactagtgaaacatttgaaaaaacttattgaaacacctagataataggatttgcaacattcaataatccgtagcaacacaaaactttaaatgtgcaacaaagtcgaattaaaaattaagacatttatttctcacgcgtgaaacattcgattttaacggttgaaacatgtaaaaagataatgtacaacattgtacatgcactagtgaaacatcaataaatacttgttggaacattacattatcaatgcccaacatttaaaaagtaaaaaaaaagtcgtcgacatattgtcgtgtgatatcttgttacaaatatttaattgtaacgaatccaacaatataattagtttgaaattcggataaatagtttaatagaaaaaatcatttaaattttgaaacatactcgcatgtactctctcttagctaactggctatacacatgcgctaattgctcccttagattttttacgtacgattttttctttccggccgaattgaacggcgatgagaagaattttccccaaagagagctggtaattttgtaaaaaagttctcgcttatcttgataatcattattaagtccctcattgtaagttcactgtcctatgtattcttacgtaaagaccctctataggaccgcgctctgaaaaagtgcaagtaaggatgttttctgagaaatagaacaccctatccccccattcccccgaaaccctaccactaccctaccactactgttcccccatccctcctcttcctttgccctgccctgccctagcgccgccgccgcttttccttccctccccggcttctcttcgccggcgacgacgatgcggtgcggtgtctccggctcagattctaaagattctcgagctctccatgtcaagtaaagggaatggacggtgcggtctgttccccgaaaccctagccaccactattcccccacccttttctcgctctctcccctgacctttgcgacggggcaacctcgacctcgacttgccctcctcttttcaacgccgccgccgccagccttcctcgcatgccctcctctgacctaccccatatcctggagctctccctaccaatgctcccttctctctctctctctctctctctctctctctctctttctcccctcagttgagctagctccggggaatgtggtgatggagatcaatggtgagggggatcaatccgctagcccggtgcttgatttggtggataggcgcactcaatcttgaatccggtggtgttgtgctcagctcgggcatgagggggttgatccagaactgtggattgaactcaagatggtgatggtgaggcaagagctccacggtggggtggcatctcttgctcaagcttaaggatccgccgttgtgcgcgccatcatcactattcatcggttctacatctaggcggtaggtcagattgaaaccacatgccgtcgcatagaaaaacttcatttgcagttgggatgccgtcctcacttccggtgagtcaaagcatcaatctctttctctgtagacttgcctcatgtatagctggcatgcatcttctttttcctgcttccctgggttccctgctcacactgtgattctaacatcccaatctgaacaggcaaactgtcaaacttcgttttttttttcatgtatcattcttctattcacaatgataaacattgatagcctatcaaatttctttatcataagtgctagaatatttctgatttgtactgcatctcaaattgtacatgcgtgtgagctat

SEQ ID NO: 63747 - DNA, 3369 bp, Oryza sativa
atcaaagcaaaaggtttgaacatgagaaacttgaaaaaagaggaactctcccactcaccgcgagaagaaataacctttgctgcgccagtagaactagggatgatgttctgactagcaccccgtcctcccctccaatctttcattgaaggaccgtcgacagtcttttgggtggctgaacaaataaaatcatttgattcaataacaatgctacttttataagcttttagatgagaagagcagtaaatcctgtgtgtgcaaatcgaaaagtataaaagaggagaaaacctgttgtagcatggacagttgtcatgaggccctcagctatgccaaattcctcgtggacaatctgaaaagtacaaaccatgatacaaaccagtatggtggcatggtgctacattttgtaacagcgaaatgtacttatcatctgaagtcaagaaccgatcaaagtagacacaacatactccatgtgtatccttaacaaagaaaggatacaacagaacagaaaaataccttggcaaggggcgcaagacagttggtagtacaacttgcattagagacaacattcatgctggggttgtaattcttctcatttactccgactacaaacataggagcatctgcggatggagcagatatcactactttccttgcaccaccctatataagccagatggaatctcagcattttttgcatgtgaatggcttagtttattttctgattggccagaggggttgtgtaaatgcagaggcaaacctttaagtgtgctgatgctttctcagttgttgtaaaaacaccagatgattcaacaacatattcagctccaaagtttccccaaggaatatctgagggatctctgaaatggaaaggagaagcaccaacaaataattttagcaaaactaaagcacgtgggagaattattacaacccaaaactatataacaagaatataaggagtcaagtatgtcaaaagtacaatttttaaacaaaaccgtggattcaaccagacctgaagaattcatgttcttaccttttgcttgtaactgaaattttcttcccattaatctccaaggttgactcatccacaacctttatggtgcctttaaatggaccatgtgtcgaatcatacttgaacatataagcctagaacaagaagaatatcacgatcaaagaacttgaaatagtctaaatgaaacatatgaagttgtagcactcaatacagttatgttcaaaaacagtttagtaaaggtgaacctgtcaattttctcattaagaataattatggttatctgaaattaacaaaatagtaaaaaaaaaaaagtgaatagcatgggttgggttcgtgttctcatgcaagacacacctccagcatgtaaaggaccttatataggaatgccttttctctttaagatcttatgtcagataatgataaacaaagcatgtttactaagttaagaagagctaaagagtacttaggcatattatcatattagagtaacaagcatttctactcaacatgtttacactgttatttgtagaaataatataaagatacattgaacatcatcggttccactgcaacaggacgtaatacatactgtgcttttccaaaatctatcaacagaacttaccatgtacttagcatcgataaaaggatcattaacagccacaacttcaatgtcatctctattagttgcaattcgtagaaccaacctcccaatccgtccaaatcctgcaataacaagaataaagagttcctttacaaccaaagactaaataaagatcaaaagtaatttaaggtcacctacagaagcaatgaagttgaacaagggttcacttcaacgttccaagttgagttagcatagcgcaacttccaaatagtaatcatacattacaacaacttgataatgtcattatttttccaatctacaggaggaactcaccattgatgccaacctttgtcttctccgtgctagaagattctacataaagaagaaaaaaaaataatcataacaccactgcagtcctcataaaccccttttagtgtttgatggatggagcaacttacgatgggtggcaaggggtgcttgtgtagcagttgctctcaccggctcaacgctgctagcactgcagtagaaaagcagttattgaaaatgcaatgtgctacagctaatactgatcaaccgtatccatgatatgcacagagcaaaaaccacaaaaacacaagttgagaaaacgaggggtcaagtccgttttgctctcagaaattttccgctctaaccaacagctgtgctctcggttgtcaaattttgttattcaaggaattcgaataatctggatgatggaggcactcacagtgaagacgaagccccaacggaaggaaaaccgcaggtaaccttgctcctaacgcacgacacctgcaacacagcagcaacatcgatcaatttggtggaaatttagcaagtttcaatctgcgaaatcatggctaaacaaacgcgaacgaatctcaactgaactcggaaaatcaagcgaaatacaagcaattaaagtgggaaacagctgagtgttcactacaatactccattactcctacacatagaaacaaaaacatcgccatacgaacaacagtttcatgcgcatgagttggcagctgtcagtcacacgaaacaggaacaggttctcaccgaagagaccaaaaaaaatcagagagggagagagatcgggatggcgaatggggaccttgacggggtcggcggcgcgtgatccgccgccgctgccggtgccggcgatggccggggtggcggaagcgcggagggggacggcgagcgacgccatgcaggtgcggcggcgctggaaacttggcttcctctaaggaaggcggcggaatggaggcgggggcggaggagacggcgagcggagttgtgcggcggcgggggtcgtcgtcggcggcgtggttccgtgatgcgtctcccggtatctcggcctcgggcggagttgtttatggctttattattacttgtaggttttttttctttctgtgcctcttttgttttatcgcctcatcttttaacttatacttatacttataaacataagctacaattaaaatttttaatcttaaatttaaatttaaagttgattttagaattttttttaatttccatcctagtttatttttcagcttaaacttttaatcttttagatttttagattgttaataacatgtatataaaaattttatttacaaactattttctatttgtaaatatgttatttcacaaaactatggagtccttagtttgttctctctttacatttgaaaaacgtgtgaaaatatttttattgaggattgactccgataatcatttacag

SEQ ID NO: 63748 - DNA, 730 bp, Oryza sativa
acgaggggcgcggctattcgaatagattatactctgatcagaggtggtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccgaatgatatgagacttcccaaagtctaaagttataaaaccacctaatgttgcctaattaaccagcgaagcatctacctaagttcatactagtggaaccatcaatagagtacccactagttggggttttgtttattatagggtgaacaaggaaat

SEQ ID NO: 63749 - DNA, 669 bp, Oryza sativa
caatttgtaactgaggatgtacatataaactcagattctttgctttacttgtggatggagtcaaagatgcagtggtgagaggaagctggaggcaggtagcgagcaaagaactgatgcttaagcaatgtgtggtctgatactctgatgtgttgttcggtaaaaaaatagaatgtaaacagtcaattatacctcactatgtttcttttcagataataacagtatcatataaactccagtgtaaagttgacattgcccaaaatgcaggtaagattttttttttaaaaaaaaaagtacagagagaacacttccttttcagctatcaggcagttgttgatggaagtgcagatttcgtggggtctgcttctgattctgatcttgctcactcacaacaagctttctttccatctctgcatgtaagacatcgattcagagatcaaattccactaggtgttcatggaactgcacgccactggttcaaaaagacacagaaatccagaaaaaagatctcaccaaacatgcacgaagcaccgaagcagaggtgaccagctatacatctcgggctctcggctctcccgtttcatgggccggaaagcgattcgacttgcgtgcggcccattttacttgggccggatcatggcccatctttgttaggtgaggcccatgatattg

SEQ ID NO: 63750 - DNA, 4417 bp, Oryza sativa
cacaaccatgcactatacatgctggaaactttacatttaatggtgtcactaagaaaaatttcagatttacaagcttttcaaattgaaatggcagatcataccaagttggcgtatcactcaatcttagctacacgctccgagaccacaagaactatttgcggaccaagtggcagcaggagatggcatatggccaagcaagtagcatgcttaagtattttcaagacaaaattgccgattgcccatcattccaatatgcattgcaaatggatggtgaagaactaatagctaacatattatgggttgatgctaaaatgatcgcagattacgcacgttttggtgatgttgttagttttgatactacttttggaacaagcaatgagagtaggccgtttggtgtctttgtgggattcaatcactttagagaaactgtaatttttaattttttggtgctgctctcatgtatgatgagacatttcagtccttcaaacggttgtttgagacttttctaaaaggtcataatggacattcccattatgtagaatgctatcaaacatttaggtggagagaagaatgaggagaacaatgaagacacaagtattttgtcagattttaatgcatgcatgtatgagtacgaagacatggtagaatttgaacaaaaatttgacatcatgattcagcggcgtgctgctgcatggtgcggcgcgtcagcctgcctggctcggcatgccactcagcctggctcgacatttcgtcgagcaggtggtgtgcatgtgcagccggctggggaaaagaaggaggggaaacagacttgggtcacaagggggagagggtgtagaaatagacttctgatatgctgggctgagagggaaaagaaaagcccagttgtaataggaatattctgtagaactgcaaatggaatttgtgaaggggatttgtaatttggaaactgtagatggactgtaggtacttcatgtaataggattgcataactgtaaaaggactgtatattcggacatttgactttgggctgaaatttgtaaatgggagttggaactataaatgggctgtttaatttgggtaattggattggattcaatttggccgctcagtcgcccaagtatttaacttaggatgtccttgcggctgcttgaatgtaaagacgatgatatcgatggattttagaaacgacgtttggcataagaatctatgcgatgcggtaatgtttcaacggtagggatgatatagacgataggtctaggtgcggcgtatggcatacaaatccatttgtcgcggtggggttcaaaggtagaattagagtcgagaatatacgagtcgacgcacgacagttaaattcgtcgagcgattttagagtttcaagcgaatggccgaactctgggattttaagtagaaggaatatgggagaatggaatccggggagagccgagtcgaatagacgggacaactcaggctcaactctagtgttcaatcggtctgaggaaggaagcgatgttatgacaaaggaaagggtttcggggctttgattagcttcaccgaaacgcttagcaaattagtcggagaggaaagagggcaaggaaggatgtcgactggagaacatcctttaggtggatcgatttaatcgcggtattccaacaattcaaggaaacgacggggtattacaataacttgggagggttgaaaggacagtgaatggatattactctgagaggtggttctgggggaaatactgagttcgagcaattccagacaccagaacaaattggttcgggaggggttcgattgagaagaaggattgaactacggaatatgattccggaggaaatacgacaaggattggattcacaaggatggattaaccgagatccttggcacaaacatacaaatgcaaacaaataatacaaatcccattatgcgggtaagctaggcctttcaaggaggaaaactatacttttccgtgaattcttttgaaataactcatttaagattttagttcgtaaatagagttttgctagtaaattccttctagtctttatttgtaaaaataattcccaaacacttataatttcaaaatagggtttttagaagttaactaatattagccctcatttgtaaaaatagtttcctcggggaaatatctctcaaagtatgttttctaaatatttagtatttatttttttattcataatacaaatacctcaagtaggttctatttcaaagaaatggttcacagaaagacaaatggcatttacaaatattttcttaattaatatatttcataatcatggttcttttaacaaaatagtatttgaatcaaaaatatattttgtttctagatttccgtcctcgtggtccaagcgcaaccgaaaaaggggagatagaatccaataaaagccaacatgatggattttggaaaagatttttgattaacacgaaattttaatttcgcaaatcaggacagaaattttcatggtgttacactttaggtgtataaactttagatgtgtagaaatattatatataaaaaatatttgaattcaaattcaaatttgatttgggtatgtaaacttttgacttataaactttgggtctataaactttaggtgtataaactttagatgtatagaaatactatatataaaaaatatttgaattcaaattcaaatttgaatcggatataattcaaattcaaatttgaatcgggtatataaacttttgacttataaactttgggtctataaactttaggtgtataaactttagatgtatagaaatactatatataaaaaatatttgaattcaaattcaaatttgaattggatatataaacttttgatttataaactttgggtctctctaaactttagatgtgtaaacttgaggcgtacaaactttaggtgcataaatttactaaaataggaaagtaatgcggtgacaacaaaaagaaaaccaggtggagggaggggagatccgaactgatcactaggggcgatcgatcgccccggcccttagcaatctcgcaaacaaggccctatcatacccggatcggattacaaaatccttttccttaaatcggcatgatttcttctctatttatatctttatccatacgttgggatacctttacatatacaaaaatgtaagcagtattctcaatgagagtagtaaataaagatacgtagtatgggaatatatctttgttcacacaaaatttccgtgtacatatcgtgcacaacaactaataaatttcacaaaaaattctaaagaaaattatatatacttccaataatattacaatacgtgtagattcttaatttctaattcattatattttagctataactaaaaaataaaaattttgacagttttaagagtataaatctatgagaactctatctcctttttcactaaacataattaagaaacataattaagagtaaattgcattggtggtacacaaacttgttaggtgggtgtaatttagtatataaacttgtaaaatgctcgtttcggtacacgaacttgtctagtttgtgcaaatgagatcaaaatagcttggcaatgttaattttatgaagctgatgttgattaggacgtgccatgctgacgtgtagtgagtatacataagatatgcaatatttttaaatttggtctctactttgtccttcgtcatggaaatgatgaatttcatatatttctaacccttatatcattgctcgttttgttttctatgatcactatatccattctatttttattgaagaggtgtatgtctaatagagaccttctcagatatatgtttatatagtaatcctaatcagcctctaaatcaataagattagctatgtagtgttctttttgtctttctccgcacgccctagacaagtttatgcaaaaaacaagcattttacaagttcgtgcactagattgcacccacctgataagttcgtgtaccagtgatgcaatttactctataattaatttcaagatgagacattacacaatagacgtaatagtactaaaagtatatatacaaatctttcactactaagaaaacgttataggtgccggcacttttgagatgcacactagccaaaaatagttggctcgattcattgagccatcaagccgatcccaaataatacccaaatcccaagatttcctcaaatccatgaacacgagctacaatcaataatccttagaaaaacaacacatctagatcaaataaaatcacaaatagggagggagtgggagggatggatctgtcggccgccgatgccgtcgcacctctagccggcagacccacctctccgccggttgacgtcgccgcgccacaccttcagccggtggccgcactgccagatccctgcagccaatgggcgagcgccgtcacgctgtcaga

SEQ ID NO: 63751 - DNA, 2710 bp, Oryza sativa
tggttcatgggcccatgtgcttgtagtattttagtccctagagcctttcttatgctattattgttttgatttattaccctctgatattatttatgtattttcaacaattcttaaactgtgtataaattctatttttaatgaggccttgaaaagttgtctgaatacattagatgtctaaacaattggataggttaatattgtgattgcattggaagagagaaacaacaacaataaagaaaatgttcattgtggaggttactagtgtgttcctctatgtgttcaattggtcattcatgcatacgaccataatgattaatgaagagatcagtagtagtattgtaatacaattcaagtactttctcttttggaaaccaaataatccaaatttgcatgggttctaccctgtttattttgaaatacataatggacctaatttcccacctcgtagatttgctatgaggaaatatgctggtcatgtgtgatctggcatattttctgggcttagaaatgcccaatctctctgctatactgttgctggttttagtgacaatccagccgatcgtttttggtctataagggttgcttgctttactcctttacctgctgcctgctggaatgcacacatttctgctttctccaatgttctaaaagtgtcatgcttgttgtttgtaattgatgcatctatttggatcaatatccagactcctttgagtaatctatttgtacaaaattttcttcatttgtttgccaccttgacaattttctgcttatttaggtgtattacaagtatccttacaatcatgtctgctgagcaggatcttgtaaagggtaaagatacattgatgccattggttgattttcaagagaagaaacgtacaggatggaggcaactgaagatttcgccatctggagtggtgaaatatctcagaaatacatgctatgaacatttggcaaccttagaatcagatatctttgctagtttgatacaacatatccttgtaggtgattgttgatggtgcttatgctcttcattcaacactgaggtcactgcttgatattcgtgttgctgtggtaaaaattataattgccctaaatatttttcattatagaacagttattttatctcaataatttcacccatgaacttcaggttggtggtgttcattttagccttctgtctaaagtccagcatgatattggagattcttgctcgttggactatctgattgatagcatatttcccttgtttagaaagcatattgagccagacttgcatcatgctcaagtatacatcttgtaccttttttgcctttttatagtctgtaggtaccatttgattcttttttatttgagttgctacttgctagtgcagattagaatcgacaacagctttgtctgctcattccgagaaccatactacaagcttaaatgcaaaaacgaggtcagcattggtttccggtcggtagacaacatattatgtatctaactgaagctttgtctccttttcaactgtttaagctttatgtttgtttcatggctgtagtttatttaatgcaacaagtcagcaagcaaccacacttaatgcaaaatatgccaaagctttgaacagggatatatgatttgtagtttcttgaaatctacatttatattttttgaaatggaagcatgtgtttttattatttgaaatggctccaaaatgtatgaggtcacttcgtgtcagcatagtttgccccagaaattagcgttgaatgaggctctattttactttattttagtttttagtattccaacaaaggaggttctgcataagagttgacaatcaagatatgctgttactaatgcttgttttttgcaccgactattttcaccttcttttcttctttaactttgcttatgtctttgtagttaccagatggacataatttgtatttttttaatcaaaatgaaggagaaactgagaagtgagtcatatatatcacttaatacatttcttcatgaatgttcatatatacttctagatctgattggttgatattcaatccccttatacttttatcaagcttatgtgtgtggatatgtccattttcattttttttgtggggaatatgccccttcaatttgtgatagtttctttcttatgtattttcagctttattgagatgtaccttaggccaccttttgcttccgaggaaataaaaattgatgattggattaaagttaggcaatgtggaataagatattacttgtctcttggggatcagaggattgtggacaaatactttattatccgtccaaaagctgagtttgaggtacacaagtgatcttattatcttgaaatttggggttttacatacaagtgtaatgtttggacgtaaccaaaaacaataagggtgtgctgatgtgttttgcatatgtacttttagtttccttgcatttctctgctactacatattcattgactacagtacaattcttactccatgttgcttttacctccttaaatattaatattttttatattctgatactttggggataaatcagctactattgcataatgtaaataaacctattcgacttttcatcatcatgaatccatttgtttctgatctatcatctatgaaattcttcaaactaattctatactgatgatagcgtgtaggatcgaataattttcctgcattgtagttgaagtgcagaaccatgcagt

SEQ ID NO: 63752 - DNA, 576 bp, Oryza sativa
tggagattggattccggaaaagaagttgcaacttgttgatatgagtattctattaatcctattaagccctaggccgggatgttacacttaccgtgtttaccacaagcggagtgggtaactgcttgatctgaagtatagctcgaccctttcctaggcatcggtggcgagggtgggcgtgatgtagttgggtcggccgggatatccggttgtccagctgccggattcaccgcggtgcacgaggggattgctcactgccttttgaggggtgggggtgaaaccttagcgtggtgtggatggttaggggagggttatgcggagggtcttgcacgatttccccctttgtagtatcatggtgatacttcggggcatggtgacatgtgtggaatcgtgtcttgtgggtacagttgtacacctctgacaagagtaaaactattcgaatagtcgtgcccgcggttatgggcgatcaaccagattcaccatgattagtctcacccctagattagcttaatgaactggtgtagttcaggtggttggttgggcctattgcaacgtggtgtagcgtaggacagtgattgg

SEQ ID NO: 63753 - DNA, 4085 bp, Oryza sativa
tttcaccttttcatataaagcatattgcagactgaggtgtatcagatcacccttctgcgacattgattagaagaattgtcttcaattcattcaattcattaacatacaatggagttatgtaggttgctggagttttaccaagaaaattttgaaattggagttgaaattgttttttttttaattcagttgagttatgtatttgcagtgaaattgactgatgcataatttatattgatcttggttgataagtttatagctatgtaaattttctacccttatcttttgaagtgaataatatgtttatgaattccaaatgatcttgttctgttctcgataaaacttctatgttgcaacctttaggtttattttgatgtttgttgtcattgaactttggaaaaaaaatgaatatgtaactggcttgcataatttagattgttgcagcagaagctagaaagctcggtataaaggggccatggattacgaagtcataccttgaaatgatcctagagagcaaaggtgcaacatttttgttttcatgttttttattttcaataatttctatccactaataagtttcatgttggttgtcaggggtcccacgacttaatacgccaccaccaatctcaaggaaattactgactgaaagtcaagaaaaaaaaattgttgcaccaaagccaattcgtgtttcgaccgaaaatgttgcaaattttgatgactttgcacaaccatggacgaggtctccacccaaaaagtttgaccaggagcctgttatgggaaaatggcagttcaatcaaggttttaaacttgtgctttcatttatgatttttgccttgcatattctgttctttaatgctaaaacaaagggcattttctcttgtcattggatatcatgtgcagcccattagggcccatagagtggtctgcctctctagggctggtggtactgtgcattaatagtacctacttggttaattttcgtgcgtggatagttcatgtcaggtggtcttattagagataaggttagacttataagttagttattttcttaatactagggataggtttcttaatggtcaagctaacacatctatatgacggggtttgtattttactcatcaagcaagtaataaacaagagtatttagtcttccccttctctcctgcccttgtggcgtggctgcctcaatggcaccgctgccacttgggtccagggatacacaactagaaataggcgcaagtgccctaatcccaaccatgcctattacggagtacattggaaaccatatttatttattattttttctgtagaaaatccattgaatatattcttacacttttgcagattcttcttcaggaagtaacatccagttagctccactgccagactcctatgacttagataggggtcttctcctatcagttcaagcaattcaggtaaatgaaaccacattctatttttttcatcacagttacgcattactgatctgtaacatattccattaattgttgtctttcaggcattgttggagaacaaaggatttcctgtcattgttgggattggtaataacatctttaccgttaataaagtagcagtagttttgtgtttactaagaccaagcatctgcttgctgtgaatgataaataactaaaacaactcactctactttgctggggcaacttaaaatcatttagtcagacatctgcaccagatatcccttgtgacaagtctcacttgcaatgactaccagtttcattaaagtgatatcagagcatctatatctccaaatttcacatgatccagtttttaatgtgctataatggtatgcttgctgtgcaaaaaagagtgcctgataggttgtgcctaatctattcctatacacctgttattttaggattaacttgtattacaattctctgtgggtttgttgtaccagttgctggggctacatgtcatgccttttttgtaatatatttaagttatggggcaattgcacgtttgacgctgttttgaaagctaactaccagtttgactattttctcaactttgcttatttgaccccgcttttcaaaaatgaacattagctatgaccctattctatcaggccaacctaacggtgttaacttaggggccaaatgccgtttatacccctgctcattttgagtatactctctgagtttttatttatttggcttagttttgtgtactcggtgtatgtgatgaaagttttaataaatttgacttggaattgacaaattgtgtgtgaatttgagttagatttgataacttaagcaaagatgactgaattttaataaaactttggaaatatattatccatccaattgcacgctgaagaaagaaaagcatatatgctatttcacatccaacaattgccccaagcaaatcacgaagctcaaatttgtgtcgaccccaaagcaaaaaaaaaaaaaagtgtgaaattaatacatgtaaaacaagagagattattcaatcagatcagcaaaacaagagcaaagcaacttccagatctagtagaacaaggtatagagaggaggtgtgggtagagcaagagcgagcaaggatgtgggccacatgagcgcctcacgcaggacctgtgcctccggctgagccaggcaagcgttgcacgcttccgtccacacggccacgcactccatccacacagcaagcgccggcccgcgcgtttccccatcagcgccgcaccatccgctgcttatccacgcatcgccaccaccgcctctacacgcgcccgcgccgctgctcctcttccctctgtgcgccggcgtcgccgctcctccttccgcgcgccggagctggccctccctcccttcctccctccacacggcagcagccgtcgccgcccatccctcctccctccacgcggcaacagccggcgccagctccgctgctcctcctgccacgtgctggagccgtccctccctcagcgcggcaaaagccggcgcgctgctcctccgcgaacaggcgccgccgcctgtccgcgcgccggcgctgcccctcccttcctctctctgtgcggcagaagccgccgccgctgctcctccatacgctggcgcccactgccgtccctctctttgcttgccagcaccgctgctcacctgctcctggtccctccacgcgccggccagccacgccaatgtgggataaaggttgggatgaggggtattttggtcagttcatgcgagtaaaattatttttttttctttttctaactgaaaccctaacggactagtaaaaacagggtcagatggtggcttcgcttttgaaaaacagggtcaaatgagcaaacctgaaaaagtagggtcaatttggtagttcggcttctaaatataagcaattgtcccttatttatggcgaacaaccatctattgtgaaaatgtgtgctaaagcagacaataaacataaatgggccttctggcagattactgagcgattatttgcgccccatctgtttttttactagtccatgtatgtgaatacaagaattcttctaagaattttatattgtatggaatagattgattctgtaataataattctgttaaacttgtgcaaaaatgatatgacccacacacccagcaaattacatttactgactatgctgtcgctgtttaagttgatacactgtttatttgtaggtggccctagtggatcaggcaagacaagtttagctcagaagatggccaatataattggttgtgaagttataagcttggagagttattataagcctgaacaagttagggattataaatatgatgagtatagctcattggatataggtttgcttactaaggtgattcctttttatattgattccttttctgtattatcatgtgaattacaaattcctgtgcataactactagaatcttaaatatttcaagcatgcttccaaatttctatcttgttctaaaagtcgatgcaaggcgccgcctaggcacttggtagctgccacgattaggcattagatagtgcattaggaggctaacctactttgggcgctattgtgttgctatttttctctatgtaatatgcttgataatttcttgg

SEQ ID NO: 63754 - DNA, 4315 bp, Oryza sativa
ttttaccattgttacaactatttaatcctcctgatgggcaactctatctcaatacttctgtgtccaacactaaatgatgaagtccctaacattcttttcatgaagtccctaacattacgtgtccaacactaaatgatcaaagaagttacctagttggatcaagtaggaactaattagttctgtataaatccctagcatttttttgatgaagtccctaacatttttttttatttatgaaatccctaacaactttacaaaacataatattgtggtttaactaatgtttgggcgaccctccaagaaacatcaaacttgataaataggtgtgattgtagattagtcattagtgactgtctgctgatactctgaaagataactttgatatataagaaaattttcatgcactagggcatatcttgaaatttgctcatatgcttacttccttttctaatagttaccgagctgtggcatatattgaagcttctgcaacgatttaccaagatggaaaggttattatttccatcaaatctatatttcttttcattctttctgtataataagttatgagtacatgcatttcatatgatcaatgtgtgatgtttctttatgaggctcagttcctttcagctactggttactagattatcatgggcccacttttcaaactgctaaagttgtcacagaataattgtatatctaccattcaaattttgtcccaaaaaaattgtatttgtaataaggtgatacccatccaattagttagaaggagatattctgccttctgccctcccatcattccttctccatctgcctcaacctttcttttgttctatgcatgtagggttattgtggccatttgtgtagaaatacaattattttgggacggaggtagtatatggaagttccttcaaaaatttaagcaaattcatttttcatgtttgtaatggttaaacttaattaatctagcactcattgggtgtcttcgctggtaagccaacgagctaattgctctaccatctgaatagaatgaagcgtaagtcttatagtaattgttgggcaagttattataaatgaaccatgggatgtgctgttataggtgcatttccttgaactgtgggtagtgtcccctcctccggtaaactcaaaaaggcaggatacaatctttgcgctgctgccgtagtttaaataatgtatctttggagacactctttgtctactttctgatgttttggctgatatggccaaaaaattgtcagcaagtgctgggcctgggctgctggctaatattttcctcaaagatattgatatatagaaatcatggaaaatttcacctagtttgatgcatttttatgaaattttagacatagtacctaccaaatattccttcagaaatttttgagtgcttcctctgtgtgtatggttggttctgatttatattgtgaaacagtcaaatgaatggagtttaagttactgttgttgactcactatatatagtataaaatgatgcggtttgaagtatttgtaaattaaaattgttttggttaacagttgtgcctcaacctgtactctacctgtattgatatctatgcagaaaactatagtccctctgtttttaaatatgacaccgttgactttttaagatacatttaactattcatcttattcaaaaaaatgtatgtaattattatttattttattgtgacttgatttatcgttaaatgttctttaagcatgacttaaatttttaatatttgcacaaaaaaattgaacaaaacgaatgatcaaacgttagtcaaaaagtcaacggcatcatatattaaaaaacggaggtagtagtattcatatctgttgaattgttgaaagaaaaagtttattcaatgaaagttctggtatgctttaggaatagtgacactcgttgtatatgaataaatttattatgtatgtttgggtcgatggaataatatttatttgcattggaataattttcaccacttttttttgagtgttctcatacttgttgggattaggacattgttgagtgttctcatacttactgggattaggagtcagatcaggacattgttgttcccagttgcacagaatttgaacagctaatatttttctgatttgaagctgctttatgataatgcctactttttccccatatttctcatttcataattgtaatatttttacagaagttagttaacattatgatgatgccagcggatttcctgtttttgcaattgtcattggttctggaaccactaacttctaaaacgtttgtttacttgattgaagattcttatagaggttgatagtctacaaggtgagacaaatccgtatcttcagattaaaggaacgaacaaggaaatagtttcctctgctgcatctgcactcagcttagatgattcatacacgacaaaggtctcctagaaaatcctagctagttaaattgattaatttgcacacacattattgcatatcagtttcatgattttattctgctctgcagagctatcttcaaattattctggagagtttgccagcggatgaaaatgttcatactggtattcataaccaacaagctgctaggctacaagaacttgttgagtttatccagtcacaagtatgttaattcaaaccaactagttgtaaatactactgttacattatgggatattttttatggctatgatttagggtagtcagaacataagtatttgttctttacaactgtttgtgggagaacatactagcaaattgccttttgtgttggacgcggttatgtttcgtagtgtggtcacctggtcggtggtttaaaataggccattgagcatggttgcttgattggttcaagtccatgtagcatgcttatccatacattatttaccaaacatcagacagttaacagatgattttccaaaggctgtatcatgtttaactgtagctattttcatctaaaaaaaatgtctattggtcctttaaaagaagttagtgtcagtggtagtatcttcctctccacatcttatacacttatttttatgaattcaatgttacttttattgtatgttgtaaatgtctccatcagctatatgtatgagtatgtgcatgtatgctatgacgtgcaccttcctatatcaaaaagttatgttacttttaatcatttaatgtatgctgtaaatgattccatcagctgtgtgactgcatgtcatgcgctagttttgatttgaggattctagttacttcgttttgtttagtttacaacttgtagtatacttattcgagattttcctcgacggaactgtaatagcagatgtgtttgtatgatcagattctatggctaattagctattgttctttcttaactttattctcatatattgaataattctgtggtgcagggaggtagcttcaattcagatttatcttcacctacaagagaagtttcttctacagatagtgtgcttgatgatgtgcaatctaggttaaggaggcttgagagatggaatacaattaatatggtaatttctctttattttcagatgctgttcaagacccatattctttctcaactgccttaagatttaattcagtttgcatgcgttggcattatgttcgattaaacaattaaatattgcatatcatggttcatcagttaaaaccccttgtgttctgcaggttttatggactatattactgtctgctcttgttggatactcactcttccagaaaaagacgacgctaaggcgctgacaattcatacatttgaccccaacttgacctcactagtgctgctttcagcactaatcctaataaggtttgttttcacgcaatacctgtgaccggtctttcagaaaatgtgctgtcgacatttactttgatcattttcaggacttttcgctctttgatgcgatgtgatgagaagaatcctcttgagttagcaggtggactgacttgttcaatcatgcatactacaggtaaccgcagttttagttgcaagttactaacgaaaaagaaaagatgtatatgatacagttgaatgtttgctacaaagtctattcttgggagggtaccggtttctactgagctttgatttgttgagtcccatgccacagttttcagaatggacttgtatcgatacgagtaccacatggttaattggcgatggaaaaacagatgggatatgttgcgtccgtaggaaccaggatcctctaacttattaccctctgacttaactataacttcaagtgactgatatatgagcctcagttcgtgggagaggctcatatatcaacccacatgagaggaaaaa

SEQ ID NO: 63755 - DNA, 3583 bp, Oryza sativa
ttcgtcaagtcagctgaaagggaggctgaagcgaggttgaagacgaagcagttcgcgatttggctggattcgaagaacagtctacaaccacgagtccacgagcgcagtctttaaattttggcccggccaactcctagttaaggcccactcggctcagccactcccccaaccagcctctccccctcctggcctccacgattcgtcgattccctaatcccactgccgccggccacctcctcttcctctctcctaaatccatagccctaggcggctaggcacggcggcgggcgcggtgtgggcgatgagcaggcggcggtgtccggcgaggtcgagcggcaagcaggcggtggctttcgacgagctagtggcgctacggcgaggggcaagactggaggccggccagccggccagccggcgccgcgcgcggcagtccaggcgtccagcgccgtcgcgccacagcgaagatcaggaggtggcgagcctctctccggcgagggtgcaagcaggggtgcaaggcggcaaggcaggcaggaaacgccactgtgccgctgacccgctgtgggctgtggctggcagtggcattgtggcaacgacgcagcttattgatggtctgattgaagatttgaagttagaaattggtaaactactaacctctaatctctatctctatctctatctctatctctactacttatatataaaaaaataagaataagagatgtttccttcgtccatcaatataaaaaaacagcggaaaaaaataaaaaatccgattccctggcggaaaaaaatgcgattcccacataaaacgggaaaaaaaaacgtagattgaaaaaatatatccgattcccacctaaacgaaaaaaaaatccgtttcctgcccaaaaagaaaccaagaaacgtagatccaattcccacagcggaaaaaaaaatccgattcctccaaagtgaaaaacaaaaataaatccgtaaaaataaaaaaatccaaaaaacatgtagaaatgtccgactctataagaaagtagcgaaaaaactgttcgtaaaaaaacgcaggagaaaaaaaaagggcggaaaaaagcacggcaaaaaagtctaatttttattcgcagtgttagtagaccgtatttatctcttctctatctctaatttaatctaatctaactatttaaaaaaagaagtttccatcatatattaaaaaagaaaaatgcacgagaaaaaagtttaaaaaattgaaatgttagaaaaaggtgcaaaagaaaacgcgctagaacaaaaggttttcgtagtccaaaaaaaacatgccagaaaaaatattttcatcgtctgtaaaaaaagcaaaaaaaaaagcatatgaggaaaaaactgtaagaaaaaaggtaaattgatgcacgcttggtcgtatcggatccatcgattttttccatctcatacacagcttttgtttcgccatctattcttctgtattggataccctgcacatctctgtaggcaattatcagactatttttatgaacaaaagctactattcttgataacatattatatggaaataatattagaaaataaacatattttaattgttatttagagaatagtgcacagtgactctattttgtgtagttttgtatagacttgaccatgtgaggcagtctaggatttgattggttgcaagaatgggattaaatgttgtcatatgaataatctaattattttaggtaaagcaaatatcggtaaggttgccatcattgaggttgggccattacgtttaagatgttccaattttctaattttttgtttgtcatcaacatggttatacatgtaaaacgtatattatcattagttttttcacccgttgcaacgcacgggtatgtttgctagtataaataaaattgtgtcttgatagttcaagttcagtgaggttgtgaacttgtgattgaaacttataattgttctctatacatttttattttttaagattatcaacatgtcaaaaagaacactgctcacttattattatggttcaacagtggcgaaaacagcgtggggacggggaaggtctttataccccctatcccctaatggaccattagagcctccataataccccgaaaattctaatccacatatcagaatgcccaaaaggctgagaagcccaaaaaaaaaaatccccacccaaccctaaatctccatcagtcgctcttgccgtagaggcgcaaagagaggcgtagacgcggagcagcaaggaagtaggggcggcaccgcgggcggcggcgtgcagctagcagacaagcacgagtgcacgacgttccaggcagagtgcggcaaggcactttggtttagccccattataattttatcctggctctgcccctgatggggagtgccccgccacgctgctgcctcggtgtatggaggagaggagagtagaaggaagaagtggagagcaagagagaaggaaggagagaaggaaggagaagagagaggaagaagagggagaggagcctacgtggactgggtgcgttcactggtggagaaaccctttgtagtcccggttggtaccccccttttagtcccggtttccaaaccggaagtcgccatcgggggattaaagtcgcctatctttagtcccgggtgaaataaccgggactaaagatcgagctgacctttttttttttttgcatggccctgttgctgcatggtttatatatatatatatatatatatatatatatatatatatatataaaccatgcatatatatgtttcaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgttctagctagctacgatttcgacgtagtagtagtcgctgctagctcagaagctaaggaccggtgaattgtgtttctgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattattaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacat

SEQ ID NO: 63756 - DNA, 540 bp, Oryza sativa
  unsure (1)..(540): unsure at all n locations
ttgggccacaactcagcccattcggctatatgttaaaatacatacaattcatttcatgaccagttctataaatttatgaaaatatacttatagccattatatattatatagtttagaactatgcgaaactatacatacatatcatttattaggcttgatattgtatttttttatcccttcatatttcgaaggaaaaagtccactttgactcccttaaatattggccgaatctaattcgtaccccttaaccagaaaaccggataagatggctccccgaactattgaaactgatgcaatttgactccctaggtggttttgcaagcggttttggctgatgtggcgcctatgtgacggtgttgacccggtcttcgtcccacgtgtcgtcgacatgtagctcatgtggaattagagtaaaaacaaaaaaacaaaaatttgtaggaccaacatatcatccacacacacaaaaaaaaaaaagtgggacccaccgacatgtgggccccacatgtcatnctncctctccttcccttcttcctcctccct

SEQ ID NO: 63757 - DNA, 593 bp, Oryza sativa
atttagctctagcttaattaaaacaatttcttcggacgatttaacttggaggcgtgacaccacccacccccctcgttgtgggcaccccaccaccaccacgtcggcatctacacctggacgagcagctccccatccccacgttgcacctgcgactgcaacacgatgcgctccagcatgctctgcagccgctccttcaccgttggctccacgcctacctcctgcggcgcctccttgatggtagcccaagtcaatatatactgtggtagtgtggttaactagcaaatgtcttgctagttaccatcaaggttgagccacgtgaaataccgttggctccatagctcctgttgagacatgttttctaagcagatgagggaggcggaacattaggagtttttctgaatgactccacactttgtagcaagacatcgcgctagggttaccatcaaggtcaggtattgaaaactttagtatttgaaaatgttgtttgaagttgtcataatttgaattttaaatttaaattattgaaacagagtcatatagtaaaatgaccaaaccaaaagttgtatatattgatgagttgtacaactttgttg

SEQ ID NO: 63758 - DNA, 2006 bp, Oryza sativa
gtgttcgtcccgaatcaccccgttaatttgtcagctcggccctatctctgtctggtcggaacgtgccctgggaggaggcttccactgcatctgttagtcgtcgcgcagcctctcgtatctgatcgccgaagactagtgagccatcagctgggttgagcgttccaccgtgagcatagtaccagaacttcgatcgttccggccaattgggtgttgccggttcgatacccctctcaatcaagcaagcctccatctcctcccagttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccatatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactaaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatacatatatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgat

SEQ ID NO: 63759 - DNA, 602 bp, Oryza sativa
  unsure (1)..(602): unsure at all n locations
cccaaaagaaaaggggaaaaaaagaagaagggacacatcagtgatagcgaagggcggcatccttttgagagcaaataattgcactccactggagtacccgtagtacgatccatcatcgacgagtccatgtcgtgtgccaccaacttgggtttaatataacggtgctcaatttacacagaaaataccttgcaaaatcccttgaaatatgcctctctgcctttgcagacgaccataaacatcaaggaaggcagcaaactgcaaacccccatcctgtccctctccccctcccttaccttccactcttgatggacacagccgacaagctccactctcccaccactccccttctcgcccacgcccaccatgacgaccgcctcttactctgctccccgccggcggccgtggagttccctgtgctcaagagcagggcggcgcggggcgcgctgctgctggcggcgaactacgcggcgttgtttgtcgggtcgctctcgtccagcctgctctctcggttctacttcgcgcacggcggcgccgaccggtggctggccacgctcgtccagtcggcgggattcccggcgctcctgctgncgctgatgtgcgcg

SEQ ID NO: 63760 - DNA, 1900 bp, Oryza sativa
gtcgtttagtttgaaactttttaaattttggtcatgtttttgtgagagattttctagaacttccaaattctaataaggtagatatggtaagaatgtgtttattttgctatcctaccaaaattggtaatataaaaaaatagcagggttaaaaatgataatgaagtgaacttaagctgttgtttgcactgatgaagtgatgagcattatacccctccttttattttattttttttgaggacgacccctttttttctgtcatcataaaattgacgaagatactgataatttcacatatctgctgctaatcttgatggacatcggtgccataaataaccatcttaattatccaaaaactgccatttgttcttccacctttgaccacataaaacaggagcaggcattcccacatgcaacagccgcacggctgcctgaagactgatatgattagtgcctgatcgaatgcacacaaatctttttcatcagctaccatagcattagcgtggtcctgatctatgctactaactttttaatgtgttcttgaacacagtagtacagcacagacaagaagaaaataaacctcctaggttgctgaattccagtcatctcaaaatataataacttttagctattaatttgaacacatagttgtctagattcataactaaaaatgcttatattttgggatggagggagtaacaaaaactgcaataccactcgttacaatctgaaatccccattcttgtcaagccttaatttcaattttttttcccttcaacacatacacagcttctggcattattcttccctgcctcttcacaacctgatcgagcacttactgctgctaccggagtagtacaagtttggtaacgagagaagaaattcgagctgttgctggtgttcgtcgctgctcacacagcatctctgcctttccggttagcccagtacaaacagtggtacgtactgtgccttttggtttcttgttttatgtggcccgaattcttttttaccctcgcagcaatttcaaagctcctttttacaattttttcacagtttcttggccggtagcgaacgcttctagcttttttttcatctcaatggcgcagtacactctgtaccatctgctatctcctacccaaaaatataaaaaccttgaatcagatgaaacgttttctagtgcaatatatttgaataaagatatattatactagaaaacatcgagtccatccaaatacattgtactatagaaatgtagcatccggttttaagtttttatatttttgagatggagagagtagtactacggcagtgtttagttcctcccaattcccaacttttcatcacatcacatcacatcgaaaactttcctacgcacataaactactaactttttctccaaactactattttctcccacttttcaacttttacaccatctaaacacagcctacgtaggagtacgttgtgttgcttcaaattttacagctgtatcccatttcatatttcttggcatgctagtgaacttctctagggagcatatttggttcattggttgttgagtagtagtactaccactataatttggattgctagctactccctccgttttaaaatatttgacaccgttgactttttagcacatgtttgaccgttcgtcttattaaaaaaatttgtgaaatatgtaaaactatatgtgtacatgaaagtatatttaacgataaatcaaatgatatgaaaagaataaataattacttaaatttttttgaataagacgaatggtcaaacacgtactaaaaagtcaacggtgtcaaacattttaaaatagagggaatacattatttatagaatttcttgccaagttttgtggagcttgtagtggatgattgtgttagctacactaaaa

SEQ ID NO: 63761 - DNA, 20011 bp, Oryza sativa
tctcccgaggagagaaatagaaacatccttggtcgaatggcgtctggactgacgccctttatagtgtacgtgcaacagatctccggaaactgctgcagatgagcgttggcatcctcgttaggcttgccgcagaacgggctagcctgtgccatagtgatgaggctggacttcaagtcgaaatccacgtctcccatgttgatctgcggcccaatggccacattttcagcagatggagcggcaaactcgcgaagggtcttgtcagccatagtcttgaaagtcggtggcactggtacggctggtttctctatcggtagagttttctgcggaggaatgactcgcggcctgacgctccggaagaaagcttctggattttctttgaagttttccggcaagttgaaaccaataatgcactaccctgttttcacaacaaaagtgaaaacaaccaaggttagcctgcaaagagcagtgattatacagaggtaaatattaagtattagttcaggtaatctctattatgaatcttccccggtaacaacgctagaaatgctagttggtatttcttaacgacattactagaaatataatttcttgcaaaggcgcagaaatacttctgttatattatggttacagagttcatccgcaagcgcacggatataccattgtagcatctcacccaagagtattccaagggtatcgtatttattttatcccgagggaagatcatgtagagagaacttgactaataatttatatattacttgtgataatcatattctaagcaggggttaagataatccaacggtagagtgacacacaagcaagagctactcattcacataataaaatatctaagctaagtggaaagaaaagagagaaaatctattcctatacttctaatatacatagtatacatacattccagttatccgatatactagctaataccctctatccgatgccctcatggtatttcgagaagccacccctgactaccgagttccttacgacagcccgtcatgaccatacaaccggggctaaatacagaggagtactctccctagggaattaaattaggactatatacatgcgcggaggaatacctgtactgagctgtgaccatcagcggcccacctctcatccgcagcatataacctcaaataataatatcccgtaatttagacaccacgtctaaactaccagatactactctaatatcatcgtcatgacatagagtaattgcatatacaaatattatacccgcactaaagcatctcctagataacctagcagtattttcagtataacatgaccataatataaagtaggcattcatatactcggaaagtatttcaataccataaatgtataaagaataatattctaataatagtacaaagcatacaaaagaggaatggaaagctactagagccatacccgaactcttccgaaggcttccggactcctgatttctactctattcctaatccactagcttaagaacactaaactaacttgaaagaatatgagagagctcttgcttgaggtgtgtgtgtgaagtgaagtgagtgagctccttttataggcaggtatgacggttgtaactattgcgaaatgtctgaagcaccccgcaaccgccatcaggagaagatctagagcgtccctaccaaaccccacatccaaaggtggagagggaggttcagccaaaccaggggccggcccaaccagcccacaatttggctggtggcctcccggacttctcttctccgcagtcttttgaattttggcccaattggttgtgtcatttctaagttcttggcccattcatacataagtctgttcctcgacatcgtttgattgatttatcgtctgagttgatgttgattctccttcactttaaacctaatactagtggaatattattattctaacatatatatgcattgcaagaatcagtagttctcctctattttggtaatatattgacggtcgaaactgatcgataacgaccatcgacaaaacccctcaagcttgaacctttgctcgtcccaagtaaaggacgaaaggaaacaaaaacttggttattgatcaggagttgctactatgctgtatatctcaaaggtacaggtgcaaggtatatttactctctctcagattaaataatctttggcacggtggcttatccttacccatgattcccacgagacactgcttctccttgccttgagcggttgaaagacagaacaacaattagagtgccaatcacccaatctttattcgagtcttattccggaagttttcaaatgattttgcaaaaagaaagccaagttcctcaaatgattcactcagtctctctaagtgtatcaatttgaattcctcaccatttttgcctttttgattcctactctaaaatttgatatgtggagctcgatagggatcgaacatggcatacttgcatttacatttattactaagtcaaagacttagactaaaatagataactaaacatactcaagatcaagatcgtgcaaagtgtgtgtgcaaagtgtgtgatatatggtggaaatggtatatgaaaataaaagaaaaatgcttctcttttgtgcttatatatatatatatatttatatatatttatatatatctttactacttaaaaaattcatagtggtggtggtgagtcctaaacaatctaatggctgagagctctcccaggatcctctcgcaagatcaacgcaccagcccactccccatccatccgcgctcgcatcgcgcatccacccacccccacgcggctgcgcctccatccacgctcgcgcaaccgctcgtgtccgcgatgcacgcttccatccgcgcatgtcgcagcgctcctccccctttgacgccgatacatggctaggaaacgttgattccctatcaccgggcacacggagtgcaccatcagcggcgctgcggcggcacaccaggcacgcggagtgcgtcatcagccacacgtcgatgcagcctgggtggaacgcatgctggcactgggacaggacgcggagcagctcggcggtgtcgaacgcgccgcggcacacggcgcattcggtcgtctggtccctcaccacgtcgcgcagcgtcgcccatgtcgccgaaccggaacaccggagcgctcccacggcacagttgctcaggctggagcggcaccgcttgcacgaagacgacgacggctggaacccgaggcccagcacggcgacaccgcgcgccacgcccaggcagcggtgcttgcagtgcttggtgtagatgaggaagaggaagagctagcgcgaggaggatggccgtgagcaggcccactacgacggacacgtccacggcgagcgtcggcggcagcgggggtggtgccgacggggaggattccttcgtcagaatcatctctttcagtgaccatggataattaaatcttacgcgaaattaaaaatgaaaaaaaaagtttgtgaggcaaggcgtagctggaatgatatagatctgctcgattcgtaaagtgaatgggtgaaatgggcttgaggaaaaccgtgctttgctccaaatcctcaattcttctaaaaatagcggaagctatctttgatcaaagcaatttttagttgttgattttcggttctggattgcttgatattgatcatactacttcagaacatgtacatttgacgaaatagtgcggccaagtagcagtatcattcaccacaagaaagaatgaagcatccagtaataggattacgaattacaatacaagcatcacaatcgcagactcacatttcaccgctgatagctttctctgcaatgtgctgttgagagaattaatgagttaataatggtacaagacaaagcgaaatcagtagctgaaattaatacttacgaatccctgtttcgatagtacgtctaaacaggaaagtcaatacaacatcagctctctgcgacttgcattttcgaaacgctctgctcttggatcttatttctgtaatcttcttggattgcgatggagatattgagcagaacagttgagttgacctcccgccgatggatggaccatagctgcatcgcagaagatgctccgtgaaccgtgaacgaaaactctgcggtgcagtggcatcccttcaccggcgacggccttcttgggggcaaaagctcgttgtatgtccccgctgccgatagttgatccatagcacaacgcggggcgggcaggtcgccccgtccaataaaaacaccaggctccactccgttgcggatgcagctaacgagtttggggttggcggaagaccaaatgggactccaaggggagaggatggggatatgctgagtacatggtggggtgcgggtggggggggtccagactcactgaggtcttgtttgattaatccccttaaggctttgttcggtttggagaggattgaagaggattttggattgagagggaataaaatcctcttcaatcccctctaaactgaacaaggccttaggaatataccgcgcgcgtattgcttccagctccactaaatgcatcccggatccccaacacatccctgcgtgaggataaaaactacatccccaccagtcgccatcatgttgctcgagtcgaccatcgtgcctttttgcagtgctgtacacccatcacgctgctcggctcggcagtggtccatggcggtggcgccgctatgccggcggcccacgggggtggtgtggcaggggaggcccagggcggcgtcgcagagaggaggcccagggcggcggcgcggcgaggaggcccgcggcagcagcgcaacaggacgcgtcgatgtggttcacagcggtcgcaggctgcagcgcgggggctgtaggcgccggcgagtagagtcccacatgcgccggcgaggagggtaatttctgtgtgcttttctatgtgcttgctgtttcttgctgtccttgctgtttctgtgtgttttacttagaaattttaggtacccatgattcacaatcgagctcaggggtgaatttagatgtctatgaatttagatgtgggtagaaatatgcatgaatgcaaaataatattgtgtgagcaaacattatagaatgatgttgtgtgagcaaatggatgcctaggggtaagattgtcttttcatacaacttaacggagaggagttaacagcagttacggtatgatggtatttttgggagaaagaggcttgtgcaatggcatttatgggaagttgtctttgtcgatggcatttctggaattagggtgcttgttgattgcatttcatggattttctcatagaataatgtgcaaccacgacgcctccttggctcacaatgcttggtagagattactagattagaggttaggcagaggcctcatgaaaacaatcttgtccacgaggtagtaggtgacatgatttgatttatatttatgattgtttaagtgatgatttttcaaacggatatatacccgttgcaaagcacgggcatccaactagtgtgtgtgtgtgtatatatatatatatatatatttcataaccatgcctttccctccttctatcttcttttttttgaaaggattttctttttaggagaagaaagcatatgaaagcatgaataatttattttggtggtagtatggaaatggaatggaatattgcttagctcccagtgtaggagtttagcatgtgcatatatgtgagtatatgatcttgatcatagagcatgagaagtatctacacaagtcacaagagtttgacaaagttcaatggaatgacaagtaaccaaaatgtctatatggttcaatcatgatagcacatttttggctctggtaggaatttatatcaaatgaggaacttcaaatttatcattttgaaaaataaaacatccggaatttaagtcaaactaggatcaggatcatagcaactcttatttactatctcatatcttgcaacaaccaagacttagatcagcaagtgcagctcatttacctcagcttcccaaataattgttagatacttatatttaacctttgagagagtacttacctacgaacccatatataagagatataaaacagagcaactattcatcaattcaacaaagagaactagcctatcttacctagcatgactcaaacctatcctatctttttggtattttctattttgcaaatttttatgttgttttcaagtttataggatgcaattggaaagcaaatatgtaattggaaagggaaatatgcaatgtgatacaagttacctgagtagggggagagatgtcccccccctcccccaagcttggctttcgctcagggtccttggtaaggattgaacccctgaaagcggaagtacgcttaaagatcgtcgccctgttgatgcatcatgttgttgatgttggcgaactgagcatcagtagcctgttgccattcttgcatctgggctatgtgttccgtgaggttgtactggatctcccccgtctgcatatcaagggtgttcattctcctggtgatttcacccaactcccaacgagaggaactcgagcgccattcacttggagatggaggcacaccacttgatctgggaggttagttgtccccccattgtatgtcatgaggcgcacgccatcggtcctcactagcacttgcctggcttgagaccccgatgctgtggcgcggagcttgggtccatccgggtgcatccgcagttggctcccaaccagcctcatacatctgcacgggtgttgaggatgatgaactttttcgttcgttccttgccatgttgcgcgtctccctgtatgctccacctgcacgagattcttctatggtctgcaggggaatggttagttcacgatagttgtacaaatgataccctacatttggcagcgggatttcatttgtacaaccggggaaaaagtaaatcaaagatccatctactccatgcttgagaatatgcccttgcactagataagtctcatcaatacacggacgagtggctgagataaaaataatttggttgctaacgacccctagcccttttgctatccgagtaatcagagaagtgcactcaataggagcagagaactttatactttctaaccattgccttatcatacatttcacaggagcaattttgatctttctaaccatggcaaacatgataatcaattcatcccccctaatgggtctaagatcacctctagaaaacaaaatcatagcaatccatttgtacatgagcctaaggtaggattatggatatcattcgtactaggtttcttgcaaattggagcaccataaatgtcttccaaaaacctatttttctcgaacccagaaattcctttctgaagatcgattttacaagaatcgtgaaaaccaagaagtgtacttaagcctttccatgtaagtgagtactccttatggaaaaagcgaaaggaaattccatattctatttctttcaaagtgcatagaaattgcaaagtaagcaaatgagaacgaggctcatctaccatagcaaatctctgccaaccaaccgctttccaaatagaacgaaattcaacatccatacctatctttttcagcagctctggagagtattctcgcgtgtgagcatactcccagtcgctcagcatgtagtaggcttgtctctcccgatcattgacatggtcgatgtcggtgccgttcaggagtcgtcgcggagctttggcgtcttccatcgagacaacagctgatgaacgagtactagactcgtcatgatgacttgatgaagagccggaccccttgaacagacgagacaatcgcctcctcattctgcacaatggagcaagaatggactaactcggcgcgggttaggaatgacaagaatttcacccgccggttagttcaccaaagcaacttgtatatatgcaactaaatatttgaatttgagggaaactatcaaagcttgaatgaacttaagagcaaactttggagagggaatgaaaatgtgttgaaatggggtggagttccctctcccggccggttggcttaagtagtgcacccacaacagtcaaaaccgacctgtggggcccactagccgttgcctcaaagagggaggcagccgaccgttgcctagctggttcggccaaaccagggtattcggccgaacacctggtgggcccaaccggccccactttcgaccgttggattccaacagtcagtgtggtcgtggcacagcgaattttcgttaaaaattttattttggtttgctttgaaaaattcaattgaagaatttcctcaaaattcaaaaatcctaaatgcaactttgaaattcaaacatgcgatgatacaaaaaattcaaattattgaaagcaaaaatgcaagtacataccaatttacctgtgtggtgaaggtcgagtcatttaaattccgacgtgcaagaccgtacctcctttcagtttagtttgcggattttctacccgtctctggaggtgatggagcgggcatctttggcttctccctccacaccttcgttggctttggtgcggagggcagcttcctctgagttggctgctctagcttcttggccggtatgggtggttttaccggcgtcctccaataatggttcttgagcatcgttgtttccttctctaggaaattctgcatgaacttcaacaggctgtccgtcttgggtggctccacttcgaccacttgaatattctacggattcaacccgtactttatcctaaccatggaacattgttccgtcctcggttgaaactcaaacttcacttccttcccgtcgatgtggaaacggatactccccgttcccacgtcaaagttggctcctgcggtgctaaggaacggacgccccaggatgagcggcgtctcttttcccgtgtccatgtccagcaccacgaagtcaaccaggatgaagaagtctcgtatcttgactggcacatcctcctctatccctgctgtgtaacagactgacgaatcagccagttgaaggcgcattggtgttggtgccaacaccgtgaagttgagcttgtcgaagacgtcttttagcatgatgctgacactggctccaaggtcgcacaaggcctggtcgaactagtgtgccccgatcgagctggtgatcgtaggacaccccggatctttcttcttctccgggagcttgtggagtgcacggatataccgatgtagcacttcccctgcggagtattccaagggtatcgaatccaaaggaacgtgtgtggtcagatcttcctccggttcatccaaggataccaagcaaatgataggccaggatagagaggattactagtgagaaacagtgtctagggaaagcttaattttaatcctaatgcaatacttcaggcactggcaacccgttgttcccagatgtcgctctactaattacccggatagggaggacttaagtgatcttgagggctgtcaccacctctacacccacctcaaacgtactgtgggatacgcagcaattactggataacaattacctaaacaccacgtctaagcaattactatctactttagtgtttataactcaccaaaacaatcactatatttaagttgattatagtgaacaataattctgtatgctatttaggaactaaccaagaggtaattctcacaaaataaatctaaattactcaagaagaatattgtattgaattcagagtaataaacagaataaaagaaataggagaagattaccgacaactccggaattcttccaactccatctactctactctcttcctattctagtacacaatatagtacaatagagcctcttataattcagcttaagcttggaagtgtgtgttaaagtgagtgagatgatgtccttatataggggtaggtatgacagttggcgaaggggaaatgtccgaagtgccccgcaaccgccatcaggagtgatctgggacgtccatgccaaaaacctgggatcaacggtgatcaccagggtttggctgaacctgggggttcagccgaacttgggctgggcccccctagcctggactttggtctggctcctcatctgatcctcctctatccattcttcggtgtttgggctgattctctgatgtttctacgaagttcacaacccatccttgtatggatacatatttctcctcactttagtctagatttcctcccaacatcggggtttatcacctgcatacaaatatacaccaacactgtggaatatgtgagattaagcacctatcactatgttggatgttttattatctgaacttgatgcaggtgttggcggtatagaatcggcatttaacagccgccaacaaaaccccgccacacttagtcctttgctcgtccctgagtaaaggttagtgcagaatgaatttcttcaagatatgaatcaagcttataaatcattcacaaccatatctgcacctgtgaactttatcagtggctatcttaccatcttaagtaattgacaaatggaatgatctcgattccagtccttcttgcttctctctcagattcatgggatttttatgaattttcgcaaaccagctcttttcctcatattgactttctctcgtctctcaaagatgtatactttctttttggatcctcaccaaggcaaaatgtgccataattcatccctattctaaagctgatatgtggagcttggtagggataaatcgggacatacctgcatcatatatattgcaaagccaaaaatatggactcaagaagatcatcagtcatactcctagatcaagggtctttatttgtggatggaaaatgaaaacgtaaaatattttgtggaatgatggaataaagaaatgaatctcctttttttctatactctatcctcctttttgttttcttggcatgcatatggaagaggcatggctatattatttttttttcaactttgctcaatgttttgggagcaagctttatttccttctttctttctcccttttttcatacatagccatgccttgccttcccttttctcattttcttttttttaaccaagaacttttctaggagaagaaagcatagtctgaagtaggagtttatttgaatggaatttttgtggaaagtcatcttccagtgtacaagcttagcccaattatatatgtggaaatgggaagtggaaatgacaatgaccccttgatcatgagagtatgaaagatatctaacacgagtcacataaattcgacaaagctcaatataatgtcaagcagtcatatgtataacaaggttcatcaatgatatacttgcatatggccttggtaggtataagatgaagtcaattggaggattgagcttttaaaacaattttattttgaaaacaaattcccaagagtcataacaagagttgcaaggattcccttcatcttgaatcatctcacataaagcaattacttagatgcacaaggttccctaaacatggatggttgttcacaagcacaagttcagctgagaataatgaatatacaagatcaatcacatgaagaatttcattagttggaaattttatctttcacttatgcttgaaccaattgttttctgaattttcagctctagtactataccgtggtggagatatacagatacaagacgtgctcacctgcttacctatgaaaattgggagggattggggccagctttggttcggccgaaccactctgatgcccaattcctctgcaatttttttgcaaagttcagtgccttccacgtgttcagatattcagcaattttcagagcatatgcacgtcagaggctgggatatctcccccacacttattcaaaacctgaattttattaaacatgaaacaaaacaaactttggcaaacattggggttaacactaatgagccacattattcatagcaagtgcttacatgattggaaaaataaaaccaagcacctactactattttattcatgggaaaggaagcatctaattagcataatacttattttcctttcccatttctacgaatgcacgcttgatcttagcctggcacaaaccgcgactaagggtatcgaaattatttctaattcagcaagctctacccctagctccgcgttgtgatccctaaactctatgttctccttgcggagtttcttcacttgcgcagcgagcttatggattgagggctccggcgacttcacctcatcttcttgatattggcctggagtccttactattggagggggtgtcaaatgacgcttcaccttcataggtggagggctacgggattccgctgccccctccttctccgatgctatcaacggccggagtaaacccttgccatacccaccgccgggagtttgcactccctggatgcggaatcgctcctcctttggagtggatggagtagcggtgggtgtaacttacttatgtagcacctcatcccctgccttggtgaacagggtgcccacatagtgctcggcgggaggcggcgcggccttcccgtcatcttggaaaaggcgtcgcgccttcaacaagccgagttctcccgttgtcggccgtcgcgcaggcgaatccccccgaattttcgttcttgtgacatggcgaggggagacggatcgcactaccgaacggagggccgaacagggccgagaggggttcggccgaaccagggagctcgccgacgggctctagatttgcagtggagcccggcacagctgcgaggggttgagcccatatagcatttaccccttccatcgtgtattcttccaccggaatcaattgatttgccagcgtcggctctccggtgagattgtaagtggaattggaagaagagccaataaatgggatcagtgatttgcttgccattggtgaattggaggtgatggagcaaggtaattgggttgagatagagaggaggtttgcaaagtgggaaggaggaggaagaataggtgctttggttggatgcgactgatccacctccgagagcgcatcacaatggactatagacgagcgggagagattgctattcgaaaatggggccgaacgagcgccgctctggttcggccgaaccctggtgggtccggcaggcctccacttttcttcctaggcccactaattcctaagctaagcgcagaaatgacaactatacaaggttttaagcatgcactagatgagatcatcatggttcataatcgattaattcaataacatccacttcttcatctaaagtttcatttggttcaaggaaagtctttaagcgttgaccgtttaccttaaatatgttgcctgagtcgtcgcggagtgtgattgccccgtgcaaagaggtgtcgatgacgtcgaacggtccttcccatttactacgtagttttctgtggccaaaaagcttaaccctggagttgaacattagcactttgtctcctggcttaaatttcttgatttttatccttttgtcatgccagcgcttcgtcctttctttgtatatctttgcgttgtgataagccttctctctccattcttcaagttcagcgatttgcatttttctccattctcctgctccctcaaagtccatgttccagtttctgatggcccagtatgctctgtgctcaagttccacgggtagtcgacatgacttcccgtagactatctgatatggggacattccaatgggtgtcttgtaggctgtccggtatgcccacagtgcgtccggcaatctatccttccatcctgttcccattttgttgaccgtcttttgcagaatattcttgatttgtttgtttgatgtttctgcttgaccactggtctgtcgacggtaaggagtggccacattgtgtttggctcccatctctcgtaggaggtctcggaaggttttttcaatgaagtgagaacctccgtcacttatgaccattttgggtaccaaaccttgggaagatgatttctgtgaacatcttcttggcatgcctcgcatccgcggcgctgcacggcatagcctcaacccatttggagacatagttgactgccaccagaatgtactcgcagttgcgtgacttagggaaaggtcccataaagtctataccccaaacatcgaatatctcgacttgcaaattatatgtgaggggcattgcatctcaagcaagtgattcctccttgcctttggcagcttgtgcatcttctgacgaattcttttgagtcttcgtacattgttggccagaagaaaccactttgccaattcttggcctgggtgcggaatgcaccgtaatggccaccatagggtgaggcgtggcatcgttctatgatcttaagtacttcatcaattggcacacatcttcgtagtaagccgtcagagcagacccgatataggtatggctcatcccatatatgacggtgactttcatacttcagttttcgttgattttcccctggtggtatgtacttggataccatgtagtttactatgttggcatatcacgggttggagtcacgaaccgttatcaacatatcgtctctcaagaaatcattaattggttgttcctgcatgtcagtgatctgcagcctggacaaatgatctgctacagaattttctactccctttttatcctttatttctaagtcaaattcttggagcagcaaaatccatcttaagagacgcggtttagcatctttcttagtgagcaggtattttaaagcagcatgatcagtataaattatcaccttggctcccgctaagtaagacctaaacttatcgatagcaaaaacgaccgcgagcagctatttttcggtagttgcataattcaactgagctccggttagagttttgctagcgtaacagattgcatgatgctttttatccttggtttggcccaagactgcaccaacagcgaaatcgcttgcatcacacatgatctcgaaggacagagtccaatcaggaggttgaatgattagagtggagacgagtgcctttttgagaatttcaaaagattttaggcacgcgtcattgaactcaaagggcgcatccttagctagcaaattggtcaaaggcctggcgattgtagaaaagtccttgatgaaccttctataaaagccggcatgtcccaagaagctgtggattcctttgatgttcacaggaggaggaagctgatctataacatcaattttagcccgatcaacttcgattcctcgttcgaacactcgatgcccaagaactatcccttcacagaccatgaaatggcacttttcccaattaagcaccaggtccttttcttggtatcgttctaagactttgtctaaattctgtagacaatgaccgaaagtctttcgatagaccgagaagtcattcatgaagacttccatgatgtcttcgatcatgtccgagaaaatagacatcatacatctttggaaagatgcaggagcattacacagtccaaaagacatcctacagtatgcataggtgccatatggacatgtgaacgtagtcttactttagttctccggatggataggaatttgatgatacccggaatacccatcaaggaaacagaaaaaggaatgatttgccaaccgttccaacatttcatcaacgaagggtagcgggaaatgattcttttttgtagccttgttaagtttcctgtaatcgatgcacattctccatccggttacggttcgttgcgggattagttcattttgagcatttgcaacggccgtcattcctcccttctttggcacgacctgaactgggctaacccactcgctgtatggtacgagataaataatcctggcatgcaggagtttcaagacttccttctttacaacttctcgcattgcattaatgagccatcgttaaggttccctagagggagtactctcggggtcaataggaatacgatgggtgcaaagcgcgggattaatccccctgtggtcttgaagcgagtagccaagaacagaacgatgcttttccaacacggtgagaagatgttgagtctcgtcttcagagagcttgtcactgattatgacaggggccactctgtcattgtgtaggaaagcatatcataggcctggaggtagaggtttaagctcaagcggaggtcgaggtggcgggtccatgattggcaggtcgagagtctcaccaggatccacttactctttgatgaaataggggacctcatcttccagaagggcctcgggagactcgtgagggggaactgcaataacctcttccgctgactcaatttctgggagagggtcggtcaaggcgatccttgcccgtgagaatggaattgaaaattcagtctctcccagtgttattttgaggctatctaatcggggtgtgttgatgagaagttgctcaattggcagcccgattaggatgtcaaaatcttggatttcaaaggcatggaaatccaagatcgcctccctatcttcaaagcagacaagcacatcttgcacaatcccaaatccttcgatgatatttccgcttggatgtttgaagaatttgtttgtcggggtcactgtcttatcgcttaaataagcgaatgcaaaagactctgaaacgagattggccccgacagttagactgtagagaataccgacgtcattcccttccagatggcaaggaatgattcggggagcggtatttattcgaattacttcggatgaaagctctgcctcccttaaccattcatcactcattatgaatgttaactcccggacagtttctcgtaggaacccgagttccataggacctggaggtgacaaagaaacgggtggtttcctcttgctaaaatagttcaagttattgccgtagtcttcatcaaagccgtccctgaacaggattgcggcacgatccagagtctgaatttcatcattctcgacggacagctgctcaggaaccttctcatcaaccgagctaacagaagtggatggttcagcaagtagctcgatcgttagaggttcctctatcttggacacggatacctccggctggggttcattggagtgcgtcatgaaggaagtattttctagaatgcgatccaaaattgttcttccttctgacggcgttttgtgcaggaacgatcctctagcggttatgtccagatagaatgcagactccttatccaaacctgatgaggacatcccttccaacgatacaaccacgcctattgcacagcaaggaccaatgactagagctcgagctcgtgaacttaattatcaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaactttgacccaggctgctcagaatgacgaaaatagttctttacatcagaaacttgggcttgggccttgtatcattacagccatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattccgaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcacgaattcatcaccgcaaacacttccaccatcacttcatttatcttcatcccgctgccactatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgttttgacttgttagctgaagctttgagcttgctgtacaaaaaaaaagaaagaaaacaaaaaaaaagaaagaaaaaaaaatcagaagtgaagagaaggaaaaaaaaaggaagggaagagaggaagttgttgttgttgttgttttgtttgtgttattttcgtgctattttgagtggctacgcttgtgactaggctcgcgtctctaaagggttttgcctaggaccagtacaataccatcgttgaatgattattcaacttgctttgattaatgtggttctagctgtaccttgatattacttgcagccacctatagctccacaaatttttatctactatatcacaggatcgtgcttgttgtcagctccggtactactaaccattgttgctgttcttactatttgccaacgccttttacataacaaagtaagaacatgtaagaactcgtttgcacaagtttggtagaagtgtagatggacaacacctagctccaatagttgataggacatatttcttgtgaattgtttcttcccattaaccatgacaggaggatcgggggagcaccctcaacattcaccacgtacgaggggcatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctgtgaacacttctcttgcaggtatcttgaatacgttggagagaatgggccaagatggtcatgatggatcggctaggcgcaaccacaatggccatgatgctaatagcagcatcgcagcaagggaagaactggagtatgctgctgacactgagcatgatgaggaggtacttggtcgtccacaaagacaacagcgccggcagcgccatggcatgggcgctccaccacggcgggaggtacgtgataatgatgattctttaggcaagatcaagtttaccattccttgctttgatggaaaatatgaccctgatgcatatcttacttgggagttagccattgatcagaaatttgcttgccatgattttcctgagaataaacgtgttagggctgctactagtgagttcactgattttgcatccatttggtggagtgaatttgttcgttccaatccaaataacactccccaaacctaggatgcaatgaaaagagtcatgcgagctagatttgttccttcatatcatgcacgtgatttgctgcacaaattgcaacaacttagacagggaaacaaatctgtagaggagtattatcaagctttgcaaacaggaatgcttcgttgtgattggtagaaaatgatgatgctggtatggctagattcatgggtgggctgaaccgagaaattcaggacattctagcctacaaagaatataattcaattaatcgtttgtttcatcttgcttgtaaagctgaaagggaagtacagggacgaagagctagcttcaggactaacatttctgcaggtcgtgctagctcttggacatcttctaacgctgctgcaccgtcaactcgagcagcagcaccatcgtcctcaagcaacaagctgcgtccctctacaagggctgcagg

SEQ ID NO: 63762 - DNA, 6751 bp, Oryza sativa
gaattcgagctcggtaccctagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtcttgtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatatgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagttccttttcctcctttcccgtgtgctatttgcaaaatgtttactctttcttccgtcttcaaatttcaactagtactagatggttagttttgcgagagaagaagatgtcgccaattgtctgccgaagctccggaaggctgcaggattcgctagcgaagtggaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagaatagtgggaagtgaaccaaatgtaaagaaagtgaatccgagttgcttgttcatgagagctattcccagttatgaaccaagtgatatgttcgaagatagtctatggaggtcagattaaaatcgcatctaacaacgaagcttcagatttggcaggataacgatcagaccataacaagtccagcagcaaagtcatttggggagacgtcaaagcatgtcaagtgggataagttggttctttttagaaacataattcaaaggcaaagttaccgacccttgcatcgaatagcagaagtagctagcacctggagagcaggaaagctaatatgaggcagttggtggcaagttagaagtaaatgacaagcatggtatcctagtaatgacgagctgatctcgacgcatgacatgaagtgggtaacttgtatgaggttgactccaaagatatgaactatgcgaagttctggaactgaagccccatcttcaagcgccgcaacccagtcgaagtcagctaaaggttcaaccagggacaagtcaggcgaagagaagattccatctgcaacaagggatcgagccaagcagcctagagtggcgaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctcataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagcccttaaattttacttgaattttcagagcaccggaaataattattaagcaacaaaaacaattatcaaagtttattaaaaagaaaaacctaaaaaataatcctcttcctcctttgggccaagcccagcccaaagtctccctctcctccctctctttctctccctctccttctctccctcctcctcttgggcctcctcccctcccggcccactccctcctccctctctctcccgggctgcctctccctcctctcctcctgggccggccgctcggcccaagccgcgccccctgcccgagccgcccctccctcccgcgcacgtgcgttgcacgcgcgctgagcgcgcgccccgcgtgggacccgcctgccaggcgtttcttcctcctcccgcacagcttctctctcccccgtgcgaaccctagctcgctccctcctccaaatccgcttgattcacttggttaattccaaaattgattagggggttttaatccccattgattcctcttcaatttcccccaatttcccccttgaatggcgcccccaatcgtcgggaacgcccgcgttttctccggccaccaaccatggccgccggccgcctttaccgccgccgttccgacctcccccgtggccggctccctcttctctcctataaaatgcaaccccctcgctccgttctatcgctttagccccctcccgcggtctcccatggtccctagccacctccccaccgtcgccctctctctcccgtgccgctggacgcctccagccgcccctaccgccttgcccgtgcgccggccggccgcgccgtcgcctcctccagcgtcgccgccacctcctccaccccggcctgccctccgtttcccgcggagacccccggagctgccttcccgccgtcgcccttctctttcctccgtgccggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcgccgacgactagtggtgtcgccaccactccaccatctccagccatccctgccgcctcgcctgagcgtcggccgacgtcgccgtctcctccctcggcgtcgccgcatcgccctccaccccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagccgcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagtgagccgccgcagccccgtcatcgtcttcgtcctcggctccgcatcgtcaagcctcgtgccggccgcgtctcgccttcgtccaaggatcgccgccgaagtcgttccctcgcctcgccgcgtagtggtaaggacctctccctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgttgacccgtggaccgtctctgtgtacccggtctaccgcggtcctttaggttgacatgtggggtccgcatgtcaacagcgcagccttcctgtctcttccaggctagcgcttacacctgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagtaaggcaagtcacgtcatccttgaacatattgaatcccagtttataaaattatgttgctttaaattattgcattatcgctttatttaaattcccgcgttatcactgttttatctagccatgcctatttacctttgttatgaccttattattgttgttgttattatttccttgttcaccctagaataaacaaaaccccaactagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataactttgcatagttctaagatcgtgtttacaaaatagccctgagcaactaaatgtctttaaatgctgtttac

SEQ ID NO: 63763 - DNA, 677 bp, Oryza sativa
tcgttcacgagtttgtgtggaagacaagggattatacaggttcgggccgctgggaagcgtaacaccctactcctgtgtgtgggattatggttaggtcttacaagagatcttgagctcctagggaaacctagctgttattcctctagagctcaagcaatcgagagtcgtcccttttctcgatgggcgaggttctccttttatagttcaaggggataccacatgcaccgtctatacctacccctcccatgggagggggacccaccctgtctggatcagaccgccattcatgccttcaaccaaaagcaaggtggtcgtgcgtccttgggtggggcccagcaccgtcccccgcctgacacgggggacatccctgtcattcccctttaaatgtatggagactttggtggctcaccacgcgcggagggcgctcctggcagtgcatcgataggacggggcatacctgcccccactccgcctgacacagggtgggacgtggggacgctaccgcccgtccaatcacccgtgaccggtcataaaccggtcacgcccgattgacatgggtctatcgggcggcgccgcacgtccacccacaccgcattaaatgcagtgaggaacggttggagtgccgcgcattaaaggccctaagaggcgccctctgcctcgcccgctctccccgccac

SEQ ID NO: 63764 - DNA, 5168 bp, Oryza sativa
tgtaaatgcgatgtttgtggcgcgacgtgtactagcgtggggttttttgtcgacggatttgattggtcggcgggggctgacgggtgggtcccacgacatttcggggtgtgcgtgtgacgtgggcgtgaagtcatggtggtgacgaggcagggtcaaagtcagagttgtcatgctgctttatttagctactgttctgcttttggggagcgaggctcagaaaactaatttctgaagcttctactaatcgtcaagatgagcacgggtagtttggacgattagtgagacacccatggtataccgccatgtaccattcctctatacttctgtatatgtctagatttattaatatctatataaatatagacaatgctagaaagttttataatatgaaacagaggaagtataacaaaaaaaatttccacacaatattttactacctccgccccaaaataaacgcagtcgtggatatccgtgtccaacgtttgactgtccgttttatttaaaaaatttataaaaagttaaaaaaatagttacgtataaagtattatttatattttatcatctaatgacaaaaaaatactaatcacaaaatattttcaaataagacgaacggtcaaacgttggagatgaacagtgtaaaactgtacttattttaggatggagggattagtaaatttgtagtttagtgcctaactatcaccgagtcaaaggctcatagcattgtggtggttggcggcggcacatgtggatccacagtggttggaggcgcctcgtcgtgatgaaggataacgaggaatgggatcgagcggcgaaagcacctaaagttgttccactgtacgctaagaatttacaggttacttattactagcaggatatattacgagtgtattttactgtaaaagttctcttgaaaatgctgaagcttttactaatcatcaagatgagcacggctaactaggtattaagttttaataaaattatgacagggctttataaagatgacctggaactggaatccttgatgcggctatgtgtttctacttaggaaaatattcagaaccatgatttgtacagccaccggttggaagttcaaaactgcatgtgagctattatgctgaaaatatacaaacatatatgggctggtgttagtgagctgctagtgaagcctgtgaagtgaatttgtgattctgcaattcccaagttcttgttgtcttgttgatctacttctatggtgctaatttaattctcatacaacttgtggagtcatttcggtcatcactcatctgtcaaaaactgataaactgtttgtgaccagcaccaacttgttctaccagcaaagtttggtgaagagccatatagcagataggaaaccaacccctaatattcagaaatttagaatgcctgagccggccgtgtgccgtgaggcatctaccggggtaattcagtgcgaaattaagatcttggtgtcagatgttttggatgcataaatctggatacgtttaaacttgggcagattagtgttcaatgagtttctgtctgctggctggcctgacaagttttaacaatgctataggtcaattgtagttactcctgccttagatcgatacgatattggagttgccaatactcccagttgtttaccaaacaagcagtgtaatcttcacgcagaggtgcaaccagagagttgatcaagcatattgacaaagcacacttcagtgaacggaaaccctgtgaatttactgcaaattcagtcaacagcttaaacctctctctctaaaaaaagttttaaagctctgaaagtctgaattactgatcacgtgatcatgtgagatcatgtgaaaatatatttgtttcagaaatgaaggttgaaaaaccaactctcttttccgtgcctgtacaaaaacattttcagatttcaggaccctctcttcctcctttgttaaagcatgtattgtttatgtagttacaccatttatcttggaagtgatgtttacagcggccaaatatattccagttttgcatatgcttagattttaaagattcaaattgaaggaattattctcacaattgtgtcgattatatgttgatctcgggcaagtgaatactagtgtgatctccttatcagtcaattcgcctcctttttcaagaaaggtaagaacagattcttctcgtgcaagttgtgctgttgctttggttccaatacttgtatagctatgaccagtattcataccttttcgtacttgatacgtcctgctgatgaaacaccggtgtcactctatcagaacagtattcaggttatagaatttttttgatgtgtccaattgtccatcatgaatctaaagctccattcaaaacagactattggacggatcgttgctatgaattatctactcaattataagaataaattaaataatttaaaacatgtggtctaaataatatagttaaaggaatatattttttagaaaatgtgtttttcaaattatggagcaataatttgtttcaacaatcagatggataatctgaaaataagatgcatatgtacttaggggtgtgtttcccatttcctacttctcgtttttttacgcccatatgtttcccaactgataaatggtgtgtgcttttttaaaaaaaaatctataggaaagttgttttaaaaattatattaatctattttaaggttttttttctaatatttaattaatatgcgtaaatacatgtttcgttttgtgtacctgaaaggaggatttccaacccttactctcaaacacagccttaaaagcctacaaatgtatgagcatattggcactaaaatttgtttcgatcactttgcttactgctatagctctagctcttcagttgtcaccttttgttttctccttgtctttctctgcgatgtcgtggttgctccactctcttctcctcttctccttgcctgtctgatcgatcgcctcgccaccgccgccgccaccgccgccgtcgtcgtcgtcgtcgtcgtatcggcatggaggtgtcccacatggccaactgcagcaacgtctcctcaccggagcagcagccgatgccgccgtcttcggcagcggcgtcgtcgccgtcgccgccgcagcttgactacgacgtggtggtgatcctggcggcgatgctgtgcgcgctggtgtgcgcgctggggctcaactcgatgctccagtgcgtggtgcggtgcacccggcgcgccgtggcggaccccgtcggctgggtggagcaccgccgcgccggcgcggggctcaagcgcgaggacgtcgtggcgctgcccgtcgccacgtacgtcgcctcgccggcgccctccgtcgccggctgcgccatctgcctgtcggacttcgccgacggggagagggtccggctgctcccggcgtgcggccaccggttccacgtcgtgtgcatcgacaggtggctcctggcgcactgctcctgcccgacgtgccgccgccgcccctcgccagaggccgacggccacggcgccgtcgtcggagaagaccaccaccatcgcctgcaagttttgactgctgcttaattgatcggctaaactttttttactatagattatgagcgtgacctatatatgctcattatccggtaaataacttgtataatggctgatgattttacttcgccatcttgagtgagtagttattattttcgtctatccaggaaaatcatcctgaatgacagttgcttttatgtatgagcatcccttgttagttgttactgcataataatgcaaagctaatcattaaaactggcaatgggtctacagtatttgcccttttttttaaaggaaacaactcagaacgcatactcacacaccacaatcacatcacaacacacgaacacacacgtgtgcgtatccctaacacacgctaggattgagaatggaggcactaggcctcaatgcacgggaaacgtgcagtcccactgaacgcacatgcgtgtgtaccctattttctagttgagactgccccgaaggacagtcccgaagaaaatacgggaaaaacccgtcgaggtgaggccccgcgagtcgaattcacgaccgactattcgcaccacagcgaacatgccaaccgagctaagctcgatccttagtattcaaaattttcaaaagacctaaaaaaatacacaatcgactgcactaccactccctattttctagtcgagactgccctgaaggacagtcccaaagaaaagactggaaaaacccgtcgaggtgaggccccgcgagtcgaattcacgaccagccgttcgcaccacagcgaacttgccaaccgagctaagctcggtcctcagtatttgtagtttttttttggcgaggaacagtatttatagttaactactccctctgttttaggttataagacattttgactttaatcaaagtcaaactgctttaagtttgactaagttttaacattttcaacccaagacaaatttattataaaaatatattcaatgattgatttaatgaaactaatttggtattataaatattattatatttgtctataaagttagtcaaacttgaagtaatttgacttttactgaagtcaaaacgtcttataacctaaaactctaagagatgtactgttcacttacttcatcaatcaaaatttccaaaataccataaaaaagcacaatcgacggcattaccactccatccctaaaagaataaacatcttactataaatatttttatgagctatgggaactcaagatttttttttcgataatgaaaatcgatctagcctcataggaccgggagatatgaacagactggcgatgttcgtttcactaaaaatggaaatgaagttagggcacgataaatgataaagtcattagaatgtgattaattgagtttcatattgtcaattgttacaaacttgaaaaataaatttatcagatattttaaaataacttttatatagaaagcttttacacaaaatataccgtttatcaatttgaatagcgtgttaacaaaaactaagataaaatctttatcttaaccagcaaagaacagggccattgtacagttaggaaaaatacaacaggcaggtctcacgactctcgtcattgcatagagacgacacaaaaaaaaggagggggaaaaatgaagtgattcccacggtttatctggaggg

SEQ ID NO: 63765 - DNA, 20311 bp, Oryza sativa
ctaaagatctaggggtatatatattcccgatgcgcgccctcgtcttctccaccaacacttagaagtttttgcccgatcgatctctctcggcttctccttcgccgccactgcctagggcatccccgcgccggcgccgccgtcgtatctcgccgtcgtctcgcgctcgtcgtcgtcgccgcctccgcctcctccgccgccgccgcatctctagggtgagagccaccgccgcctccctctcagctctctctctccgatctcgatctctctctctccctctcgattgccgctggccgcctcgttgccgacgccgacgtcgtcacgacacgacgccgcggcggcatggcaccgccgcgccgccacgccgccgccgcgcaacgccaccgcgtaatgcctccacgccgccgccacgtcgccgccgcgccgccccgccgccgctccgttgccgccacaccgccgctccgctgccgccacgacatcgaacgaattaacgtgaacgtgaacgaacgtgaacgagcgaacgaatgtgaacgagcgaacgaacatgaacgagaacgagcgaacgaacgtgaacaagaacgtgaacgagcggacgaacgtgaacgagaattgaatgtgaaagaacgaacgaacgtgaatgaacgagtgtgaacgaacgtcaacaaacgtgaacgtgaacgaacgtgaactaacgaacgtgaacgtgaacgaacgtgaacgtgaaatgcaatatatgcaggtgaatgaacgtgaacgaacgaatgtaggtgaatgaaacgtgaccttaacgagaacgctaacgtgaacgatcgtgaacgaaacgtgaacgtcaaatgcaatatatgttacttcgcgtttatcctaatacatctttttgtatgttgcagaaaagacgttgtcggagtcgtccctcaagccggagtggtagctagccctcgaaggaattcgcgcaggcaagtgacgtaattatatatatgattgttatatttgtaatgcaattaagactattagatttaatatacgacacttagacttagttttaatataagattattatagttttaatataagattattagatttgtaactagacttagcatataagattgtgtagggttctaatatacgacagttagactacgcatatatgactatttgagttttagtataagattatttgagttttaatataagattattagatttgtaattagacttagtatataattattgactagctagggtcctataatatacgtcacctagacttagcatatatcactatttgagttttagtataagattattagatttgtaattagacttagcatataagattgtgtagggttctaatatacgatagttacacttagcatatatgactatttgagttttagtataagattatttgagttttaatataagattattatacttgtaattaaacttagtatataattattgactagctagggtcctataatatacgtcacctagacttagcatatatcactatttgagttttagtataagattattagatttgtaattagacttagcatataagattgtgtagggttctaatatacgacagttacacttagcatatatgactatttgagttttagtataagattatttaagttttaatatacgattattagatttgtaattagacttagcatatacgatagttagacttagcatatacgacagttagactaagcatatatgacttcgcatacacgacagttagacgtagtatatatgacttagcatatatgattgttagcctataagattgttaaaacataaatgtctcatgacttagcagttgtttcctatatgaacagatggctaatcgcgatgaggaacagatattgtacgatataatcgtagagggaagcagccagtactggaacgaagaagagggtaacgaggatccaaaccagtatttgaacgaggaagggaacgtggagagggatgcgtaggggaaccaggaggggcacgtggaaagggatgtggaggggaaccaggaagaggaggctagtggaagtcaaccctccgctggacagaagagggcacgcgggcaacgaggtgccgcgaagaagcttgagggtcggcacatcataacggaagtggacgaagacggccgacctagtgccccggcagaagccgccaagaactatgtacatcacagcggttgggttgtgcgggataatgtgcctgtcagtacggtgtactggcgcagaacaagggcacgcggagatcatgagagctttgacacagattcggagaaagagatgctgtgggccacaatgctcgagacattcacccttcccgcgggtatataagacaaagtaaaaggtggactctgaaggaaatggcagaacagtttcaaagctttaagggagatctgtaccagaaatatatcctgaaggggcagacaccgaacttcgatacattcccaaagctaagagatcactgggacaagttcgttgcatataagacaggtgaacaagggcaagcgatgatgggaagaaacaaagaaaataccgccaagaagaagtaccatcaccacttggggtcaggcggctatagcgtcgcgatgccgaagtaggaggagatggaggctagcttgcttgagaggggtatcgaaccggccaccgctaattggccggaacgatcgaagttctggtactatgctcacggtggaacgctcaacccagctgatggctccctagtcttcggcgatcagatacgcgaggctgcgcgtcaactaacagacgcagtggaagcctcttctcagggcacgttccgaccggacagagagaaggacgacctgtcactcgccctgcagactccagagcatccaggatgaacacgagggaaaagggtgattccttggaagattgggttcaaggaggacatccacacatacaggagtcggatgaggagcaagagagataccgaggcgaagattgtagatcttgagttcagggtatcgagctacgagctcagcatgcaagaggaggtggcaaggaaggttgatgaatgcatggccgcacatcggtcccatgatccccagccgaccatgcctcctgctatggtgagcccgtcaggaaatcgtagcagctgcgcctcaacggggtaggtaggatcacacagcatggacgccatgcaaacccaggacgaaaccacctgccccgttgatgacatcactcagcggacaccatgtgagctgcatattcccttcaagaacttatcaataaaggtaagctcgtagtttatagattttagatttggccattccgctagttgctgcttatatatgttgattactaataaataacctctcaccacatgaaggtggcgtcgagcatggccatcccaacggacccttcaggtacttaccactgcaggccgattccagcaggatactccaaggtcgaaggcgcgtacgaggacctcgagctggattaccctggaggagacggtgagacgcatctacgagacacaagccatgctattattctatggcgcaagcggtacatcatcctccctaggcgacaagcggcgtctcgtgcaccatctcctccggctccgccatctcctcctcaggctcctgcaccgtctcctcctcatgctccagcaccgtctccacctcaggctcctgcaccaactcctcctcaggctcctacaccgactccgcaagctcctcttccggcaccttccaagtcaagggccccccaagctccaccgcctgcccccacaagggcaacgaagaaggcgaaagttgacgccgccaagaacaaggacccggggtatgattgcacgcaagaggagcttgatgcttacgtggcatcagaagtcaggagacaattcaagcctcgaagtctagaaaagaagattcctatagacccgagtgtcaggaacttcttcaggggtatgtctgcacctgccaaggaggccataaagctatcggactatgagcgaacactcaaaaaagcatcttctggaaagtccaaaccagtccctcagcttggagagcaaccaaaccaggagatcgagccgttggtgaccggtgaagattttggaatacaagactttattaatgacaccgggctaactacggatcaattgctacgagacgcaccaatcgaaaaggcagaagtgaaatacatgtacgaactcggtaaactgcttgtcaagcctgagctgctgcagtccctacccacacaaatgtacaagttccatcagctgtacatggagatgagcgccaccggtagagagatgatcggagcgaggatcagggacacagacttcttgcaaggagatgacattctctggatcaatttcaagggaatctacgaactataccagctggacgccctcgacgtctctattatgagttgctggattttgtaagtatattgttcagttagatttcttactacgtctcctttaattaattaggtccttgtatataagtagactatatataatatatactcccttttatcgttgtagaatggagattcaaagggcccgacggcggggggtttttgatactggattcatcgaccctcggaaagtaaacgttgcaatgctcgaccaatatccgcaagccacaaaggacaatctcgtccatctcctgaaggcgcagcattacaagacgttcatattgttgccgtacaacacagagttagtttaattttactgtcttcctataccaaattttattcccatacgaacatgctaagtgtttcatatgtaatgcatcccacgtacattgcagattccactgggtgcttttactcttcgacctggaggcctacaccgtcaacgtatatgactcaatggataaaaaagagtctacgtttgacaaggttttcgaacttatagacaggtactgtcataagttcctatgttaattaagaatcttgttatagttaattgctactacaaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtacattaattagatctctcgtcgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatataatttattcgcatgagggataacctgatcacacacaaggaatttatcacggcggttcaagaacaactcatgggattcatcaacggacaaatccttgatcccaagggtgaattctactacgacagaaatacaattcataggtccttagcttctgagatagcgactactactacgttgaaatcgtagctagctaggacatataatgaattgtaattaatacatgactatgtttctatatgcatgtgtacacattttctataatgtaaatatatattttggtcatatatatatatatatatatatatatatatatatatatatataaaccatgcagcaacagggccatgcaaaaaaaaggtcagctacaccaaccgggactaaagatggcttagccggccacgtggctgagccatctttagtcccggttattttatccgggactaaagatagcaatctttagtcccggattggtagtcccggtttggaaaccgagactaaaggggggttacgaatcgggactacaaacgctttctccaccagtgcttggagtccgtgctgcagctggctacagatctgtagcccgctgctcttctctctcatcttttatcttattaaaatatatttatagctggctaatagtctgctattgtacctgctcttagggagaaacaacagtcagtattgtggctcagtggctgcaacacagtagcagtgctcatcgatcattacatgacaatatgacgatccacagcacgtacattacacatttacacggcagcaaagtacagtagctactcctaattagtttcatacagaatgttggatgaatatatatactgttcctatataattatccccattagctctgattataggtagccatatcatcttatttatttcagtcactagatcaatatcaaactccaaataataaccatgcatcaaaccatgtgtaatgcaacctttgtatatcacttcttcatgttctatgtcaccatgcatgtatccgtttaaaatagctaataatcttcacaaatgactcttaatttttttagacaaaatgttattgcaacgcgcgaggcatcattttgtttcatgaagggatagttgcctatcgagatgctcctaattaattaattgtggggtagctactttgttatcaaaaaccatttaagtatctgttgattcattaatttagtatcgactttgcagtagcttatcaattgtttttacaatgaaaatatccttatgaacatacaatgttgtaagttgtgttatctcgttagaaggttcaaaaacactttttcctcaattttgcctacatgatacgatatgttagcgtgtacctcacatgaatcccatacattaggtcatttcccttcttcgtctccccgttatctccccagtagctcacaacattgtttacacttttggaaaacctctgaaaattgggtgatttcggtggtgaccaaaaaatcatgatttttggacctttttcaccaaattattgaaaattttaacaaattttgaacactattttgactacatttcccaaaaattgaaaaaatctaacaatttcggtcgagatagttacattgccgaggggtctgaaatttcaatcctaacaacatgacatcccctgtgaatgtcatcgatctgtcaaagtgcaccaacttcccacccaccgcaccactaaactcacctctatcacatcgaacccttgcctcacccacccaccatcacaccaccagcctagattaagccaaacaagagaagaaagagtcgcgttgcccgtctgccaacgacgtagggagagggtatccttgatgtacttgatgccaagccattttctggagcgggtgaagggtttggtgtcatctcagtagcgaaggaagccgtatgagttgaagaggctatacttgatgacctacaggccttgtagtctacctgactaatagagacgccgccatcagttgcgtggacatggtggtgggtagtgatggtggcaaacgatgcgaggaggaacacatagtgcttgttgctatggtgaggagcatgtgtagagggagttgtcgttttctgaggagcaagagaacatgagtgtgaggcggcagagcattgtgggaccggtgagcaatagggagaggaagagaagatgccacttgagtaagtgggctccataatagagtgccacactagcatgttacgatataggcgaaagcgtaaaagattaggaagtctgatctccagagaaaaaacataagacgaaactaatagtgccatttaaaataaataatagtgccccttgaaaaggtgacagtttggttagtgacaaatagttacattctcgttgggccaccgcggtttgcttcccacaagcctacaggggtgagggggcctggccttccacaacaagtccggctcaatacagccgcaccgcacaaaacctgggcccccaacgtcgacgctgcggcgctgcctgctacgctcgctttctcctcgtctccgctccgcttcgccggttgacggtgcgacgcacgaagcgacatactctgatactcgcgcacgctgcagctgcacgcaccgccgaggcgccaacacgacgctgtgccgtggcgcgccgacaatcatcgcgcatcaccgtggcccgtgagaactgaggtaagtacgtacgtctccttccagcttgccctggcacagcgtggtctccctatactcaattgctggcttcgccccctgcctgcagtggcccacgcctcggattcgaggatgcgctgcctccgccgcccggcaacccacctgctctgctccgctcggagcgcccacgccgggaacgcccccagggtgctcgacgaaatgccccttccgcctctcgctccatcacgccgcacgacgactctggtccgcgcgcaccacctgctcggcgcaatgcgcgggccggggttctgcaccaccgtgggctcagaatcagatgtggagccgcgattcacggtggtgccgggcgccgcccaggagggccttgcaccgggcgtgtccgaggcggcagaaagggtctgccgcgtcgtgtctgcccagccggagcatagaattgcgccggtgctcgatgctcttggggtaaccgtctcgccgcagttggtggccgaggttctcaagaacctaagcaacgctggcattcttgcgcttgctttcttccgatgggcagagaggcagcaaggcttcagatactcggccgagggattccataatttgattgaggctctcggcaagatcaagcagttcaggctggtgtggagcttagtggaggccatgcggtgccggagctgtctgtccaaggacacgttcaagatcattgtcaggaggtatgcccgggccagaaaggtcaaggaagctgtcgagacatttgagaagatgtccagttttgggctgaaaacagacttgtcagattacaactggctgattgatatattgagcaagtccaagcaagtgaagaaggcgcacgccatcttcaaggagatgaagagaaaaggtaggttcatacctgatctcaagacatacactgtcctcatggaaggctggggccatgagaaggacttgctgatgctcaaggcagtgtaccaagaaatgctcgatgcaggcatcaagcctgatgtcgtcgcgtacgggatgctaatcagtgcattttgcaagtctggcaaatgtgatgaggctatcaaggtgtttcatgagatggaagagagtggttgcatgccaagccctcatgtatattgtatgcttatcaacggcctcggttcaatggagagactcgatgaagctttgaaatactttcagctttctaaagaaagtgggttccccatggaggtgcctacgtgcaatgcagttattggggcttactgcagagccttggagtttcatcatgctttcaaaatggttgatgagatgagaaagagtggcattggcccaaatacccgtacctatgatattattcttaaccatcttataaaatctgagaagatagaagaggcttataatctattccagagaatggagagagatggctgtgagcctgagctcaatacatatacaatgatggtcggtatgttctgtagcaatgaaagagttgatatggccttgaaggtatggaagcaaatgaaagagaagggtgtcctaccctgtatgcatatgttttcagcgttgatcaatgggttatgctttgagaaccggctggaagaagcttgtgtatatttccaggagatgttagacaaaggaattaggccaccaggtcaactttttagtaatctgaaagaagcgcttgttgaaggaggcagaattaccttggcacaggaggtgactcaaaggttggaaatgttacggagaacaccaatgcgtggttgagtaatcaagcacataacgtaagacggcatcttagctcttttgactctttagtttgtcagaaaacggatgtctcatttacaacctacatgatactactagtaaggtgcccatgtgtctgcaagaggtcatcaacctcatgttcggccgtatctttatgcttctcaggcatcacattcgactgcattcatgaagaatgcgcatctccggtcaaaaaaaaaaaaaaggaatgtgcatgaatgcagcagattttttccttcctttgagtatgtctaaatacgaccgaagacatccatatatctatctacatcgatatccattggagctgacatggcatgattgtgtggcaggatgggaactgggtggtaggcgcgttggcctgactgtatgcaagcagcaagctcttataccgtcctcacttggcttggccgggccctaaaaatgaatttgtatttcttgtttaaaatttactcctgaaatagtttacatcatctgtattgtatagagggattgaactaaataaaaggcgctggctgctcaaacgtttcaaattcataaagaaggtaagcaagttaccaaaccaaattacacgtttcaaatttataatgtggatggctgaaattttgtttatgacaaccacaaatgatttaactattacaaagctcaaaagttatttaaaaaaagcaaagagatgctgataaagaaagttctttagaaatcgtaccatttggtaaattgggatatgtaacatggcctaacatagtgataggttcattggaaatcttgaagaaaaagggccaccaagccccaaatatcacaatgctgcggaactaagcttcacggttctgtttttccaagttgcaatcatgtgttctatatatttctacctagattgaatttagagatttgagcagctcaacaaaatggagacacatcgcaatttactgtatataaactttatagtcatacaggtacaaacttataaatgcatcgacatcatgagtgaattactaaccacaaacattttttctttagtatactgtacacggtaacacgggtacggtacattacaaaacagacagcttgaattcgatatctcacatgccattaagtacggagtactacccaggatctttcttatttcagggacagtgatataagatgttcttccatgggtgtccgttttaatttcaataggacattgcttattaactgggacctgcgttctggtatgatacaaacaccttcagttcttatgctgcattctaccgctctctgcaccagcataaggatcaatgataacatttatcaccgctggcttcctggcacgaaacgactctgaaagggcggattttagctcatctggtgtctcaacaagataaccttttcctccaaaagcttccatcattttatggtaaccagcagctggaacgaaagaggttggggcaggatcatctttgtacggtccggttatctcatcagggcttctccgatcaccgccataaactccattattgttgaagacaattacaacaacaggcagctggtaccttaccaatgtctgcaaagtgaacaacaaagtataaacgttaaggtacctttagtacaatattgtgaaaatagaacatagtaccgccgataatatatgacaccattgttttctttaattcgtttgactgtcttttcaagaaatatgcaaatagacaaacatacacggcacgtttaaagtactattgatgacaggtctagtggtactcttttcacttaactaagtaactgaataactagtgtaactattgatgacaggtctagtggtactcttttcacttaactaagtaactgaataactagtgtactattgttggtcgaagtttaaggaaaatgtcaatggtgccatatatttaaaaccagagggaatagctatgtactactctctttttattaaaagtgcaactagttagcaggcacagaagcagtgaggttttctcccatctttcggaggagtatacctccctaccacttaagaggcaaaaaaattaaaatggctgatctaatcataacaagaggaacaattgacaatatttggcacataaatattaatcacactatatcacataatttaatttgcacagttccattgttgcttgacccacacatcggccaattgatatccaactatcaagtagtagtagcaaaccacaaattctcaaacagttattaatactcgaagcgaattattgagcatgagtcctacaccctacaatttaggagtgctccactaataattcattgaatgggttaaacacaactatatactaaatcatgtcatcttataaatttattattaaacaagctatacaactcccacatcagatatagcattgagaagaacataaagcttggaatggccttaccttacagctggattttaattaataaattgaagcatatcattttgttataatgacaaaaaatgagcattattagtttcaagaaaattatgtgcattaatgtaagaaacaacaaggttaacataaatacagaattgcatggttgccaattggcaatatttccagataggcctctcgtaaaatgctgtaattttaggttccctgtaaaatgtataatttaggactaagggtatcctgaatttctgattctttttacttcgatattacgaaggtacaactacgatcaacatataaaaaatacgagtaaatttcactttgggccacattttttaccgatgtttcactttggatcaccctttaaccaatgttttcactttggaccaggtaaccttgccattgtttcaccttggaccatcctcaactcttttatccatgtacatctaatttgtcatatgtcaaagaaacggtctacaatagtgatcaatttgagttgacatatgacaaattagggaccaatggtacaatagtgatcaatttgagttgataaaggatcttctacctttttatttaaatatatacaaacaaccagtgcgttggctgtgtgccttatggcagaagccggtgatgtaaaaacattttcattatctaaaagaaataatacaaccagcacagctataaatgatacatgattcttgggaacgctatttaaatgccatgtcatctttatctatttgttagaggattttatttgcatgatatcccaatttcataacttaaggggatttgttagctcattgtagttggcagtctcatagttatactaatattatgacaggtagttattactatatagaattgtctgaatagttttgatatcatgacatgcttaatcaactactttttgcatgagcaaaaatgaatatcacttgcaccgcacaacagcatggcaggagcaaaagtaaagaatatgagccaacaaaggtgctaataatagcattgtgcaaattaaatcaaataaattgtgaattgtggtagatgttttatttgtcaaagtggaacaggaatgccattattcatacctcaacctccattgcactgaatccaaatccagaatcaccctccacagcaaccacaagtcgatcaggctcagcaactgcagctgcaacacagaatcccaatccaactcccattgtcccccatgtacctgcatccagtctagtcctcggctcgttctgcacaagcactgccctgccgacatccatggtgtttgccccttctgagaccactacaggagcagggtttccctcagcaagtatagcatcccggataatccgcaaaggtgtcaggaaattgaatggcacaacatccttggcaagctgagcctccatcttaagaacattgtccctggccttcttggtgattgcttcaacccatgggtgtgatggtgccaagcagaatggctggtccttgatctccctattgataagctccacaactctcttggcatccccaacaattccaacatgcggcttccggagctcaatctcctcctcgcagacatccacaagtatgaatttcacatctttggaccatttgggtggctcaccgaagtgaagcaaccaattaagccgagcaccaacgactaatgccacatcacattgcccaatggcgagagagcgcgccgcggtggccgacagtgggtgcgtgtcgggcacaacaccctttcccatcggcgtcgggaggaaggggatgcccgtggtatccaccagcttccagatggcgtcctcagcgcgagaatacgccgcgcccttcccaaacacaaccagaggccgctccgcgcggcggagcagctccgccgccttctcgattccctcgtccagggacttgtgcttgggtggagaagaatcggatttggccgaatcggcggcggcagcgtcgatgagggcggcggcctccgattccgtgagggtttggtggaggacgtcggatgggatgtcgaggtagcagccgccggggcggccggagacggtggcggcgagggcctggaagacgaggcgagggatgtcggcgatggtggttgccttgacggcgatcttgatgaaaggcttggtggcggcgatctggtcgagctcctggaagtcgcccctgccggcgtctggctgggagcaggagccggagaccatgaggagcggccaggcgttggcggtggcgtgggagaggcccgcgaggccgtggacgcagccggggccggagacggtgaggagcaggccgggggagccggtgaggaagccgtaggcggcggcggcgtagcccgcggactgctcgttgcggaaggcgaggaagcggacaccggcggccgcggcgcgggacgcgagggaggtgaccgggatgcccaccaccccgaacatgtgccgcgccccggccgcggccagcgcgcgcccggcgagggcgctgccgtcgaccttcatggcagctggagcggcggtgtcggtcgccattccctctccctaggctggctgcctggctggggttgcgtgccgtcgcctgagcagctcaggcttatagcgggggcggtcgggggagagccggagagtcgccgcgacggcgactgcgacggcgacgcggcgacgccgcagttgaagctggaggcaggcagatgaacctgctgctaggaagttggaagacgcggtgtatctggacgagacaactccaaagaaatactcctatcctactcgatcatagtacacgtcactcgggcacttgcagacttgtttgaccagagttgtcaaactgccgacacatcgtatctgtttttcggaggcgcatgaagcgtccgattttagcaggcagttgatcgaaattgtttcaccgggtacattgtaaatgtcaaccaaatcagcttatggaacattttgctatagcgtatgaaacaaacagttttcaaaaaaatcagacgatgtttcaccctatataaaaacattgttttagcaaatagcgaaagaatgtttcaattcgctgcaacatatgatccgtatataatgaaacattacgagtacacttgctgaaacattgttggtggaaaaaaaaacgaaacggattcccttaataaagcgtttccgtaactgtgcatgaattggggtgtgtggtgacgggtgaggacggcgcggaggcgcaggagcgcgggaggacggggcgtctgatgcatgtgtgcccgcatcaggcgcccgatttaaagaattttcgctgtttttctggcaaaaatttcatgttatgggactgtttagatcccaccctaaaattttacaccttgtcacatcgaatatttgaacacatgcattaagtattaaatataggctaaaaataagtaattgcacatattgcgactactttgcaagacgaatcttttaagcctaattgctccatgatttgacaatgtggttttacagtaaacatgtgctaatgaggcttaataaatttgtctcgcggtttactgacggatactgtaattagttttttattagtgcccgaacacctcgtgcgataccctatataatatctaatgtgacacgccaaaactttacacccctagatttaaacacccagtgtcactgaaaaatgtgccatttgagatgccacctatttttaatttttcatactgatcattagaaatgtttatatctttactacttaaaaaatttgtagtggtggtggtgagtcctaaacgatcaaatggttaacattcatcggaggatcctctcacaggcatcagcggatgagattttctcccacgatccacccatcgcaccacttctcatctccctgatccgcatcacgctccctctctctccgatccgtaatttcgcatcgcactccccagccccccatccttcctcctcagcgcgccgcctcctcaccccaccgacgcgccgccttcccatcccgcccaacccgcgccttcttctccggttgtcctccctccgtattgtgccgtccctcgctccgccccctccctctccatcgcgccaccgccccctccataaaccataacctccctcaaatcccgatcatctgcgtagccatcgttatcgtcggaccgagctcttcgatcatcactctctgttgccgccgctgcatcggacccatcggaatggtggataggaatgtggacctcagtatggttgaggggtaggacgagatgatggcggtggttgcaggcgcgtccaccagcacgctcgctggagtgtggagaggcgcgcgcccgctgctgcgagtcaccggcggtgtcgtcggcatcatcgtcagctagctctgcatattaaaaacataatatgagttgtcaagtaaagttagtgcaatgtaataagatgtttttaatttacctatgagattcactattagtatttcctcttgcatcaatttagtggaagatatcaaaaaacaacagaagatattcaaaaaggaactatttggatggaaatatgcatatattgatggattatcaacacccggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcgtgttaattatgacatgggttgtgctgtttcttgttggagaaaatcgttaagtatctcctggcattcatgccgctgccatcaacattctttcttgatggctgtgagcatgtcatattttatctggtgttatcccagctgatgagcatcccattcgattttttttctttgtttacattggttaagcttgatgcatttttcagatttgcttccatggatcggtttggtcaggtagtcttgttgcaatgcagagttttagaaatgaacggttcatatacttcatatcatagttgtacatagtggtttgttctaatcattcccatctgattcttgggagtagccaaattagtacatggtcagatattaggaaggaagagcagtataatatctatgtgcagtttagttctaattgaccggctattctcacacgttggcttttttattgactaagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactctgtcaaataatcaggtaagtactaaaatcctattaatcactataaaattacaatctcatttgatgttgccttttccctggtgatcataggagtgacccttttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagttgcctcgtatgctaccactgacatttcttattattcattcctatttcttagagaattgtatttatctatgcaaaatcgtaactggatgtactgaggattctataagtttttaaagattaccgtgaacgcatagtgtactgtccagagaattactcagattcatttatatctttaatggattggattccatgtaaattcagttgtaatcctttaagatgattttcagttttgtatatatatatatatatatatatatatatatatatatatatatatatatatatatatatatatatatatatatatatatatatatatatcgtctgttcaaggcatataacttaaaatttagcatgtaccagaagattattatcagtagaccccaaaaaggtcacactccaattttgatttatcaagtgcatgacccttgataaatttactcatgtgtgtgatgtccgtgactgcttcccgaagcccaaccaattttgttttgaggaaaacatcaactaactatgtatcacttaagagggtaatattcagaacttgtgatcttagaaaatgaaaccgtattcttctatgccaatgcctaatggttagagaaaattcttttcaagtatacttgatagtctgatacattaaccatattcctttgtttagagaggaacattagccacattctatcctcctcatttgccagtcataacaggcgagatgctttaatgcatacattttttgccgttgcaacgcatgggcacccaactagtattgagaaaatccaaaaaatatcattgacaaacactgaaatccaaaaaatgcatcgacgaatgcaagttccatgaaataccattcgtacaagcgattttgtcccagaaataccatcaccgttagggttccatccattccacgcacgttaaaaacactgttcatcctatagaacttaacggagggttgctaacgaaaccctaacagtaatggcattttatgaaacttacattcgtcgcatttcttggattttctcttatatattttgaggatggaaccaggtgcgccgatcatatgattattctaaacattattttctttgtcatttatcttattgctatacttgtttgctttcttgtgatagatgaggtgtagacccaaattacaatagagccctgggataatggaagtagtatggaattgctagatttatgtcatcataatttttggctaattacagtcagatcggtcaccgttcaaacggtgctgagatttggtgctgtcgcacgcccgcgagaccgtttccaatgctgcatgttcgatcgatctctgatcaaatcgtgtggctgagacctgctaagggtgtgacatagctgctgctctgtctttcttcgagtattcttttctttgatcaatgcgcagagtagtgataaatcataatgttagggctatagtgtggttacatcacgtttaaactagaatcacatgttagctacacgtgacttacagtataattataagtttagttatatgtgtatgtcaccggttccaaagtgtaatattttacaataatatctaattcaaacttcaaagtgaaaagaatacgtagcctaatttacttttaatgataaactaactcctagcaatatatctgatataggtactttaggagcggagggagtacacaataaatactgctagaattacctagaaaattacatggcataggccaaagtctgtaagactgcaaagagtcagtgatgtggtaattagtaagccacgttacccaggtctttgttattcgattagttttgctatccaagtatatgcatcgtatctcctaaactcgttatcaatcggcatcaactagtaaatcccgcaccggttacctatatagagtactagagaattgttgctccgtgatttttgatgtttagtggctcccccatccgaatggagatcctctatcttcaaacatcgtgttttattattgacatatggaactaaagtttttgttagatcctcggtgacaaggtcacgtaaggatcctgatcctatctccctatcctaacgaccagccaggagaggacgagtcaaatgcagagaacatctttgtctgaacaagggcgacgctggctagatagacctcttcccgcgcgcgcgcttgcacgtctcgtcagtcatgttagcatcaagccagcgatgatgaatgatggcccagtgcatgtattttcaattaaggaaaaggaaaaaaaatagtactccctccgtttaaaaatgtttgacaccgttgactttttagcacatgtttgaccattcgtcttattttaaaaaaattgtgaaatatgtaaaactatatgtgtacatgaaagtatatttaacaatgaatcaaatgatatgaaaagaataaataattacttaaattttttgaataagacgaatgattaaacacgtactaaaaagtcaacggtgtaacatttcgaaacggagggagtatgagtaacagaaaatgatgaatggtctagttgaatcgctaggtcgttttcttctttttccctctttcgtcaggcggagcttaagagatgatggagtttgcagggagcaaggaccgggctagttgggattgctaatg

SEQ ID NO: 63766 - DNA, 3222 bp, Oryza sativa
gatcccgggggggcctgtcatgacctgacagcattcgaaccgggattacggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtggttggtgggtggtgccgtggtctagcccaccggttcagctcgggtcattaatagttaaacccaacgcggtgatatagtcccttctcgtggtttctttgagccccttgcaatttctactactacttacttttcctgtggagtaagccaaatcgcatcatcgcgcttggttcgacgaaacttcgacgaggcgcgttgtcacctttttcctgttccacgatgaaacggcagggatcatttgcgcgccacaatcgccaattatataagccgaggccacaccgccacagaagcaacggtaagcaagcccatccacaacggcaaccattgaagggagctacagtgtaagtagctagatacgcttaattaggcgactaggcgagtacgtagtggctgcaccgcgcagtcatggcgttttctgtggagaagtgggtagggttcgggtcagctatggctggcgtcggcttgctttggtcccgaatgccggagcacgtccatgaggaggctaggtacatcatcagtagcttggttcccatggcgatgtcctacttcaacccctacgagcagatcactgtgtccgagtacattgcaacggaacatgctgttcgacgccatctctgcctacctgagaagcgtgtgcttggatggtgcaagcaagctcagggcccagctccgcaacaacagcaatgacgacccacttattagtctggaggagaaccaggaggtcgccgacagcttcgagggcgcccgcatgtggtggaggctgttccccaagacctccaagaagagggggggcaccatcatcagcttcttgcctggggactcggacgagccgcggagcttgaggctggtgtttcacaagcgccaccggcagctcgtgctgaactcctaccttccaggcgtcgtccggcagtggcgtgagctaatcgctaagaaccgacagaggctattgttcaccaaccacgtcaaagacgggaagagcatgtggagcaatgtcccgtacaatcccccgtcgacattcgacttgctcgccatggaacctgccaagaaggttgagatcatggacgatctcagagcattccagaaggggaaggagtaccactccaaggtcggcaaggcgtggaagcggggataccttctacacgggccaccgggcacgggcaagaccaccatgatcggggctatggccaacttcctcgactacgacgtctacgacctcgacttaatatccgtcctaaacaatgccgacttgcggaagctcttccttgatacgaccgacaaatccatcatcgttatcgaggacatcgatgcgattgaggtcgagctcacaaccaaccgcaagggcaagaaggcagccaacggcgacgacaaacatgtggtgatagggctgtccgacaagaatcacgacaaaagtaaagtgacactgtcagggctgctcaacttcatcgacgggctgtggtcggcgtgcggcagtgaacgaatcttcgtgtttacaacgaaccacgttgaccacctcgacccggcgctgacccggcgtggaaggatggatatggacatcgagatgtcctactgccggttcgaggccttcaagatgctcgccaagaactacctaaacatcaccgagcactcactattcagtgaaattgagggactgctgagcgagaccaacaccactccggcagacgtggccgataaactcatgccgaggaacggtgaaatcggtccactgctcgacgagatcgacgaggaaccagtcgatcgtgatagcatcatgctgcgctacaaccggaagagacatgctgatgaacgcttggaaagtttagtggaaacactgatcatgaagagggccaagatgaattccgcaacatctcctatggaagaggccaaagaggaacaacctaacgcagaagaaagctagacaagggccccggtcggatatatatgtcatggtgactgggcttttgtgtgtggtggaaaatggtcagctaggctcctttttgtgtgttgctattttacctgattttcgtgtttgtttagtcacttacgcttgcataagtcataccctaaaatgacacaatatacaaatgtttagcacagaaaaataacaacgatatgtgtggggtgccagtataactaagtacataaaataaacaaaaaacatagggaacatgtgcttcattaatctcaaggttcataaatacaaattcccaaggtaatatgtatgtatgtatgtatgtatgtgcactctatagcttgtcgttggatagatctgaacttgaagaagtggtcctctggtttctgaggtctcgaaagtctcccagttaattacctccgcaggcctaggtcaacagaacacctccgattaagctgcttgtggttgtctcttcatattcgcttcacgttttgcatgcatgatgaatattggtgaagatggtggatatgtacgtgggcgctgacaatgcatctacggccagggtttgcagtttcgaaagtgtgtattttgccaggggaggcgaaataactgcaatcgacaaaatttcagaaatttcaaaaattttcatccgaaattttttgaattaaatttgaaaattttgtccgaaaaatccgaaatatagccgaaaattccgaaaattcggggacaaatcattttgcaatcaacagaaggataattgaacattcgatcaatcaataattgccaaatactcattaattgtccaatgactaaagtatttacctcctggtggggctatgtttctccctcgcccaataccagtctcaggattgccgccctccgttccacttccaacagctgctgctgctgatccccttccccttccatcttccgctcgtcttccaacaactgctgctgctccccttcccattcccctgctgaaatcagctccaattattgagttgcatgcactgaccagttcaacccaaaagcttaagctgatgaggaaaatgcgggcaattcactttatattccaacactccccctcacgcgaggcccccttaagcctctagcgtgga

SEQ ID NO: 63767 - DNA, 681 bp, Oryza sativa
aaaactaaggggagaattggagacggcacaaagctcactgcttgccagtatcctcgcgctcggagacaacaacagatgatgatgatgtcaacatgaggtcttattggcttgtttggctgtgtcaatagcaagggctcatcgtttgttttgtttctatgttatttttgtaaagctggaaaccccagcattttgcatctgtgaaggatggctacaacaaagactatggggagtaaatggagacagcacaatttgatcagctaggcttaggcaaaaatagaagatttggcgtcctgatcttaaagctgcttcctctatggacttgttttctttgctttatctctggcttgtttggctgtgccagcagcattagtcctccttttattttgaactgtgttgcttcttgtaaagctggaaaccctagcattctgtactctctgttatgctttatgaaaagctgggcgtctgccttttctctaaaaagaaaaggagcatatgctaccaagctggtgaggcggcaaaccgaattgtcttgtgcaccatgaataatcgacaaaaaaatattgatcaataacctgagctcctcattgcctaagacccaataacgtacatagttagctccatcactgctacggctaatgagaactgatcgagccaacttttttttatgagtaaagtgtattt

SEQ ID NO: 63768 - DNA, 1931 bp, Oryza sativa
acattcgatcaatcaataattgccaaatactcattaattgtccaatgactaaagtatttacctcctggtggggctatgtttctccctcgcccaataccagtctcaggattgccgccctccgttccacttccaacagctgctgctgctgatccccttccccttccatcttccgctcgtcttccaacaactgctgctgctccccttcccattcccctgctgaaatcagctccaattattgagttgcatgcactgaccagttcaacccaaaagcttaagctgatgaggaaaatgcgggcaattcactttatattccaacactccccctcacgcgaggccccctcaagcctctagcgtggaatagaagtgggttgcatgcactgactagtttaacccaaaagcttaagctgatgaggaaaggtaggcaattcactttatattccaacactaatagctgcggcggcggctgatggaccagggcaaccatgacccctgcatctcctactgccagcatatgcaggaccttcttctcccatgcccacagtgcacactacttcaagaacaggacaagagcagagtaactaatcagacagtggcgaagtcgaaaattgagagttgagacaccgaatcagtaagaatggggatggagaggcaagaaattccaagatacataccgctgccttctcgtcgtcgacaaccctctcgccaagttaccggatccaggagcaactgaatgccaccctctacaggaggagcaccgccgccaggagcccgaggggcagggatggctaatgcgctgatgacgtggactctacgagggagcagctgagccaccgcggccacctgtaggacgagcgccaccgtgattgaggtgtggaggtggcagcgtcacgtaagaggatttggcgccggaggttaaggttttcgtctctcagcggcgctgtcggggaaaaaatgggttagggttagggttgtgggggtagtgagggccttattagcaaatttttttaaaaattttttgtccaaatttttgaccggcattgacttttgccggaccccactagcaaaaccgaaatttttcatccgaaattgcaatccatgtctacggcctcatcactccatgcgtcggttattgttattcatactatcaacatgtgttgcatgggttactgttattcatactattaacatgggttactgttattcatactatcaacacgtactcagaccttaatatatacatagtcaatataataattttatcagtaacgtaatattcatggaagatgatgacatcgtagttgaaaattatagtaagagcaaaacctgagatatgttatctacattaagtttttttaaaaaaaataaaattaccgaggaattggcttctaagattgctggccattgcatacttgtggttctcttctaagaagaagagtactagcaattctaatacacaggagatccttatattattgcgtcgcctcactgcttctgcttcgacacgttcagctggttcagttgctttgccctctacacaaactggttctattgttcctggttctcagacttccaatgagggatcctcatctgcttctggtacttttccgtggattcttgattcttgtgtttctttccatatgacccctgataagtcttgtctttcatctatatatcatcctttagtccttattactgttcaaattgccgatggtacccctctttctgttgttggtcgtggaactctttcattttcttcttttagtggtcgttctgtttcctatgttccaaatttgaccatacagctcatgtctgctggacagcttgctgatcatggttgtcgtgttatttttgattctgactcttgttgtgttcaggatcgacacacgggtctcctagttggtactggccctcgccaccatgattctcagcgt

SEQ ID NO: 63769 - DNA, 1159 bp, Oryza sativa
taaagagctaatgttgttgtgagaatagtcccctatgtaacaccccttaacacttgcacaaaactaaaccttcttctttgttaatgaaaggagactgtccttctaccctcttattcaaaagaaaaaaaaaacagactttttcaaaagtaacagttcttggtacaaagagcggacttttcttccctaaaaacttttaggccccgtttagttcacgagacgaaaagtttcaaagagtcagatcggatatacaaacacacattcaaagtattaaacgtagactaataacagaacaatttacagattccgtctgtaaactgcgagatgaatttattaagcctaattaatccgtcattagcaaatctttactgtagcaccacattatcaaatcatggagcaattaggcttaaaatatttgtctcgtaatttacacacaatctgtgtaattagttttttttctatacttaatactctatacatatgtcaaacattagatgtgacagggtgaaattttttttatttacgaactaaacaggtctttacatagtttgaacacgggtagggctgtatttagttcacaccgagattggaatttttgttgaaattggaacgatgtgatgaaaaagttggaagtttatgtgtgtatgaaagttttgatataatataaaagttggaagtttaaaaaaatattttgaaactaaccacggcgtaggtcgaggtcgatatggatcgtatcaatcgatcatggcggcaggcacgagctaaggtacggtggcccatgcaaggcaaccactggcaacaggcaagcaaagcacggccgccgctagctccagctccatccaactccaagcagcctaggggcaacattttctccaacgcgacacacaacacacaagtggcgagctcgatcgtcggctgtccatgccggtcaaaggacatgcacaagctgccattggtggatgcatggcccgggaccgacaggcgacagctacatgcgtgcaagtaccatggccatttgcagattaattcaatgcccaaaccctctctcgctaccatcgtttcacactatttccaatgatcatttatccagttaattgtccttgatcgcaacaaaatatagttcctccctccaggttgtaatacccgttgtttcggataaaga

SEQ ID NO: 63770 - DNA, 3421 bp, Oryza sativa
cctaataggtgcatctattcgatgcaccatattctttatcttttcgccctttacagtcttcgtcttcgctactcggtaggccttggcatgaaaagtttgaagcactcggattattatctttgggaaggctacgatggttgactgcaaaggtctcgggggctactgtggagattatggatatcccatatctacaaggcgacaatatttgggctgaatataggataccgaatatagatagaatatcttacttgtatctcgggtttgtttcttaacttgtacatcaaggaaacaccttgagacttagtcggtcacgactgtatttgatctgtatctatgtattccgttagggatatagattatcttttgtaacccggactccttcccatatataaggagggtctgggcgcctctaggggcggatgttgattttctctaaatcatacaatcaataatacactcggcggattcatccccggacaggagtagggtattacttcttttataagaaggcctgaacctgtataaatcctttgtctccaaacccatacacttttccagcttgatagccaccccctatcttgactgtcaacatcaagtttgactgtcaacactaactttttctttaaacaaacatctaattttgactgccaaacccatacacttttattattgccgaaatctagtttcgacaccggccatccatccatcatccagatccatggcgcctgcgcctgcgcacaccagcagacaacagtcactcaccagatcgacgagacggctgtcccccggtgaggttggcaacgccggtgcgtgtctcccgcccatgtggcagcctgcctcgctgcctctcctctcctcgcagctcagctcgatcgcgcgccggtggcggtggcgggggccgcgcttcacatggccgccgatgccgatgccgatgccgatgccgatggatcgtggacggatgcggcgcggcgctgtgtgtcgcctgaaaagcggagcctttttttagaggaaaggattggtggaaagtttcagtgatgagatgatagctagctacagtgtgagtgtgtggtggcgacacgacggacgacggtcgtccagacactcgagtgtggccgactggccggtgagggtgacgagtactctctctgccttgttggcagaatggcagtcctcttcttttgccagtctctcctctctcatctcacatcgccgagttcaggcttcagaggttcgctgcggccaaagtggccgtggccggatgggcaattcgggtggatgacgaccccgcagttatcttatgcattagcccttgtttagttactaactttttctttaaactttcaactttttttatcatattaaaacttttctacacacatatcgttttaatttcaaacaaacatctaattttggcgtgaactaaacacacccttagtttggttgaatgttgggatggatcaggctgaatctattttttatcgaaattgctatacgtccgacctataagtccgacccatccatccgactagtgtatgtataagcatatatgctatttgtttgggcccacatggtagtaaacaagttcagtgattggttgtatgactcggtcggacacaaatcgtatggctcagtcgtacgtatagcaagatttatttttaatagcgtttgattcgagaataactggaataggatgatcctgagaggaaatatttcccttcagatggtctggtccctaaaaaattgacggacgaatccaagaaatggaaatgagtctaacccatcccacctcatccccaaaccaaatatagaggacatgtttaatgagttactacttctattctaaaatataacaggttttagagtggtagtaggtgaaattaaatgagaaatgactgtgattggttgaaaaagcaagatatgtggagaatttgatggtcgaagattatgattggttgagaactcaataaaagtgaagaaatcgttatattttgaaacgaattttaaatgctgctaattttgtcccggaatattattttttggacacgattattaagaaaatatatagaattaaatggaatgagattgtgattggttgagaaatggaggtagttgaaaaaattgaatggtagaggggttatggttggttggaaagagaatctatgtttttggaaaaaaattaaagcccataagttattatattttaggacggaggagtagaagttgtagtatattttaggctctcatcggatggcctaatcagccaaagaaaaagccaaattttaaattttcaaacttaatttggagattgattttgagatattttcagcgtagtttcttttttatattggcttttaagtcaccaagaacacatatataaaagttttacctacaaatttatttttattccctaataagccgttttggcttgttagggaaaaagccaaccgatgaagaccttagaatggagggagtacctatcttcacttcttatatctcatttatattactttcataattttaaatttatcttatattaacataataataaacacaaagtaataaagaactcactaaatgtaagtagtttagatgtaattaaaatgctaagtaagcacaaagtatataaagatacgttggtatcttatactaacaaggtagctcgcgatctaactcgttaagcttactagttaaaacttaaaagcctaatttggctcgaacttactatatcgctacgactttacctttaaaccaatccgagctgattcgagtcatgagctttgagctctccttttcccactccttctatctcgaaagacctcatcttttccaatcttgtgttgttttgagtgaagtggcagccattattatcttcatcctaaattataaaaacctatataacaaaatgagatgtatatttgtactatgaatcggcttagattcacagtaatagaatatgttgctttcattcctttatttttatattttaggactgcgtacgcatggatctctaatctatgtgagctgtagtatgtaaaggtgtcacatgccactatgtagtctcatctcatgctacttgtggcatcgtctcatcctacttgcctaacgagataattctgttttggcctttccggtgcgaagatacaacaatgacagtcgtacatgagcactgcaaaatttagcttatgaaaaattttaaactgtttttacaaaagtaactttagataactaaattttacactaaaattttaatgccacaagataattccgtcccaaaatataaaaacttagaaccggatgtcccatccaggatgtcccatccagttctaaattattatattttaggacggatggagcagtaaatattaacttttatattttgggatggatgctaatattttagcttatatgtttcggcacatct

SEQ ID NO: 63771 - DNA, 1091 bp, Oryza sativa
ccgctacagcagcagcactgcacaaccactgtgggcctgtttagttaaaaaaaacttttcccaaaaacatcgcatcaaatctttagacacatatatggagcattaaatatagataaaaggaaaaactaattgtatagtttgcatataaatcgcgagacaaatcttttgagcctaattaggccatgattagccacaagtgctacaataacccacatgtgctaatgacggattaattaggctcaaaaaattcgtttcgcggttttcaggcgagttatgaaattagtttttcattcgtgtccgaaaacctcttccaacatcctaccaaacgtctgatatgatacccaaaactttttatttcaccaactaaacagccacagtaattgagctgccgaacacaccctaagctgtaacactgcacgtcacaatccatctcgatggtaagagtcggtggttccgtacgcaatacagccagtcaacaactttgactaggcacaacgccctgtcactgacaccgtgggccccacaaactgtcctaacatgcgggagcgacgtcctcctcttggacctcttccatgagaccatctgacggcccaggaacaactccaaagaggtcggccgggccgggccccacttggcatgttcccccacttcaggccacggtggggcccatcgtacggacgataagggggcacgcgtcacatcctggatcgtcgcacaggtgcagcgcccgcgcctcacatggcggccacacggtgtccactgctgccacacatgggattgtttcgtaggcatgcaagccggacgggcatgtaggttttttttagcccgcttatctcatttttaatttattttttcttttaaattttatattattgtgtgagaaataaactagcaagcgagtttttatacaggtagtgagactacccacttgcatctctattgtttcatgaaatggatttcaaaaacaccaaccacactgaaattcttatgggtgaatagctaatttagtccctccagtttcagctaaggctcaatttggttcttcacgtttcattttgtccacataggtccttcaaatatttgttttgact

SEQ ID NO: 63772 - DNA, 1644 bp, Oryza sativa
gactggtagtccgcacggccatgcgtgctgcgactcgctatgcaagccgggaccgtcagatgcaacagacggtggatttggaccatagtagaaaaaaccggaccggtcattgatccggtggagtgtttggttcaccggtctatcggttcaaccggtgggtcactggttgaaccacggtttattggctaagtatattctgtgttgtcttctagtcaaaacagctaacttagcctagtggttggcaaggtttgcatctatcctaacagcctggggtagaatcccacctttgcaccatattttttctcgcataaaaatcaagttgggcctccagtcttacaaggctcataagaaatatacaagccagccggtttagggtcacccggttcagcggtttcgcgcgaaaaccacccggttcagccggttcacaccgggtcgattgcgtgaacgatcctttgagggaaccgagccggtcagggagctggttccggttttttcctgttgaaccgccggtccggtccggttttttctactatgatttggaccccgactgcacgtccgtgactttgcaagcaaagtcagaggatccggttcccctaaactcatacctgccgggccctccaccttccagcgttgtagtcactatgtactagagagcggaataaacctctataaattttaaaacaaatgtatatgtttctataattgtttaaagaaatataaaaaactcagaggtagcatctcgtacttagaccgatatacaatctgagcgaaaaagctattgcgtgaacgttcccggaacaagttcacgcgaatgccgcttttccggatcacatatgtgtactaaccctagccaggtcgtggtaatttcaaatcaccaactgattagattctggagatatacgacatgggccttgtgggccatagtttaagttgagatctttatcttatttttaattttttgtttcttttgtgaaattattttttcttctagtttgttatttattttgtgatcacaaaatatgtactcatttttcaaacatatcagcaaaaattatgtttgaattttttttctattatttagagaaagaattttatatcttatataaacttatcatgtggaaagtatattatttattaataaagttataggtagaaagattattattctactttggcccatttaagtacaatagaagttttattaaatattttttcgctggacttattttttttattgtttaaaattcactcatacttttttgaaaaaaaatctatgttgaaagtttgcatatgcaaagtttatatataacaagacataaaactactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctccacacgaccagtcgcgtactagactcaccccaatctgggccaggagcctcataactcggatatatatgatggggctggggatcctctagagt

SEQ ID NO: 63773 - DNA, 2516 bp, Oryza sativa
acacaattagcacatgtcattcgtcctattctaaattgtgctgacagagtcttttgtgcctttggctgagagatagcagtatctgggataatttctgcgtcaaatccggcatcttctatagcttctattatatcctcaacctgtataaacaagtacccaaataaaaattgcaggtagctaattgacccatataatctaaaaatgtgtgtcaacaatgaatagtaggtggccattaaaacaaactaaatgaatgcctattatgaacaggaggtagcagatagaacttgctggtaaatgtctacttaatagtcaggaaagccatccttaatagttccaacaaaagcaaaaggatgaaacacaacattccccgtctgcactacaataggctcatcaaaaagttgctagcgctacaactcaactaatattcacattaacagtcattaaaaccagaaactgtagagtacttcacaacataataaccataagcattaataaatttcaattgtgaagtacactgttattactatgataagactaaattttatcactgctgaaagtttatacacttgcatggtaattactgggcctagaataatgagattatatgcttgtcccaaaattagcatgtaacatcattttgcattcaattttgctcaaaggaaacttcaatgagtacttagaagccacataaattgggatccttaacttagcaccctttccccccgaaaacatgactcggctgctccctgcctcaccagccaatcaaacctatcgtagtacagcagttaccccatttctgccggtagcaacaaccaatcgcagcaaactgcagcctttttgagctcccaaatcccacaatccagagagtccagccacaatcacgagcttgcaacaaggttacagctcatcaaccgccaaagcaaaaggagcacaaaaactctggcctctgggcactgtgggctaaccacatttcacgaatcaactcatgaaaagtcgtcatcgcaaggtgaagtcaaaaagaaaaaaaaaatcatctccagctaaaacccaaaattgcaatatcatacacgattgactcggtctcacactcacacacatagtaattagtaaactcaacttattattagacaagagtaaattccgattcaccaacttctaaccgctcgagaaaaaccacgagcaagcagcgcgatccagcttcctagaatcctgttctaccgcaccaaccatcacctacgcaataattccagcgcaagaaaaaacttcaaaaaatttaccaccgcgtgagcgtcaacgagctcacgaatcccagtttgctcccggagacgcgcaaaactcggctcgacaaacgggctcagccacgcaaaaggatcacatcacaattgcaatcgcaatcgcgcggaaatcaccttgaggagcgccgggtcgaaacgacgtgggcgcggttctggagcagggacacggcgacgcgccgcacgccgcggcgggccgagacggcgccctcgacggcgctcgtgcacgccgagcacgtcattccggtgacccgcacgtgcgcctcctcctcctcccccgccgccgccgcggcggcgccgccccccatctcctcgtcgtacgagtccagcagccggacgtcctccatctcgtcccctcccccacccgccgccgccggccggccgccgccggcgaccgccgagagctgcaggtgggccatgcctgtcagagagagagagagtagccgcgcgaggtgggaatatttggtggaagagagagaggagacgaaacgatggagaatggggcgaggcggattatataaacggagagggaaaaaaaagttaaagcgcagggggcaaagtggaattattttgcattttttaggaggttatttgtaaattatggattagtcaaatgctcgaaattgttatctgtgcgtttagctgggagaggcaaatttcgccatatgaactttcccgtttttgacttcttctcagatggttcgaagaaaatctctctgaccgggttttcgaattctgaactttttggtagtactagtattactacctccgtcccaaattaagtacagccataagtttccgtgcccaactttaatcgtccgtcttatttaaaatttttttataattagcatttttgttgttataagatgataaaacctgaatagtactttactcgtgactaatttttttaattttttttaaaattttttaaataagacgaatgattaaagttgagcgcgaaaaactatggttgcagttattttaggacagagagagtacatgatatcaccgtgttggggaagccaatgttacggtctactatagcgtaactgctttcgtaattgtagtaagttaatgcttggttatatgtgagcttttgttgtgattattttgttctgacatttttggcttagaatatagtaggggctttgtttggttgaaattagcatgatttgggataagttgagctaaaccaacatgccctttacaaagtccaaaacaggg

SEQ ID NO: 63774 - DNA, 2187 bp, Oryza sativa
aaatgtaacccccatcataaatttcataaacccatcgcaaaatgcacccaaatcatatcgaaattcaaaatgcaatcgaagcaaaaaaaaaaaatcaaacaaattcagagcgaccgcgcgaggagagaaggagacgagcggtttcgccgcgggaatccgcgtgccggtggccaggttccggagcacgtgttccgcgcggctaatcacggagtagtatgttacgactttaatcgggtgattagcgccttactaatcctatcttactataaagttatcccccaccaactccttaaacttaacatgcatgcaaagatgccacatcatcatccactaatccattaattaacaagatgccacatcatcatctactaacaatcatcacatttaaacatcatacaaacatgctatatctttatagtttttataatttaagagcttttcaatataaacatgttaaattatcatccaatataattcacataatgtttcaatgtatatttttattatgttttatgatatatcctatatatttatatagttcatcctcacttaattagtgcttaaatgattaatctatggtccaaattatctttctccttttttcctctcattaaggcatatcacatcaattgtttttagcctttagatgattaatctacggtccaaactatctccctacttttcttattctataaagtcataccaccttacttttacgtttgaatcatcattctacatactatttaaatttaaattatcataaaccacattaatttatttaatctgatattattagctatcttacacgttatttttttattgttatcatactaaattcccgcagcaatgcgcgggatttcacctagtcacctaataatcaaagatccccgtgggggcccacctgctgatcgataacggtcgctgtgacggtgggcccggggtggcctgggtcgtgattgggtgaggccgtccgtcggaggggtaggtgtgtgtaggtaggcttggctctgagtgtggggcccatccgacgtggcgtggtgtgtaagccaagacgacacgcatgcacaaatccggttcgtcgaggttgacccatcgcgttagacacatacaagcgggggcggctaacaccccccatcctttctttctcctcatcttcttctcttcctactacaccataaatttttaaaaaataaaaaacataagcttgaaaaaaattatatatagaaatactatatataaaaaaattaaatttaaatttaaatttaaaacaggtatgtaaacttttgacttataaactttgggtctataaactaatatttgaatttaaattcaaattttaatcgggtatataaacttttgacataaactttgggtctataaactttagatgtacaaaatactatatataaaaaatatttgaattcaaattcaaatttgaattggatataattcaaattcaaatttgaattgggtatgtaaacttttgacttataaattttgggtctataaattttaggtgtataaactttagatgtatagaaatattatatataaaaaatatttgaattcaaattcaaatttgaatcagatgtataaactttaggtctctaaactttagatgtgtaaacttaaggtgtacaaactttaggtgcgtaaatttactaaaataagaaagtaatgtggtgccaaaaaatgaaaccatatggaggaaaggggagcgcccaggggcgatcgatcgccccttagcatttccgcatacaagctggtgtgtgttagagcaaggctaataatacaatcgatatgttgtttataagtttttttttagccttctctatagggtccacttgtctctcttatagaatttttttggttcttgtgtccaagccggttgtaagtttacagtccgcttcttttctctctctcatctcttctatcatttgcctcggcatttagctggtttatagcctactattattatacttgctcttagtactgtatgctttttttttcgtttctataattttcaatttcaactttcgatgcaatgaatgatgatgaatcttggtgatgatgatgatgatgaacgagctgaagttaggcaaagattcaggtactaggagtagtaataacaaaacaaagttcgcatttgattggttttaacttccgtgtttgagatcgacactgctt

SEQ ID NO: 63775 - DNA, 9905 bp, Oryza sativa
atgaatttagatgaatttaggatcaagtttcattcaaatcggagttaaaatgaataagttatgctagtgtaaggattcaaattcgaataattgcgaaacagtactgttcacatccgatttattttaatccgaaacctatctacagctcagagtcactgacgggtggggtcaggggtcttattatcttttctaccgaattatttttgttagagaaaaatggggagtgggcccggcttgtcagtggctcggctgctctctttctctctctcgttcttttcctatcgtcttctacctccagaccgtgcgggagcagcaggggcggcgcagcgcgcgcggcaaggccggcggagggcgacccgacggcgaccaggggagggagcggcaaggctccggcgtccacctgccggcggtcacggcgtaagacggcgcgggggcgagcagcgccgcacggccgccatggccgggcacgggtagctaggtgctagggcgatacggagggtttccgaccaaattggtgcgggcgtgagcatctatgacgtgtgagggttccattttacttattagatggctaggaagagctccgggatggcttgtccacggcaagctcgccggcggcataatggtggccgggccagcacggctacgggcgctagtcgccgaaattgaaggaggctcgagtttctacggaaccaggagagacctgaggagcgtggacttaccgatagacggcgggacgacgaagatcgggtgcagtggtggagcggagaagaaggtgcagcacgcccacaagatgctcgatgaaatgtatccgaggaagaagaaaaggaagagaggggaggacgagctcgtgggggctgggaggtgtggggagggaaggggaggcatgggtttatatagggggcggaggggagaggtggccggtgcagtgatggcggatgggacgcgcgcggcgtgcggggctcgaggcgagcggcgacgggacatgagcgcaggcgcagcgcggggctcggcgcgatgatggcgacggcgcagcagctgacggcagcggcgcggggctcgagacgagcggtgacgcgacggcgacacgcggcgacgcgacggtgacggcgacagcgcgacggcggcgcggggctcggcgcggcgagaacgacggcgacgcagcagcggcgcgatgggacggcacgcggcgcggcagtgcacggggcgcgagggcgcgtaggcggcagagggaggtgggacgggcgcgcggcggggcaggggcgcggggcgcgaggcgacgacgtgacggcgacgacgatggcgcgcggggctcaaggcggcgacggcgactgctcgacggcgacggcgatggcgcgcggcgcggggcgcgagctggcgcgcggcagcggcgcgggcgacgacgatggcgacacgagcggcatcaggcaggaggaggaggagggctaggacggctaggaaccaaatcgaacacctagggtgctaatgaacagtgctagccggctatttaaccctattttagcatatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttgtatatttttgaagactttggggtactattacatttaatatatcgacttgtcatgattaatacattagcagattggtcaagtttagttgtatagcaatatattttacacggataggttcaatctatttattctataaatagtaaattgagactcggtacaatatcaatctaattgtttaattaaaactcacatattcttatttatatataagcttaatgtatttatatgaccatcattttatatgagtgaattttatgcccagaaagatatgttaaatattaatgtaagtattccaatgaaatactcatctacaaataggattactatagtggtgatcatcatttcatgtggataggttgtccttttaaatcggttttacctctatatgaatcattatattttaatatttgacctataaattaaattagtaattaaccttctctttgtatggctttgttgtggtgcgtaattatttatagagttcataataaatatcttatttttataattgttactcagttgtatagctttagcttaattttcagtggtgacaatttatagttcggcaagcaataacaaccataacttccagcatgatgcaaaagttttaaaaagttcaaaattttagtgatttttattgtcttgaattttcaggatgttacacctagctccacaaatcccacgtgaaaaataaagatcagaaccttaaatgacctttacaagttctatgcaaaacttatgctgagcaaaaattatagtctaaaactaatttcaattgtgtgcaataataatgtgtagtccaagggtgctactcccgccccatgccgatcgatgtcattaggtatctaaaaaccaaattaaacacaagagtgagtaaagaatactcagcaagtacaatcttgaactagtaaaacatacgcatgatttatgcattaagaaaccaacatgaagggttggatttactttatttttaaacaaaagaagtcaaaagatagtagttccctcccgggcaggtgtgaatatcctcttagcattaccggtaagccgagcaagcgtgatcagcgcttctcaaggatcatgaataaagatccaaattgcactcccatggctacgcatggttcttgaataatgtaaacagaacatccggaataatgaaacatgaatttgaatatgggtcgaaacacgaataactagcataacgtcatagccatacaatcagtaataacaagcaattgaataataattatgcaagtaaagccaaacaaaacaactcagttttgtccatcatataagtccgtcttgtacttgccttaactcattcgatactccgactcaactcctccaacgttggaaccctccacacctgtggagcaaaactacgcataaaccactatattcaactaatgatggttacaagggatatttagtaaaatcgaaacctagaacatataaaccttttaccgatttgtattaaataacctatagctgttccattactgttttatgagtaactcacaaaccgtctaacggaaactagcaaataatacaacttcggacatctagacaaaattgtctacaactttcatgttgagcacaaaatcagattatgcctctgaaaatcccacattaaggaaaaacgaactgctgtcctgatttccggacccggtcagcagtactgtttttgctgtttctcctaaaccgttgatcggaatcgagtgaaactagcagcgttggaaagatattgacaatgactacaaactttatttaggacaactaacctgattcctgatggtttaataccagatttgaaaatacggtttcagcctagcgttcgatataaaataaattcgaaaaaaccggaaacagatcgtcttaaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatatcggcagcaacagcaagccgtacaccaccaccaaggaagagatcagatcgacaatagcagggttcggcagcagcagggaaattaacagaaacaacagtagctcaccaacgaccggctgcggacgacgacggctgtggcgaccggcgatggctgcaccagcggcggcgccggcgaagagaggaacagcagcggcggcggcagagcgcaggaggtgcggcggctagggctacaggagaatcgctcctgtttctttttttttcgtttgttttttttttggttggttatataaagagactagataagatctaacggctcacatctattcaatcctcgggacttcgttcggactccgattactataaatttatagtctattttgcactactcggcgagctctacgcatccacggttcccgatcgcctatacgaacaatggtttaaaagttgaacttttgcgcgtttgctctaatattccgcgagatatattaatttaaaactcggggtattacattcttccccccttcgatcgaattcgccctcgaattcgcccaatcatactctagaacacgggatatttcttgaaaggagtacaactaaataaatcatgtgataattcacggcggaagattgcttgtgataatattgttgtgcttaagaacgaaggagatgcacaccttggtaaaaaaaacgaaggagatgcacaatgtaaaaaatgatgatacagtacagaaggttccaatttggcctgccacacggacccaagttgaaaaggatgcccattgattcaaggtttcgtttgggtgccatgcaatggtatattcgatctggcctcaaaactaaatttaatctggtggacagcacttccaaaaagagtgcctacttttttctgtaaacgagtgctacgatcaaacctgcatacatgccatatggactacacgatactatttcttgcagcttattcttatgattctcctgtagccttctccagttatgtatcaataagacaattatacttttcccctagacaaacagacaatccatattcatctctgaggagattgattattctcttgcttggtgaacaacggataatattattatcatttctttactattacaggcttgataagccgatcaaacaattggcttgcaatttgcctcacaggcttgcaagctagggtagcgtacatttctacagcagaccttcgatggggagaaaatgttgcatggtacgggtaccaaaccatttatattgacattgttgcgtccttcattcatggatgcactcctggtgtaatctagatttttacctgaaaaataaaaaatattttactaggaaagcatgaaagataaagaaaaaccatatgcaatacatggatatgtgaagatggatgtctagaagaaaaatggaaacacaaattttactctgaaagatatgtttctataatacatcgtgattaccacagaataattgaataattgtgaaatcgaaataaaccttggattcaccattgagattcaatattagatagtagattaccatacagatggccaggaatgctaaaacagcctagaagggccaacaacagaagcagaagtcctcggctacagttcggcatctgcttgcccatttgtgtgattgctttgtatgaagctgtggcttgtgtttcttctttgttttaggatggttatatagacagcacaactgaaataaatagacaaaagtaatccaatgattaatagtatccaattataaggcttatcgttaacatatgtacagttttgttataaattagtcaaatgaagtatggtggataatcttatctaatcttaccatctgcagtttactcatattgctaaacatggacggtggcctatgtaacgtctactagacactcaatgtgatagctaaatatttgttaatgtgtttattctgcacaatctatgcgaagttattccctcgtgtaagtaatatatgctcttttgcacgatgacatggtctgacatattaaattttaccactaatattctttccaatatactctgtgaaaagtcactagaattacaatattataagaagatgattgtaaaagtagttaaacatattttaccagctcctataatctctacctcccaatgaaaattttaaaaacatttacgtgttgtttggtgataaacctgttttatggtcaatgcaaatttctttgtattatataatcccttattttccatatgttacatggtatggatttttcgtaaaaaatagctatggatgttgatatatttttcggaatagataatgaatataggattggtggataatcgttcagatgtatttgttggtctatttttgtaaagtattcttaacggttaaagcgtcaaacattgtacgctgaactactaggtagttggaggtggaactagacatcctatggaattttacttacatcgtatagaattgtaccaactagagcaggttgtatgacccgagaggtttcatgtttgatcggggggagagggtgcgactacaaccttaggtgagcatgattccatgcataactcttgaaaatggacaagaatcacttgtacaaccaaacttggatgcaattgtccgaggtatacgacgtgaaccacaaggtataccacgaaaaaaaggtagagggaagatctcaaggtgacaaagatgtaaagtcaacaatacctaaccaggacacccactttttacaatctatcacgcatagtgaaattgtattgaaaaccaaacacatccttgtggttaccgcgtttacaaaatttgtggaaacaggttagtccaatgaaattgatgcatggaatctctgtattacccattttattagaataggtttgtagttgaaatgggtaaaaatgggtgacaatggtgtctccatagtggatactaaactggtgatacaaggaacaatcacacgagctcatgcctgttcacttcattatcaggcagtttcgttcttaaggttacaatatcatgatttctttaaaggggtacaactataaataaaatcctgtgataattcacgggggggagattgcttgtgataattttattgtgcttaagaacgaacgttatgcatactatggtaaaaaaaaacgaagcagatgcgcacagtagaaaatgatgatacaatacaaaaggttccaatttggtctgccagtcagacccaagttgaaaaggttgcccattgattcaaggcttcgtttgggtgccatgaaaagatatttttgatttatcctcaaaactaaatttaatctagtagaccgcacttgcaaaaacagtgcctactttattatgtaaacgaggactatgatcaaacctgcatacatgccatatggactatacgatactatttcttgcgcttattatggtgtttctcctgtggccatctccagttatgtatcaataagacaattatacttttcccctaaacaaaaggacaaaccatgtttaactatgaagagattgatcattctcttgattggtgaacaacggacaatattattatcatttctttacaattacaggcttgataagctgatcaaacaattggcttgcaatttgcctcacaggcttgcaagctagggtagcatacatttctgcaacagaccttcgatggggagaaaatgttgcatggtacgggtaccaaaccatttatattgacattgttgcgtccttcattcatggtggcactcttggtgtaatccagattattacttgaaaaataaaaaatattttactaggaaagcatgaaagataaagaaaaaccgtatgcaatacatggatatgttaagatggatgtccagaagaaaattggaaacacaaattttactctgaaagatatgtttctttaatacatcgtgattaccaaagaagaattgaataattgtgaaatcaaaataaaccttggattcaccattgagattgaatattagatagtagattaccatacacgtggccaggaatgctaaaacagcctagaagggccaacaacagaagcagaagtcctcggctacagttcggcatctgcttgcccatttgtgtgattgctttgtatgaagatgtggcttgtgtttcttatttgacaacacaactgaaataaataggcaaaaataatccaatgattaatagtatccaaatataaggcttatcctgaacatatgtacagtttttgtcgcctcccaaaacgaccctaaaatacatcctctaaattatgcctagaataattaaaatacttgtgaaagccttcaaaaattaaaatgtgcaaagttaaaagtcaattaaggcttggaggatttttgtatatttcgtaaaagtctaaaatgtgtaaataagttttagtggaattttcagagcataaataataattattaagaaataaacaaagttaaaatgattttataaaaagaaaaaccttaaaattccccctctccccctcttgggccggctcggcccatctccctccccctctctctcctctccccgcggcccactcggcccctccccgcacgcgcgccgctgacgggcgggcccgcccgccaccctcgctgacgggtggggcccacccgtcatccccttcatcctgccgctcccaccgccccgcccgcaccaagcgccgccgccgccgccaaatccgccgcatcccgccgtccccgcgtgcaattaagtgggaggaaatactccccatgatcccctctccctttcccccattttcccctctctctccctctctatttcggatggaaaccccccttaatcccgccggcgccattgatggcggccggacctcctgcgccggtttccttccccgccggccgccctctctccctcctaaccctatttaaaccctccccgctcttctcccgtctgtttccgcctctcgccgcccttcctcctcgccggaatcgagctcgcgccgtcgctctctctctccgccgtcgccgccgagctccggtccgccgccgtcgtcgccccggactgcctcccacctcggcgccgcatccttcgacttcgccgcatcctcgccgaccgccggagcgccgtcgaccacgtcgacccaagccgcgccaccgcctccttccgctctggccgcctcctccgtcgccgccgtcgccccggggtgagccgtggactgccacctcctttccccattccctcccctctctcggccgccgctccgccgcgccggtggtcgccggcggcgaccatcggggcgcgggcgccgtctcccgccggccacgccgacgtggccgccttcgggcgcgccgagcggcagccgcatggggccccgccgtcagccgcccgcgccctcgggtgcggctgacgcgtggggcccggtcgtcagccgcccgggccctcgggtgcggctgacgcgtggggcccacggcgccggccggtgtgagctcgggtgcacccggtccaccgaggaccgtgaggctgccgcgtgggccccactcccgtggacccggtccgcgcgccccctccccacggctgacgcaataaattctttttaaattaaaatttaaatgaagaaattcacaaatattcacttaaagagcatataaacttcaaatggccataacttggccatttgaactcggaattggaccgttcaagtctctaatttttccttaagaagtcaagaacccatttttgtactttgttcctgcttgttatatggaatttattagagtaaaagactttttcctttccgttggtcgtgtagacgctgcagcttcggaagatccgctcttcgtggaggttgaagccgacgtttgggaaagcgagcaaggcaagtcacatcatctttgaacatattggatcccactttgtgaaattattttgatttaaattaatgcattatcgctttatttaaattcccgctgtcggtgatatgggaccgggagtatcataaccagaggcttgaggcagacataatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcacta

SEQ ID NO: 63776 - DNA, 1320 bp, Oryza sativa
attgaaaatcgctgcaacttgcagccgttttgaactaccataggcgtatctgctaccaaaaaatctctttcaaacacactatttatattttgggatggagtaagtaagattagaagttctacgtacagtggtctggacacttggttaagtgagaaaccatgtgcataaatgtgaacacgctgagtatttcctcgaacgatcgacatttgaacattttagttaactgaacgagctaatctaactttgtatatatacccaatttggtaagcgtatattaatcgatgtttggcttgcggtgcaagtaaaaaatgggcgccctgatcgactactgtgcatgccgtacgttgaatcactctacggtcttgatcagaaaattaactaagagctagacataacattgtagttaccactaattcatcaggtccattagtgcttgacttgtagtgttggccatgcttacgagctaggagacgtgctcgtggaagcaatcacgcaaatgaaggtgaaagtgtaacatataatgtgcaacctttacaagatcgtgctttaatttgtcacagcttcagcttaaaacctaagctaattttgaagctcttgttaaagcttcatgaaaagaaagccaggcaacacagagtgacaaaaagggtccttaacactctaatcatctacacgtggacttatatataagcgattttgatttgttttcactataaatttatagtatgttattttaatcttggctttcaaattacgaataatacagattcaaaagttttgtctggttcattattttttctacgacttatcaacaaatcgatcggtcgaaagtaaattagaaacaggaagattcaacttttaaactcaagtgacatcagcaagcatgctccaagtctggtgaccatgctatagcaaaccatttttcatagatcattttaagcacatgataaatttcaaaaatagaaactgagcacatgataaacaatctttgtgccacccaattttatgatggtttttctcaacagttgcagtccgaagaggcgtactccattgtactacgatccaatagtggtcgtcgaatatatgcttgatataaccaaaacaggcatcccccataacttgattcgactgagggaattgctaaagatactgattttatatcatttttgttagcatttttttaaagtggtaaacgtcctactttgtacgggaactttttatataaaagttcttttaaatatcttataaagtcatttctaaatttaaaataatttaaacccaattaattagtaatatgagctaataatattctcgttttacgtg

SEQ ID NO: 63777 - DNA, 4818 bp, Oryza sativa
tgtggatttcttgctctgtcctgcaaaaggaccacatttatttcctccttcaatctatagcatcagttgcttgcttgcttggccaatgaaatgaggtgggttggtgatggggacattgagttttgttagtgcaatgtattatggggacatcagattggtgttgcaaagtagccctatcattcaaaaactaatatcgtatctgtagattgtttcttgttgtttctctagcgcataaaaaaataatctaacacatggtattgtactatcaggttgctgggctcaaacatatgcgaactttgatggagtggccaaaatgctttggtggctgttgggtactgtcatgtgcttttgaacaggttttaattatgttgtatgagatatgctaaaaaattatgttgtatgagatgtgaaggttgtaatgtgtttttataatatttatgtgctgatctataactattttgttactgatgatgagagaatgtcaactgatgatcagtaattaattttgctaaaattatggacgaaatatttgtatttgctaaatttagcagcagctgaatttttgttgggctaaaatctagctgtagcccaatttgagctgggctgaatgatgactaaaaggccgaaaaaacactaaaaaaaatcagcccaaaacaaaaaaaaaaccattaggtcataaatgggccgaaagctcttggaaaagaattgggccacaaaacacgtgggctaaatcctacatggcatcgatgacacatcagcgtccaccttggcgaacacatggcacatacgtggtgattcaatttcgtgacggaaaaatatcctacgtggcagctaatctgtgacagagaaatatcctacgtggcagctatccgtgacggttatttttcatcacaggaaatgggcttggctggactaactagaccacgggcttcatcgtgacggtttaaaaccgtcaccgattctgttaatctgtgatggttttcgacaaaccgtcacacaggtcaatccatgacgctcaatccgtgatgatttctgaaaccatcacagatgttgtttggtgacggtttttcagtgatccgtgacggaaatttttcatcatggattaacaggattcttgtagtgtgtggacagagaaagctttagtgaaacttagatggaagccagcctgtctgttcatatcgttatcttgttagggttggttcagagcatcagatttttctctttgtagctgctaatgggtaaagcttaaacagccatagattcgtatgatctgttcgagaagattgctgttgtaagtaagctgtgaagatgacaactgcacaatccatttgtttgctggccatgcggcacatcggcccataaaacatgcatgatgcccgtgccaaacataactgtagaacttgttgcatttgtattgaagttattagttatttgtttgattgctgggtctatgtctatgtctaaaaatctaggttggcttcgtctctttaatttaagtggatcagaagattttggctgtttcgtgcaaaaaaaaaatttgttgagatgcactatctcttccaacattttgcaaaatatgtatgttccttattatcagaaggaaatattctagaagtgactatctttaaatatgcgtgcattgtactgaaatgtaaactcttgaaaaagcgccgctcggggatggtactacctccgttttttaatagatgacgccgttgactttttctcaaatatttgaccactcatcttattcaaaaattttatgcaaatatataagatataaatcacacttaaagtactataaatgataaaacaactcataacaaaataattataattacgtaaattttttgaataagacgaatagtcaaacatgtgagaaaaagtcaacggcattatctattaaaaaatggaggtagtactatttataaccgagttacgcaaatattgcataaataaataacgtgaattgaacaggaggagcacaacatatcagcatgtttgcacgtaaaatatttgtagtgagaaagacatggttgaggatagggaagacaacttactccctccatcacacaaaaaacaaacttagatctagatatgatatattctagtacaatgaatatagatagacccctttttcatattcatagtactggaatgtgtctcaacatataaaatcttttatttttgggacggatgtagtagtacactactacaagttcatgcctccgctagtttgggtatgttgtcttattacattgtggctatgagaagttcttctcatgtttcatattaattactacacctgtttttgatattgagacggtaagagaatctcctttgtcatgacacattgtggtgctactgtgctaattgctataccaacgacaaaaatgaatatatagagcaactcgtatatatgtacactagtaggtcctccatagaaaacagttggctgcaggtagttgagaagtgttcaataacaatgagagatgttaggtatgtctgcttggtactatatatgcatatgtagaatgcaaacaattatgcatggacagtgcgtgcagcagcacatgttttccttgtaagagtagctaggaatgaagattggaggggatatatatcaatgagaaattgcatgcttgttctgtgcagatgacatatgctagcgatttcttggaatgtggggcgttaggaattctaattgcagcgtctacagctttagctgggttactcaagaacagaacttcatagattgcgctgagacttggcaccaagaatgcaaggggtctaaagacgtgaaagctttgagacgtcgaacctgagagataattagtcagactctgtgaagccgatcagttgatacgaaggagattacggcaagactattcagcagaacacaaagagattattgggctgcatttttgcagagtattgggcttcatttttgcattcttgttgggtagtattgtacagcgcttatttgtaggccgatagtgaggttctgtaattgtatggctgatcgattaaaaatggcatgtttaggtttgaataaacatattgactgcccaattcggttgcttctttgattcatcctgttggtactcaacctgtggtttcaaatataaaatctcccaccatatgtcatcagcttggcaagttggcagcggcattgtcacgctgttcatgtttctttctgattgctttgatgtatacagagaggactaaatgttgaatgacattaggaaaaactatatttctgttttttatccacttgtataaatggacatacgattagcggccagaaatattcattttacaaaagagtttcctagaagttccacgaagctctggcttcttgctctcgttgttacacgctggaacacgagagcaagcagtcaaacaaaaaaccttgaaagatcgtactactaaaatagagcaattctacggtacttgagaaggtaccataagataccaaaaatttagcgtaaaatttggtacttcatggtatcttatagtacctaggtacaaagaggtactaaatttacaatagaaaaaatggtacctcgtggtacctcctcaaggaccataaagttgctcactaaaatatacctgggaagttgatgggtggttgcctagttcgtgtgcggtttatggctgatatggctggttactaagcttttttgtataaatgccatgcccttgtttctatttgagaaatattgatcaatgaaagaccacacatgatttttttcttgtgaaattattggaattacaattttgctttttcactactgctagtctcaaacagttgtggatccttggaatggaaagcactaggaatttctgctgttccatggaatctatataatgtgggaatgtaacatcagctagaacgtattttttcccacacctataggattgatggagtcgtggtaaaagttacaggccttttgcgactacgcagacagaaatcttgagagaaatttaaattattttggatagaaggtgcctgccggttagctcatgtcatctattatatattaaaattttactaaacatgtcacaaatgctcttaagctaccatacaacgctttacaaatgctcctatgttaccacatgatgctctaataaattcgaaaaaaatagaaaatatgataattttaactattagatgatccaataaatagatgatcctttaaatagatgatccagtaattttaacaattagattaaaaaaacacccatatgccgccacccccaccataccatatgtacgcatgcacgtatactccctccaccctctgactctcctctcctctcctctcttattttctaagaaaacttctcctattttctagctaacaataaaaaaataataatcagatagttaaatgatcacaactcctgagttacatgtcgttttctcaatttgtttgaattgttgtgttatatataactaaatacataattcaagatacatattgcccatatttacaatatataaaatagacaataccataattctaactacaaatatttgggcaaaatttgcatttcagaagtgatgaatgaatcatcacgaattcaagtatatgggtccacaatccaggttcaaccaccaccaagcactactacagaaatgattttcctggacagggaccattttagattgcatgtgggcggtaactcgatccgcatgggaaaattggctcattttcctgtgcggtttatataagaggaccacacggaaaaattaattttcgcagacggacgtattaagtgaaccgcacgcaaaaatgagactgttttcgcagg

SEQ ID NO: 63778 - DNA, 2911 bp, Oryza sativa
tcatggctttaagcttatctcctacgcgtcggaaatggatcagtcagaacatcactgccggcgtactgtcgtcaccgccgtctggtgtctcgcctacacggttggatggtcacatgactgttgatgggcgtctacgtcttcaccaccggcttgcctttgccgctgccactagtgtcctcgcctatacggtttggttgtcatatcaccgttgttgggcatcaacgtcttcaccgtcggcctgcctacttccgctgccgactggtgtccttgattacacggttggatggttacaccaccgttgttgggcgtctacatctttactgaccggttgccttcactgtcgccatctgctgtctccgcctctacaagttgttggtcacacaactgttgtttggcatctacatattcaccgaccggctgcctgcgccaccgctgattggtgtctccgtctatacggttggctggtcacaccgccattgatgggcatctacgtcttcaccaccggcttgcctccgctgccgtcgactggtgttttcacctacatggctggttgatcgcactgccgtcgatgggcgtcattgtattcaccgcaagcttgccttcgccaccgctccgccgatagcagctgcgtcgcctcccgcgccatcagcggcggcgcccgtggagccccgtgcgctcggtgaggagaggaggggaggagaggaaagaggccgctcagtgaggggaggaaagaggaagagagagaaaggagagagaggggaggggaggagagagggtgtgaaaaatttgaagtgcgtgagagggaaaataggaagggatattttatatggctgtgcggttcacttaaaaagcccacacgcgaaaatcgatttttctgtgcgatccacttaagtcaaccgcacgggataatgaggattatcctgtgcggttggattaagatgcccgcactggataatctattttcccgtgcgggcgtccgcccggcgccggttgccccattatctcatgcggtcccaatcatggtccgcctagaaacaacagggcccagcgtacaagaatatcatttatgtagtagtgtgatggattctacggtggtgcactggagtggagaccaaacttgaggaggagaggaaagagatatgttagggaagagaccaggacagcaggattataggggtgggcataaaaaattgacaaccgaaagccgaaccggaccgcaccgtaacagaaccaaactgtcggtttttcggtgatcggtcttttctttcggtttctgtttttattactagaaaaaatgcctgtgcattgcaatgggaaaaaacatgagaaatttaagaaaaggttgagaaatatttacattatgtaattaattaaaatataaaatcgcaactatagatgtatccgatgtttttttactggaatacatttatacgatgttgaagaaaagaaagggtcataaaagtcacggtaaatgtggaaatagaattttccaaataaactatggctggatttaatttttattaaattctccatgattaattacactatgtgaaaaattttcagtattttcagagctccattgctaattttaataatacaaacattattttagcatttatttaaatgaaaatctaaatgaaaaccctcttttctcctgggccattttgagcccattttttctttagcccatactcctcccttccacctcggcctgaaagcgcgcatctggcccatcaaacaaccagaaagtctaatcagaatcccttctcctctccctgtcacgtgggtcccaatgtcacgtgggtcccaatgccacagtgtcgtctcctacctctgtccgactccacagcttcccgacgccgctagaaaccaccgcctccttcgatgaaatccatccgcattcgcggagataatccgaaattgattgaggggttttgatccttatctccttctatttcccttttccaagaattagagcaaaatcgcatcgtatcgatctcggaatcaagccatatagcaaaccctagagttgtccgtttcacatactggagggaatcagactgcgcgacgtatgaaagtcttcggcaaaaatatcttaaaacttttataataggtgaagattcggtgttcggattcatgtgttttaatatgtggagaccgaagaaatcggaaaaccgatcaatgtaagtctcataattaaattcattatattttatctatagaaaaaaattcttacaattttaagagtaatgatatgtcagaattttatccattttgttacggctattagaaaaatgtgcacgaagtgtgttgggaaaacctatgtgtataagatattttcctcacttattagtagactgacatgattgtttgtgctaagataccagaaagcaagctggtcgttgagctattcgatggactctttggaatcttgttattgaggagtattaaacgtagattactaacaaaacctattttataagtcctaggctattttgtaagacgaatctaacgaggtatattaatccatgatttgctacaatgatgctacagtaatcatccactaattatggattaatatacctcgttagattcgtctcgcaaaataacctagaggttatggaatgagttttgttagtaatttacgtttaatactactaaatagcaagattctgtaaggatatttaatagcctgaagaatccaaacatgcccataatgtgactttgcttggcagctactggtactatatataaaagaaatgttaatcatggtaacttggtaagcgagcaattttttttttagctagggatggagacggattgtgaaatattaatcctttggctctgttgttgaattgattattagtggctgatgagtgatatttggtaggaggggtgaacaggtagctca

SEQ ID NO: 63779 - DNA, 641 bp, Oryza sativa
ccaaattaatcaagcttgcatacacatgtacgaatattgttcatgtaatgcaactatgcaagtagatacgtacgccgtatggttcagcagaaatataatcggctgacaagtctgtctgtgcactctgcactgagagcaacagggagcggatgtggccgtgcgtgcgtgcgtgcgtgtggtcaccgttgcagtcaagttgacgaagttcttcacgggttgcccggtcgggggagcccctgcctgtgccgcccgggaccatcgatccatccatccatccatccatccatccatgcgtcgcgcggcgccctgtacgcctgtacgcccgcgccgcacgtacgtacgtacgcacgccatcttccgtggtccaccacaccgcccccgcggtttggttggataaccccaacacaactgcatgcggcctcgtgccaaaaacggcttctcccacaggaaaaaacggtagaaattttcctctcctcccggatcgcgacgcgcatgcagccgcgatggggggagatggcgcgcgcgtgctacaccggtgcgggggttggtgattggggaccacggtggttttcacgtacgagcgccgctagctagctgtggaagtcgatcgggataggggaggggtcgcgccgtcgccgtgt

SEQ ID NO: 63780 - DNA, 6965 bp, Oryza sativa
cggtggttgcattggtggaggtgacggcatcggcgccagaggtggtggcatcggcggcatgggtcctggggacggtggctgtgttggcggcggtggcgacggcatcggcgctggtggtggtggcatcggcggcatgggtcctggggacggtggttgcattggtggaggtgacggcatcggcggcatgggtcctggggacggcggttgtgttggcggcggtggcgacggcatcggcgccgggggtggtggcatcggcggcataggtcctggggacggtggttgcattggtggaggtgacggcatcggcgccggtggtggtggcatcggcggcatcggtcccggggatggtggttgagttgggggaggtggtgacggcatcggcgccatcggtccgggagacggtggttgtgtgggcggtggtgttggtggcattgttggcgccacaatgggtggctgtgttgtccgctgagcatgggcgaacggcgagatcgggaggacgatggcaacgaggacgaacgcggcggacgccatggaggccaccatcgttagctactacgcaccagcgctgatcagctagcttgtgtgctttccaaacatatcacctgcatgaacaatttataggcagcatctgcctagctatagtacggagcacgcgatgcacctgccgtgtttaattcattaattgtctcgtctgcatgcagcgtatgcacagagtcaaaaggcagctcttttgatctctcgtgtactaggcgtactcgctttgtacctcgtatccagctacgtatatattcaaccgacggagtgtgggctcgtggacattcggaattccggggatgattggatttactcattccatttgatattatagaagtcgctttaactttttataaaaaaaacatttttaactttaattaagtttatagtaaactataacgatacttataacatcaaattaattttattaattaacatttattatattttgatagtagtatatttgttttgtgttaaatgattgctatatttttctataaagttaatcaaacttatcgaaatttaagttttaaaaatatcataacgtcttatgagtcagagggagtactccgttagcttcaagagcactgcagctaagtacaaatgtacaatcatgtattgctcatttgctgcttttgctagtctgctcgtgagccaaaagtctggcgttatactgcatagcttggtgaatggtgggtctgggggcctgggttttggcgttattctgcatagcatgacaaagaacatgcacagatcagatgtaacttcgtctaactcagcaagtacgtacgtctatataagctgcaaaatctctcgagtcctagcttataggagcaagaaaaatacaagagcatggcacgtgcctgcgtggtactgttgccgcccttattatccaagtcaacgacgatgagtcgttgatgacagctgaacacatgctcattttatcccaaaatagacaaatctaatttagactatgatacattttaatattacaaatctgaataaatcctatctaaattctgtaatgctcgttctttgtggctttagcgggaaaatttaatttttaaaaaccctatcgtgaaagttgttctttgattgaagagtagctgtgttgccaagatctccctccaaatctctgatcaaaccaaaattccagcgaaaaattcaaattcaaataaaaaaaatcccaaaactctctcaacaaattcatggaaaatttcaaatcatttctcatttcattgaggaagaagctcaaaatcttgatcaaggaaagtcacattcgatcatattgagcccataatttgaaattaagcactttaattttccaaattgtgcatctctaggttacacatggaaggctcggccgcggtttgcaatatagccgccaagccctcctaacttgctgcacaaacttcctttgctaattgagttatccaaaacaccccttgtcgtctaccttgttgggtttcagtatttgtactcttgagtatcaaaaccaaaggcctttctcaaattcaaaatgatcaacattgggtaaaaattgggttttgttgaatccttagaaaaacccaacacaagggttggtgcattaaaaagacgtactggtggtgtagtcttaccattctcgtatctaaggactgattttgttcaaaatttcaccaagcataacatagtgtgaccgcatgggtgaagtgggacaccccctaactgagtaactagctagggcagggaagccttgatgccgatggacaagtagattcaccgggatggtgtcgggaaggacccctaagcttcctggtgcaacatggtctgagacctaacatgttcttggtccatgagacccctccagttggcataaggtgaccccatgtctgctttggaaataccttgtcacgaaagcttcaaagtccttttgtctctttggccaggagccattgttgttgatccaacaatgatacactacactcctccgactgagtgagactcactctcactctggtcgtcgagaagcactcactagacgaattcaaaacttgaaaataaacaacctttcctctaaagctagcattaaacacttaatacccctaccttggtctgtataatatatagtacccacccttgctctctatataaatatctactcccaactctcgaagaggaggagatggaacccgaagatgagttcttctaggagcaaacgacttcagtcaatcctagagtttcggccaagtttccaagtcacacctgtggtgttggtcttgtttcacttccgttatctttggcactgactcattgtgaactcagggtatgtttgtagttgcaacatagatgtaaaaatattgatattagtgaaactctattgctgtgatactcatcttcctgttgtaccagcgctgcttcctatgactggtacaggttcataggttaatgaatcgtcctaagatgaccttctatatggctagtccggggcgtgacagattcgtagtgtttattttaggacggtacgtggctgatagtctgaagcagaggaaagaatattccttatgtgtgtgttgtgcctccttgtaactacaaggtaaagaaaaaaaattgagatgggaaattaaataggaaggaattaatatatatgcaccagatttaggagcgtgtgatggattttctagcaaatgatggagcaagaacgttcattgaaagaaaaccagaaagggaaaatatgaaaaatactattttaaagatatgttgcaagatatcataagaatgacgcatgggaccaagacccatatgtcaatcacataaacaatgttatttttcaactctataatactttttatgagaaaacccatgccataatgttatgggcaaagaaagagatacaagtggccctgtttggatcaggagattctaacaaccgtagctttttctaaaatctttaccttagcttcccccaaacagttcatatcgtcactttgattctcgtaatctgtagcaatagaatcctgaaaaatgaacttgaagttagaagttgagaaacacatctttttaatatatttttagaagctagctaccaaccaactatttctcacagttccctaaaatggagcctgttatattgtgcagagatcaggacgtgcaaattgattggccacaactgcgcggtgaagatatgtaaaatgcaaatacaatccacagaataaactttcttgtaatgcaaaataactcatatgcacaatcacattgtgtattcactggtcttctcaagattttgttatgttgaagtttctcgtgctaattagagagaaggccacggagaaagaaattctctctctgggcatgagagagagagagagtataagtggattcaaattaggaaatttaagaggtccaatttcgagatcaaatgcctgagatatgatcaattttcaagtttgaatgttgctaaagcataaaactgccaaattatccaactattcttctgtaaaaaaattatttgtggtgcctgtcactcgagttgcgtatatatcacttcaattttgcaaggtatctagcaggtgaagcccatggactctttgacacatggtctcatagattggtcgacgcccactccacaaggattgaatggttagattacgccggttactgagtgcgagcctcacataccatccaccatggaggccaacatgtggaacacagtggtcagcccagccaaagcaagtccaatgcaacaccctcgtcaaatggttttcgatgaccatccactcggccgcgtgccaagctgagggaagaaagcgaggagagtgtaggatcaaaacacaagaactaagccaaccagaggggagtgaatggttggtatacccaaaaatccaaactttttgcggaattaaaagttaccttcaaatttgacggatcgcggtctgaccgaaggtgttgcgccggtctgaccgcttggaagccgtcggtctaactagagtagatcgtccggtctaaccgcccgaagaagctgcagtcgcttgaacctgccgccggtctgactgccgtgtacccaccggtctgaccgctgcgatgccgccgatctgaccgttggtgtctcgctgattagaccgctgaacccgagaaaacacaaattgaagaactctagatgtagatgataactttattacttctctctgtgtttacaaagtgcaacaacagcactcctcacgaaaatcttgacaaaactcgaaaccctagctaaacttacaactcaatcgctttaaaaaacgatacaggcttcacgctccctctctattatatatgaggtaggtagcctaaagccacgaacccaactcatactagaagtcctaatccaactagtaaatcttcccgtacaagaaacaaactttacaaactccaatcataccaaatttggactcctaccaaattcgactccgcatccaatacgcacacaatacctccatcgtatgccatatggatcatcaccaaccacgtacattgaactctagcctaagtatctcgcatgatatctgaccgtcacggacgtcgccttatccccaagtcgactcccgatccatcaccggcaatactctaccgaggcatcaagtcacctacacatgaatcaaacaaagaaaccatattccgagaccaagctatcttcaacttgactcattgttagcaaacaacagtattacatacgcatagtatccatctagaagccaacataaaacaatcacgaatatccaaacaaacaacccgaaaccaaaaccgacacagagttggccagcccgacgcgagctggccggtctgaccgcgcgatacacgccggtctgaccggcaaccacttcccggtctgaccggacccaaatcacagcagtacctgtaaatcacctgtaaaatccaatcatctccaaaaccacttcgccgataatctctaaatatcaaaaccaataatctcatatgccaattgttcatcacagaataagaataaaaaacactttgattttacagggagctcacccgtgggcacggtgagaataatggaaagtcgatggcagcggaacagagcttgaagtggtgacgcacttcgggtaggtgtggatgatgtctttccttagatcttcgggtggcgttgatgtcctacgtatcgaagacgagggcacgaaaaagatgccgacggaggtggctcctacaagtaatcagaattctattggcaaccaaccgattttgttggtgctatgagatccttcgatgcctcgaacgatggcaaacgacggccggagccccttggatatggagagagacagaaaggagagctttgaaggcaccaataaaattttactcaatctgacaaatcaaggccaaattgaatgtgaatttagagagggaatgaagcacatggttggggtcatgactatgctttcgagttgtggattggagtggaatcacgagtagtggcgacgtggggagaaagacgactactatgctgtgggatgcaccacttattagcatcgcgggtgagcgacctggtcggaccgactgttgtatgtacttatagatgtggaggaagaaggtcggactcgttggccgatgtggggaggaaggccaaggtgacacgggagtgggctgacgcgcggaggcatcccatgtcgggagtaaggagaaagagaggggggggggggggtttcttggttttcttgggtttttcctttcggtttttgtctggttcttcttatgttttttgggtttttaatatatgaaaactttgtatacatgttgtttttgttttttatttttaaatatgtatgtatataaagtttgtatacgtgaatatatatttttatacattaaaagtgtatacatatatatatatatatacatacatatatatatatacatacatatatatatatatacacacatatatacatatatatatattatattatattatatgcatatgtatacactatatacatacatagcaactatatatatatatatatgtacaaagtttatccgtatattcatacgtatatacgcgtacagaggagagatgaaatgggccgcagcccacctcgggcctgcagctttgcaggcaaggaaggcagagtgggagagagagaagaagaagggggaggggcgagggtaagcccggccggctacgcgtgaagagatggaaagggaagccttttttgaaaacctggaaagggaagctttcggccggatttggcttaaaggttgttctctgtttaagaatttcatcagaccaagtgtttttccgtacacaaacacggaaaattgtccatgtggactggagagatgacacgatcacaaaatcaaagtcacgagatttaacatcaacttttattcaacgatatattgtaagacggacaactagctagtcgatcaatcaccaagctagcacacagaagcatgca

SEQ ID NO: 63781 - DNA, 1639 bp, Oryza sativa
acgcgagtgatgattaattaattgtatagcttttgatgatggcaatatggcatggagctgtgcactatttatagcctaggcaacgtagaattaatccatacatgatactacatgtaagtaccgcagctggtgtgccttgtttgtggtgttgaattgaagctagcatacacgtacgtgctgcattttcgcctgtacttttgctagaccgccatacttcttctgaagctagcggagccgtgcatacgatagattatatatgtggagcaattaatatcactcaggttgatcgcctttgacaagtactgtactgtgcgtgaaccaagacttctacggcccgtataaatcccctagcaaaattatacatcctgtcacatcgaatatttggacacatgcatggagtatcaaatataaaaaaaaactaattacacagattgcgtgtaaattgagaaacaaatcttttaagcctaattgtgccatgatttgacaataatgtggtactacagtaaacatttgctaatgacggattaattaggcttaataaattcgtctcgcgatttacagacggattctgtaatttgttttgttattagactacgttttaatacttcatatgtgtgtccgtatattcgacgtgacacacaaaaaatttacacccctgaatctaaacacaacctacgtcgtccacgccaatagactttggctcttttagatcccatcctaaaatttttcaccctgccacactgaagtttgaacacttacatgaagtattaaatataggctaaaaaaattatgcacatattatgactaatttgcgatacgaattttttaagcctaattgctatatgatttgacaatgtggtgctataataaatatttgctaataatggattaattaggcttaataaattcgtctcgcggtttactaatggattctttaattagttttttttattagtgcccaaacaccccatatgataccctatataatatccgatatgacacgccaaaactttaagctcctagatctgaacacccctttgttagcttagctacagctagtagctgcacccctatgaacaacatgctgctcaatcgtgtgggaaaaaaaaaccccgtagtgtcgctgccgcctgggcgctccagtgggaaggttggaaatatatcttgaaaaattgagcacatgtgaacggtaatcatgggctagtaaaaatgggggcaccgtgacatcctgaccgaattaatttgaatttagtttgtatggacaataaatactgtgtacgcatatttagtatcacatgccatttaaataagagcgaaatcaacttataaggacttttctctccaaccatattaagtagtgtagtatgtgtgagtggatccgcccatcggatgagcatatagagaaggtgacgacaacggtcctccagcaagccccctcctctaccgtcaacttccaggttagttctttctcccgcaccctcaccgtgccactgcccgatctcaccggcgtcggaaggtgtcaacgtgccgacgcgaccccacccagctgacctccttcccctccctccaccacactttgttcctgccaccaacattggcaccacccccccttgtgtctcaccacccacccttgaccatc

SEQ ID NO: 63782 - DNA, 18493 bp, Oryza sativa
ttacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcatctggcgcgccaggtagggggctcagcgtgtgctttctgagctctcagactcttccgtgtgccccaagcttttcttgttcaacctaatggccgagcaaggaaaaacgcacgacctctcgccgagtgtgagcggcgacgacggggagccgaatccacgccgtcgagctcgtactcccccacctcctccgcgccaaagccctaagcagggggaggcgcttgagaaggtcgacaaatccgtggcatcaccagtcgcaggtggtgcaggaggacggcaagatggggagcgccgcctcctcgtctacggcgacggcagcacgcctcagggtacgcttcaggctgctggcgcgctcctacgacatccgcctgtcgtccatgacccggagtctccagcccaacgatggctggaagatgtggccaacttggtcatgacggcacagcagcgcctgggtgctggtggacggtccgtcaccaccaagacctccggcgccgctaccaccggctccgtgtcgtcaaggcggagggcgcggcgagcggcggcggctgcacggcattcggctgccactccctcgtcgacaccctcgactcgagaggatcagcatggggagccggatgcccgcctcaacatcgagcgccggcgtaatagccggcgtactccccgtgcaacggagggcgcctcttcgtccagagtgtcacctcggcatggacgtgaggaccagccctccgtgcccccggctggtggtgtcggctgtagagcctttgtggcgagtcttcggaatgtccgttggcccccaaggttccggcccaccatcaccgagaagtacgatgggagcgtcaatcccaccgagtttcttcaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgaatcgcttcgctcgtacattcagcggttttgccaagtccgcaatactataccatgcatccctgcacatgcggtgatctacgcgttcagggggggcgtgcggcacaaccgcatgctcgaaaagatcgcttccaaagagccccagactaccgcggagctttttcagctcgcggaccgagtggctcgtaaggaggaagcatggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgtcggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttctggcaaacggcgaagtgaggccaagcagaaggcccccgctgttgacatcgatgatggtgaagatgacctaggtttccaagaacctggggccaccattgccaccgtcgatggaggagcgtgcgctcacgtctctcgccggagcttcaaggctatgaagcgggagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaatgtgaagttgggacgcgtcctcatagatggaggagcggctctcaacatcctttcccccgcggcttttgatgccatcaaggccccggggatggtgctccagccgtctcaaccgatcatcggtgtgacgccggggcacacgtggccattaggtcacgttgacctaccggtcaccttcggtggacccgccaacttccgcacggagcgggtaagcttcgatgtggcggacctcagtctgccctacaacgcggtcctcgggaggcccgcgttggtgaagttcatggcggcggtccactatgcctacctccagatgaagatgccgggccctggtggccccatctctgtccgtggcgaccttaaagtcgcgctcgcttgcatggagcagcgcgcggaccacctcgctgccgcgaccaagcccgagggtggtgacgagaggcttggcacctctgcccccaccgccccgaggcagcggatcgccacatgcgacgaggccccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggcctgtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcttatgttgatgacttggttgtaaaaacgcgcaaccaagaaaccttactctcagatctagcggaaacttttgaaaacctccgctccgcccgcataaaactgaaccccgataagtgcgtgtttggtgtacctgcgggcaagcttctcgggtttttggtctctgcccgaggcattgaggccaaccccgagaagattcgagctatcgagcggatgcgcccccccagcagacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgtccggttgaaggcatatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggctcgggagcaggcagggaggagaggcccccgagtcaaacggtggcctaaggcccctgacgaccggagacggccctctgcccgcttgtcagacggtgctgggtgcccccgaccctcaggaaggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccgaggggccacttggacgaagaacgccccgggggtacggcccctagcagagaggaacggccccaccgaagggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaattttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtcttaatgcccaaggccagcacgaacccctcacagctgcctcaaaccgcccactgggtgatgcagttcgacggttctctgtctcttcagggcgccggtgcaggggtcacgttgacctctccgaacggagacgtcctcagatatttggtccgtctcgactttcgagcgactaacaatatggcagagtacgagggactccttgccgggctcagggtggcagccgggctggggatccgccgcctcctggtgttaggcgactctcagctggttgttaaccaagtctgtaaggagtaccggtgctctgatccgcagatggacgcctacgtgcgccaagtacgacgtatggagcgccatttcgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggtctcgggacccgaagggagcgctccaagctcccttagattgattgcttggatctctgagatccaaacatacctcgcagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgaaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagactttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtggtcggtgtcccccggccgggctcggtacggctggccacgggcgacggcacggagctgccaaacccgtggaacatcgaacaccttcgtcgcttctacccctgaaggggggggtcgggtgtcaggttttggctcgggccaaccccgcacccccctcgggtgtgcaggattggccgggggctaccacacatgcacatatattccttttcttatttcagcatttcaataaaagcagtttcaatttcctaaaggttgtgtctgtgccgtttttccttctaaagaatcttaacttaaaataaggtcactcatgctcaaccttgccctcgggggttcggttcggtcagctaaaatcgccaaacggggcccagaaccgagccgtgccccggggcgtggtgaactccgggggggaatcggcaaaagcccacgatcgggttacccataccccccggtcaccacgttcccggcctggccagtctcgacatgtggatctccccaggcactagccccgacccgagccattcgaggaccgggatttgggcgcgagcccttatttcaagctaaggcgcaaaaggaccatggcacagatcatcctcaactcatatatatagcaaaataaagttaacatagaaattttttttcatcatttttgattgcagagtaagttgatctatacaaaggaggcatgaaggccttagaagaaagaaaaagaaaaaagtaaagattgacgggggctcgggggctcattctgacgcgcccgggtcgccggcctcgtcgccatcgtcgtcctcaccgctggcatcgccctcctcgtccgagctgggggcgaacgcgagccgaggggccgagccctcgaagccgttgacgatgtggtcggcggcatcccggacgcgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttgatggtcttctcaagctcctcggggagttgctcgagaacccaagccatcctgttgaggtgcggagcgaggccttccagattggtggggggcaccgacgactggcctccccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagccgcgaggcgggcggccaagtcgctttcgcccgcggccgccccgccgataggcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggtccgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagctttttctttagctccgcctcccagctcccgtgttgaaggcggagggagtcctgcgcctcgatcatcgcggtggtggcgacgagggcggcctctcgctcctcctccacctctcgggcgatctccgccagtgccgccttgcgggcttcaagctccgagatgtggcggcggtgggccttaccgcccacctccaccatggcgtccaccgagcgccgcccctcctcgacgcgtgcccatgcggcctcgagctccgctcgttccgctcgcaaggcctccacctgggcgctaaatccatctagcaccgcggtgtttgcggcggccaaggcctgcataatgggctcggcgctcaccggggcgacggaagatgaggagaaaagtcgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcgggctggccggacttggggtggcgggaggaatgcgacgggacatcgctgaagcagaagaaaaagccagaagacgagcaaaatgagcaagaaaaaacttctttttggagaaagatggttgcaatgagagtgagacgaacctgcgagggggtcggttgaatgaccaccttggaggggaaatcaggtttccccggcatggttccgtctcccccgtcttgcggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggtgtcggcagggcggctgctccccgagcccccgacgcggggcccagaagcacgaccccctcctggggcaggtcgttccccccggcggcgctcgcccgcgccgtcgtggcccttaggggctctctcctctgaggccccgacccccatcataatggttagaatggagacgcggtcgggatcgctgcagagggggaggatctcctgaggaaggcgagacgcctccgcggagctaaggttcagcaccctttggactacgatcttgaagtcctcaggagcccaatcccatctggttccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcgatcgaggacggcgtcgtagtcctcccccagatctaccggcgcccgccagctggagacctgcgccgggggctggcttggaagtcggaggcgcgcttcgtcggcaaggggggtgtagaaccagtcgctcttccagtcgtcccacttcttgcggaggacgcaggggatgtagcggtttaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgctccgggtagtctggtgccgggcgcccctcgcccagcatcactatctcccgaccggtggcggactccggcatgaagcggcgcggcagtccggcatgcctctcgttcacgatgcgggaaggcggcagtacactgccgtcgagcagagcagagccccgtgccatggcggtggaggaagagatgattgagaacgagcgcgtgtggcgaaagtagggcgtagcagagaaagagttagagctcaggcggcgagggcaagaggaacaatggcgaaaggaagggagcaaatccttttctcgatgcttttatacccttgccatcgctaggcctggctcctcgtttctcgcgcccactacctcgctccctcgtatctcgctatctcgctccctcgtttcccgtgcccacgcttccactaatcccatttgcccgcttacggcgcgtgaagtggatatgcggttgtggcaatcgaaacggattgtatcgtgcgcgcgttaattacgctcgccgaccgaagcggcgttaccgtatctccgagcgagataaatctgctcacccagattcgcgcgctgctcaagtggtgtggcagtcttgaatagaccgcccattatggacaaccaaagttaccaataccaatgtgcatggattgagaccgttgggtattttgcccaactatggagaccggtcccacctgtcaccaggctttaagggtggcgtcacacctgaccgcttcccttgggaagggaaattgctctggcataacgccgggggctactgtcggtgatatgggaccgggagtatcataaccagaggcttgaggcagacataatcgcccacgtggcctggcaccttcggggacgtcgggcccgagggtgaggtgtccgccctcctcctgatttcccccgagggggggtcggggtgcgcttgccccgaccccgagggccgaggtgccccgaccccctgaggggtttgcactatgtacgtaggttgggtgagcacagcagggctcacctaaccacatttattgcacatcggctaagcgtgtcacgccgcacggagtgcagtgcagtgcactcgattatccggtctgtgaccagtcacagaccggtcaaatcgcgagttaggtggcggcaggcggtctgacgcacgccttgccccatcccgtcaaggtgtgagcttctaagcactcgtccccagctggagctagcgtgttacatcccaaagatggcacgttaaccccgatcgatatataccaggcttcatcctaaccattacaggcaaggtgttacacgaagaagggcaaacatgcacgttgttaaaccgacgcgtggtggacaagaatgaccggtctgacactggtcgcatcagcaacgggcagccacgatcccacgttgcgcctgtctccgccgggagtggaagcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatagagagggggttggttgattctttcccggattgagagcttagaacgggggagaagtcagctcacactttgtaactcattcatacacagatccaccaaaacacaggagtagggtattacgcttcgcagcggcccgaacctgtatacatcgctgtgtctcgtgtgtcttgcgggcagacaatctttccacatacagagagaaagagagcttgagatctcaccctaagcccccggccgaactggcaaaggggggcctgcgcggtctcccggtgaggagccaggagctccgtcacccgcgttatcactgttttatttagccatgcctatttacctttgttatgaccttattattgttattgttattattaccttgttcaccctagaataaacaaaaccccaactagtgggcactctactcatggttcccctagtatgaatttaggtagatgcttcgctgattaataagacaacattaggtggttttataactttagactttgggaatattcatatcccttggactttatggaatggttgaactattgtggaattggatgcacacctctccctcttttcaaaactctcaaaatggttttaggctgggcttggggtgcatggttttgatagtagcacctcggccatataaggaccggtcttcggacctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgatctgcggccggtagtcgagatgtcctggcacagggccggtgtcctgctgctaggggctcagtcctgcctacctatcccggagattccggccgtaggtggggttgggtcggtactcttgtctatgtctaggattggttggaaactatgtcatgtcttccttccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcctgggttggcttgggacgagctgggacctagggtcgggttgccagttcggtctgaatcatcgtaggccttgggttaaggcaggttcatgtgggttcacggccttgtttaataatattacatagttctaggatcgtgttttaaatttggctttgagcaactaagagtcttttaaatgctgcttattgcaaaacctaacccctatactataactccattgtactcctttgcatttatgctgcacttgtgggtgtgtcttgttgagtacggtggttgtactcagtcttgctcaatttttcccaaacccagaagaggagctcctggatgatgaagggcctgccgtcaagcgcctgtggtcgtcgccctagtcttccgctgtttcccgtttgtctttgtgtgtgctgggccttcgcggcccatgtaataaattaactatttacgcttccgcttgttagcctctgaattgtatcaacttttggtgtaacttgcctcctgggacaaggaataatacacgcacgtaaggaacgcccgttgggttatttccggtcgtgacagttttgttatatattagtgaaatgaaaagtatggtggataatcttatctaatcttaccatctgcaatttactcatattgctaaacatggacggtggcctatgtaacgtctactagacactcaatgtgatagctaaatatttgttaatgtcaggctagccggagtcggcgtgaccagggttctggttcggccgaaccagggctagcccagcaggcctccagatttggcagggtcactgacaggtgggtccttatggcggtttccaggacggttacacctgacatgtgggcacatcttatctttaagcttgcttaggagtgagttttcctcgtttcttctccatttatgtattaatctctgcaaacaaaatatacttcaagtacaagtggaattatattattctagaacaaatatgcattgcaagcatagtaagttctcctttattttagttatattgacagtcgaaattggttcgtaacgaccgtcaaacctaccgtatatttgcaagggatacgattgatttggcggtggccgcagcagcgccagccagggtggatcaggcggcggggagaaggtggtggaggcgcagtgaagggcggcggcaagaggctcctcggctcctccttcaccactaccgggcgggagcagccgggtgggggatggagcggcgggcgggagtaggagccgcaagtagctcagcagcggtggatacggcggtagggagcacagaggcagtagatctgtcaacggggagggcggcggcaattgggagggacgccggcggtggggacctcagtggcagctgatctggtaatggggagggcggtggcggttgggaggtgcgacaaaggtggattcggcggcggggaattccatgggaaggggactcggaaacaccgatgacaacgaggagctgtcgggctttgacgacaacgatgatgagctgtgctcggcttcggcaatggcgacggcggatgtgattttttggattttcacttttttgtgaaattaatttttgcgtgcgggtgcaccaaccgtaggaaaagtattgatttttacaaacatcttcgggcagacggacagtcttatcgcgtgaaaaaataggttttggttgtatgcaaaaatgctttcttttgagtagcgtcacatatgcttggttcgttcagtccacgtgctgaatagtgtaggtagagcgagagatggagcatccagtattccagtggctccaaccggctgccagcaatgagaataccgtcatatttgtaaggatgatgtaattaattaagacactttctgataaaaataaaggccaaatagatcatcttggctcagtaatgcaaggttgggttgataattgaagctagtttgactttgtgtcttggagactcttaaggatgccgtctaataatcctacccgacactgccgaacatgagaaaacgtttgatgtccattacattacattgcccttttcacatcgttacaatttcaggctcagctcagacattcagtagaacaaagcggttcctaataatgcagcttttttgttattgttttattattagacatgttatggaagagaaaaaaaaactcacaaccgagaaacacaagcaaaccatacaccaaaataggttggcacccacaaagcacacacatatatctagcgttggtataatatttataagcggatcaatttcttccgtggccaagctgcagcaggagttgtccatgccccctcccaacagcgtttccatgatcgttgtccgatatcttaagcttgcgaacgacttcatgcatgtctatcaataagacaattatacttttccccgaaacaaaaggacaatccatgttcatctgtgaggagactgatcattctcttgattagagaacaacggacaatattattatcatttttttactgttacaagcttgataagctgattagacaattggcttgcaatttgcctcacaggcttgcaagctagggtagcatacatttctacagcagaccttcgattgggagaaaatgttgcatggtacgggcaccaaaccatttatattgacattgttgcgtccttcattcagggatgcactccaggtgtaatccagatttgtacctaaaaaataaaaaatattttactaggaaagcatgaaagataaagaaaaaccgtatgcaatacatggatatgtgaagatggatgtccataagaaaattggaaacacaaattgtactctgaaagatatgtttcttaaatacatcgtgattaccacagaacaattgaataattgtgaagtcaaaataaaccttggattcaccattgagattgaatattagatagtagattaccatacacgtggccaggaatgcaaaaacagcctagaatggccaacaacagaagcagaagtccccggctacatttcggcatctgcttgcccatttgtgtgattgctttgtatgaagctatggcttgtgttttttctttgttttaccatggttatatagacagcacaactgaaataaataggcaaaagtaatccaataattaatagtatccaaatataaggcttgtcctaaacatatatacagttttgttatatattagtgaaatgaaggatggtggataatcttgtctaatcttgccatatgcagtttacttatattgctaaacatggacggtggcctatgtaacatgtactagacactctatgtgatagctaaatatttgttaatgtcaggccagccggagtcggcgtcaccagggtcctggttcggccgaaccagggccggcccagctggcctccagatttgttctgaatatttaaaaatgagaaggaagtcagagataagtgcaagattgaactagctagttctgaatatttgttctgcttcaagcacaacatctccatgtgttctgaacttaaatactgagattcctgaagaacagattctggaagacgagtgcattccatctgaatacgcggtttgcagacgtcggctcggtgacgacacatgagtcagaagcaaatcaggattcgataacgttcatgctttccttgacttgacctataaagtaacgtccttattactcccgtcaatgaatatgtatatcgtcgtattaagaagatagtgcgctgcatcatgcacctaaccggcctgatgttctttttcaatacgggtgaatccgaagagaatgatgactctctgaatagtggatgaattattagatcggagggattgtggttagggaatcttttaaaacatagacactattttacaggatttttatagaaattaggaagcaaacactacttaaaaaaagtatttttgcggacgttgggtttcttttttcgcaggtggatatgaccctcggagccaaatatctgttagaaatttgatcataatttggcatattttaatccaaaataacaagataataaacatattttttacaatgggatttaatccagtgatagtagcatgtaatcaacatgagcatgcttaatgtagaataagcatcaacaatcacatagtaacacaatgttgacattgcgatgaatattaaccataaaacttctaattgaaataatgtaaaaaggttataccccaagaatggttctccgctggagtttgagatagtattgcctctgttggtgttgaccggagcctccttctccttgtcttgccgttacctccagtgttcgacatgttagtgaagacgaagtagatattgatgaacagtgagtagttgcgccttgcgctctccaaaaacctgatcgcccacccgtccgtgcaaacatcgtagcagtgcgtggtttcgaaggcctattctcccaaagcgtgtgcacacactcgtcgggatgggattatcgtagcagcaatagccttggaaatggatgaaagtgtgtctcacttctccttagagagatcaaatccattctcattttataggaggaatgaaagatgaagagtaatagaataggaagaggaatagagtaactaattctcatcaattacccatcaaccatcctctactacacaattatcaaccaaccatcaattaggagtaattgatgtaggttaccaacgaaataggaagaggaatagagcagctaattgtcatcaactaacaattagccatgaaccatccttcaccacacaaccatttaccatccatcaattaggagtaattgatataagttaccaattcacttatcaaatggattaattctcaaaactcttcatcccattgatatcccataagagaatgaatacacatgaattcctagcataatgagccttaaaattaatttgatttaattgatttaaatggatcaattacccaattaaatctaacaatatccgcttatgaaaatgtaaaccgaggtggattttcatcatcctcctacgaaaatcaatttttctaggcggaccacttaagaggtctgcctgcgaaaataccgttatttcgcaggcggacctcttaagtggtccacctgaaaaaaatatgatttttgcaggaggaatattatgtggtccgcctacaaaaactcatgcctacaaaaaaaaactaagtcctatcttatgttctcctcttccatcttatcctctccccaccactcattccctcaactctctctcgcatttccctctagctccctcccctccgcttccttccttccttccttccttccggc

SEQ ID NO: 63783 - DNA, 7882 bp, Oryza sativa
aaattgcaaagagggacgtacttggaacaaatttgtgatcaatggtgcatttgtttatagagctaaccgtctatgcattccagttggttccgttcgtcttttgttgatacaggaagcgcatggaggagggttgatgggacatttggagctaagaagatggaagatgttttggccttgcatttcttttgaccaaggatgagaaaagatgttgagaggttcgtggcacgttgcaccacttgtcagaaagctcagtctcgtttgaatccacatggtttgtatatgcctcttcctgtaccttctattccttgggcatatatttctatggactttattttgggattgcctagaactaagagggggagggatagcatttttgttgtggtgaatcgtttttctaagatggcacattttataccatgtcataaaagtgatgatgatgttcatattgctgatctgtttttgcatgagattgttcgcttgcatggtatgccttctactattgtttcagatcgtgatgcaaaattcttaagtcatttttggtgcacgctatggaacaagttgggtacaaagctattgttttctacaacatgtcaccgacaaacagatggacaaacggaggtaatcaaccgcactttgggtaccatgttgagggctattttgaagaaaaaattgatgatgtgggaagaatgtttgcctcatgtggagcttgcatagagtcgggcaacacattctactaccaagttaagtccttttcaggtagtgtatggtttcaaccctaatgctcctattgatattttgcctttacctactagtgagagggttcataatgatgctaaggcacgcgctgaatttattttgaaaatgcatgagtcaaccaagctcaacattgaaaagatgactgaaaagtatagaattgctgatagtaaaggtaggcaagaggttaagcttgaaccgggtggtttagtttggttgcacttgagaaaggatagatttccggaattgagaaagtctaagttgatgcctcgtgctgatggtccttttaaaattgttgagaagatgaatgataatgcatataaacttgagttgcctcccgagtttggggttagtcccacgtttaacatttcagatttgaagccatacttgggagaagaggatgagcttgagtcgaggatgacttcaattcaagagggggaggatgatgcgaacatcactacctcggatacacacatcaatcctccaacggtcattcaaggaccgataacaagtgctcgtgtgcgacaattaaatttagaggtgagctcgttcctatgttcttctttgtatgaattcgagaatagattgctacctaatgattatattgtgattaggaacaatggaggggacaaggtgtcgcaactgagaaaattaccttttcccgaacgctagtgtattaatccccgtcccaggaaaagccggggtacaccacacaaacatgatacaaaaggcacatctttattatatcgataatatttacattattacaaaggcacttcaggcctgacatataaaaataaatagcagcggactagcgggcctacggctccatcttcacaggcgctcaactggggtataagccagaactccacctaggacttcttctccaaagcttctcttactgaaggggggggggaaagatagagcaagaatgagtacaaccacagtactcagcaagccacaccggtagatgcatgattaatgcaagggggtacaaggggtaataatataggggttaaattttgcagtaaacagcatttaaaagacacgtagttgctcaaagctactttgtacacacgatcctagagctacacaatatttattaaacaaggccgtgaacccacacgaacccgccttaacccaaggcctacaatgattcagaccgaactggcaacccgaccctgggtcccagctcgtcccaagccaacccaggccaaccattccacattttagttgttaagcaggttttaagaattaaaacactaacttgggtacattgctaggcttgcccatatccgagggcgcggctattcgaatagatttactctgatcagaggtgtacatctttacccacaagacacatcttcctcacgtgtaaccacgtgccacataccaccacggcatacggacgaaagacgtgacatagttcccaacccatcctagccataaacaagagtatcgacccaaccccgcctacggccagaacccccgggataggtaggtaggattgagcccctagcagcaggacaccagccctgtgccatgacatctcgactaccgggacgcagctcgtgtagccttcatctatcctagagatgtccatcgacccccgaattcgtcaatctccatccgtgtacctttgtttataaccagactgagccacaaactgagccttacccactagatatgtggaagtacggtagtgctttgcaacagaggcccgagcttaatccttatagtggccggggtgctacttcccacaactggcatgcacccaaaccccaccggaaaacaggttttaggggttttgaaagagaagagaggtgtatgtcctattccaccataatccaaccattccaaagtgtccaagtgatatgagaattcccaaagtctaaagttataaaaccacctaatgttgcctaattaaccagcgcagcatctacctaagttcatactagtggaaccataaatagagtacccactagttggggttttattttcctagggtgaacaaggtaataataacaatagcaataataataaggccataagaaaggtaaataggcatggctaaataaaacagtgataacgcgggaatttacataaagcgataatgcattaatttaaatcaaaataattttataaactgggattcaatatgctcaaggatgatgtgacttgccttgctcaaagagaatggccttccgaaccttcggcgatgaccacgaaccacgcttcgggaacctccagaacgacgaaagctacgcgaagcacacaagcaaactacaagcctataaagaagcaataacaatacataaaaagaaagcacatggttctttaggttataacaaacattaggagacttgaacgggtcgattcggagttcgtatgaccaagatatgatcatccgaagtttaatgctgttacatggagatttacggattattataattaggttttacaactataaaacatgtgaaagcgctagcctggaaaagacaggaaggctgtgctgttgacatgcggaccccacatgtcaacctaaaggaccacggtagaccgagtacacggagacggtctacgggtcgacggaagcagacgctgtgtgtcaaccgaggcgagtggccgacaaacggactccactagacaccacgcgggctgcacacgtggaaacaacgcggctaccgagcgggcacactaacacggtcaccacacgcacacagggacgactaccgacaccggtacacgggtaccggggccgacatccgcacaacgggcacgggctgacaccgaaaggacgaggacggggcagcgagggagagggatccttacctccatgcgacgaggcgtgggaacgacaacgacgaacgggcgcggcggatacggacgagaacgacggagacgaacggtgaggggacacttcggcggcgatccttggacgaaggcgagacgcggccggcacaaggcttgacgacgcggagccgaggatgaagacgagcacggcttgacggagggacgaacaccacgatgatgaggacgacgaccgggaccggcgaggaggcgacgagggcagccggcagcagctgcacggagacgaggacggcgtgggacacgacggaggtggcacaacgagatgacgagccagcgaggaggaacgaccgaccagaggagtcgtcgacgagtacgaacggagatgacgacaacgaacaccgacaaggctcgggtggaggggaggcgaggccgagggcgaccttgccgctgcgatgccggaggtggtggtggcgcggccgacggcgcacgggtggaggaagggccgaccggggaaattccggcgaggcggatggagaggccggcgcggcacggcagtgttccggcgaaatcgagggcaggccggggtagagggcgatgtggcgacgtcgagggaggatggcgacgacgacagccgccgcaccggcgaggtggcacaggcggctggaggcggtggagtggtggcgacatcactggtcgtcggcgaggaggtggctccgatgttttccctgcgaaacggaggcgacgccggggaagaggaggcggctgctacaccggggaaggcgactgcacggccgaccggcgtgctgacactgcggcaggggcggttggaggtggccggcgctcggagagagagagggaggaggcggggaggggtggtgcggccacgggaagacgcgggaggaggctaaaacgatagaacggagggaggatgctccattttataggcgcggggagggagccgggcatgggagagggcggaacggcgatgggaaacacggccggtggccatggaaagaggttggaaagtccgcggccgttccgggcgatggacggcgccattcaagcggaaaattagggggaattgaagaggaaggaatggggattaattccctccaattaatttggaaagaatggttggatttttcgggaaatggcgctagggttttttgggagagagagaggaggccgggcggctggaggaagaagacgacgaccgccgcgtgtgccccacgcgggcgcgcggtcagcgcgcgtgcaacgcgcgtgcgtacgcgggaggggagcggctcgggtagggggggcgcggcttgggccgggcgatcggcccaggaggagaggagggagaggtggcccgggggagagagggaggaggagggagctgggccgatgggaaggagggaggggcagcccaagagagagagagggaaggaaaaagagagggagaagatggagacttgggccgcaggctgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgcttcgttttgggcccgtgagtacttgatggaaagctctcgaagtcctccttccaacggatccagcatcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagtaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttctttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagcttttgttgctcggtgagtttttatcttcctataaccagaaaatagccatacaaaaaaaattcgtatcattacctagccatactgtgccattgcattgttcttttcagtttttgctttgttgaattttgtgttgcattgtcacgtcgtgttgctggtcttagcgtctagttcgtttagagtttcgagttctggtcacgttttgtaccacagtcgtagctgccaccgtgtctctgttgttgtcgggacctacgaaaacggaatcggctcgctgccacggttctatttttgtagttttcagaagtttctgtcggttagttttggagttcttgagttgcatctagtgtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccagtcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattataattttgggtttagacttttacatttgagtccctataaattttatatttatgtttgagtccctgtaatcttacattaaggtccttgagtcagtttttgttaaaaaaaataagaaaaaaagtgagaaaaaaaaaggcagaaaggtgcaaaaaaaaaagaaaaaaaaagccgcaccaaaaaaaaatcagaaaagaaaaggaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgagatttgagctgccagtacctagtagttgataggagcgtgtatattcttgtgtatgtttcttgtttgctgctacccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtgccggttctgcatctttttggtggcatactgtggggaataagcttgaaacttgggatgaatgcaaaatactgatgagaaaaagatttatgttttcatactatagacgtgctctccttgagaaatgggaacatctaaaacaaggtgacaaaactgttagggagtactttcatgattttaaaatttgtatcacttatagtggtttacaagaatctaatgagaacacaatgactagatttttcagagggcttaatttcaatattcaggctgggcttgttaatgtgacatataatcatataggccaattgttcatgctcgcttgcattgttgagcgcaaaattttggagaatccaatggagcaacaagatatgcttgtgcctcctatcactgatgttttgcag

SEQ ID NO: 63784 - DNA, 7827 bp, Oryza sativa
atatgctcacacctcatgccgatgctcagtacaaaggcctatgaccttggtggttgtgtaaaatggacttataaattattcctgtttctatagtttatagagaaagtagctgcagacaccaagtctacatgtgatggcagtactgcagtaatagtaaaggcgtcttgcataaaaaaaaaacatatagctaacaaactagcaagacaacatggatagaattgctttagaagagcaccggaaaacttgagcattagcgactgcacagaaatggtgaattcggtaattccagtggttaaaagcaaatgagtttgttcagtgaacagctttgaagaagagaagcatgttagtacctgagaaggttgttgacttgacctctgagatggtgattgcgaagcaacatacttcaaaacgtcaaagaatgtattctgtcctacagtagcagccttttgaaaataaaggacaactacatcggtggctcgagctctcaactcaagcaaattacggtcaatttcattctcatgctgtgaaatatatggcctaaagaaagtcccataaatgtaggtagttccctacaatgaaggcaaatgtcaatccaatgtacagaaaaaacatctaaaaatagaagctataggtgacaaatcgagtacctttgtcttagggtaccacaagtatataaagaacatcagctttgcttccgagtaaaatggtagccttcaacacgatcatatgcatggtgcaactaatgttagagactgttaaaaagagatgaaaaatgcaaacgttggcagtcttaccatgatattgtaaaatctccaaatctctccataaccgtcatcagagctactagaatcctagacacaggcacagcaaataaaagctaaatgtctcgcaaatactaatgaaggataatgtcatgatcaaagatgaaagaatcatcttaccaatactgacaccaaaatatgagctgctcaatctctggtttattcagttcgacagtcttgtagcactcatatgctggataggcgtagccaaaggccaacctacatgcaataggcataagccagatcataaatgacatatccatgctctatttgttatccagaccataaacaaaatgtatgtacattctttccgagtaaaatgatttagaggaaaacgattgctctttttttttcttgttttttttttgttgcgctccaaactaatccatagaagagcagttgaccatttcgagggtgcgttgaattgagcatctgagcatcattgaagaggctaaattttcaacgcacttgcattaaagaggagaactcacaatacgcatcttgatctacgagacatgatcaggcttacattatagaacaactgcagatgaagcatgccaaaagaacaaagcttctgaatttcgggtttatttgttcaaatcggagcctaaaaactgagcttcagctaatagtacagaacgtcagaatcattatccattcttagattccgatagacaagatcatgcgacaggaatcttgaaaaaaagaatcaatctgttaagaataaacgaaagcctttgaccgttgtgcaatgcattgaaaatttggtcccatcctcctcgtgaacaataaacatcatatatttttcgaatgcgtagcgggctctcacctcccgatttcaagccgaagaatcaggtgaacaaatcgacacgaagaaacgcatctcgcgatttgttgttttcaaacaaaatagcatatactattaggggggggggggggtgaaagaacagagagacaaaatagtaaaggagactctgccctccgaatggacacacatgcatcctcatctcaagaaactgaaaccaaaaccggagacccaatgcctttgacaacttccatacccaaaatatcaacttcgcaagagcacatttcaagattcagggggaaggggagggaaatgcttacaggaggacccgggagaggaatccgcccatcatcttctccgacgtcctgcgcacatccagatccaacagaaccgacacgaatcagaacacaccatcagcagcaacgaatttccaagagaggacgcaaaagaatctgcaaaagaaacctcttttggagatggatccggcgaggagcggcgaaacggagagggcggagagagatggtcaggagctcgccaccctcccctgttccctctccctctacgctatccctccctcctctatcgcggcttaactaaatataccggcaatgcggtggtggttttgccgagatgaggaggaggagaagagagagagagccggagaagaggcgagcacgtccgccgtcagctcgagctccaaccaaccggaccccttcctgtttctttttgtatcaccgggttataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaataagtggatgtacctggaacatatctttaaccaattataaatgcgccatgtctacctctctctctctctatctctttctctcgtgttgggaaaaataatgtttcaacgcccactaattttttttaactcgaatgcgatgcgacacattctttcatcgcacgaacctttcctcctgatgcaaccgttgaatcatcatctggtttaggtttttcttccccttcagtgtggttatgttgcaatgattgccggtgaatcatcatctttaattaggttcaccgtgatgagggaggcttcactccgccgtacaatcatggcgttgatctcgtcagtagctttttcccttcatgaccaactgcatcctgaccccgcgtgatgaaaggccaaagtggcaaagtggttaagccggtagagagcagagcaaaccagaggcagctttgaacacacggctcgcctcagcctcccgcacacagcactgctattcttgtgcggatcgatcggcagcagcatgggttggatcatggtgatggatggtagccgtgggatgggagcggtagccggtggtaggtcatgagtgacaaagctagtaggacacgcaccgcgaatctggccggatctgagcaaaaacctcgctctcgcgccgtgcgcgagaaacgtcacgaactcacgcgtgcctccaagccgtgcgtggcccgggcggctccccctgcgcggcgcggccgcacatgcgcgccgcctgctcgctctcgagctgatgagcgaatgctcgcgtagagacgggacgagaggacgagagaggaggggtttgttttgtcggttgggaggcgcacgcacgtgagcctgcacgtttcgggcttttggatggcatcccatgattgccgtgcatgggcgggcgacgagacgaggaggggggctaaatctgggtttatactgagattatatacctacctgcctagctacctgcctttttgcctcggtgtagtatgtggtattcccgacaaatacattacctttgctggcttgatgcctctaaaattaggacatgtggatccgatcgatcagcgtcgcatctaggtgcgtgtttgttgcagtggggagctccttttctatactttgggaaatcaacatgtatgtgctttagttaactttataaatctcgaaatcgcataaacaattcgcgttttacagataagcacgggagaatctgcgaatgatcggatcaactcgtttatttgagtggaaaggatcttgcaacttgcaaccgccaacatcatcaactccttttgttagcgaccaagggggtgattatgcccatggattgctgaaatacgtgcgtcatgtcagatgcatgtctctgttgcccggagcgtagctgtcagcttatctggttatacttatacggcagtatggcgcccatgttctctccctagtacagttttgtcctacgttatgtcctgtgtgtctggctgtatcgcttgtaacaattgatgccatgaagttacatgaactctgtacagtacactctaatgtaccgtaatttatcttgccattagctgatgagttgaggacggctgatgtagatctgttctttcccgttgttcctctgccttggcactcatcgttcatttttctctattgatagatgggcctttggaatcataattggtaggtgaggggataggcagtttagtgatcggtcactaatgtcatggatgcattgacactgatacgtttcagcagtgttcagttggttggtttgttcttatgtcacggcaacctaaccctacttattgtctttattattttattatcataattgcctccattcccggtccccaccatgcagataggtagtggccactggccacatcatgtacgtataaggccctgtttagtccataaaataaaaatttttacactatcacatcgaatgtttgaacacatgtatagagtattaaatataggaaaaaaaaccaattacacaaatggcgtgtaaattgcgagacgaatcttttgagcctaattgtgccatgatttgataatgtattgctatagtaaacatttgttaatgacatattaattaggcttaataaattcgtcttgtagttttctggcggaatctgtaatctgttttgttattagactacgtttaatactttaaatatgtgaccgtatatccgatgtgacaatcaaatccaaaaattttccccacctaaataagacctaagcttcacgaacaaaactgcgcaagtaatttctctaacaggtgtggacaccaacatactctgcactagtagtggttattaaaatttgaccaattacagatcaaagtgcaaatatataatttcaggcagttggcaaccataggtcttgtgtatactgtctagtccaatctttgctcactttatcagtgtgagatcatctgtgatgtagtctgtatcatcaattaaccagcggaagtttgttatttaggctcatctaactgccccttgacggtattgttatactagtattattttggcatatgaatccaggatcatcaattttatccactaaattaaagatagcctaacacacctataacagtgtggaatagtttcctgagtggtgggcataatcattttcctgatctcactccaaaccaactcaaatggtccacatttgcagaacttaggccacctgattttgaaacaactgaaatataagatgaatttgaaagtttggagcagctgcagccttcagcacactctgtattcgtgtgcagtaaaaaaaaaatccatttgctcacaatcataaaaataatattaaatccgatcgtcgcaaaggaaccaacaccaaacagaccaaaagaagacagattgtgcccgaaggaaatcacaaacttcctttcgtgaaacaaagctgctgcattagatccccttttgatttttctagattagatccatctcacactcatacaccgctttactacctctatatcatggacgcaatcacctttgctagataggccctcacccacctgcctttgctgctagcttcagaaacggataacgatacgtactttagccataaaaagatgatttcatctaagcatcgagctgaagtactagttatacaactctaacggatagtgagttcgttcagtcggagacagagtgcagtccagcagagttcagagtttcagatggcttgtgcgacacaagttgtgtctgcttcagatggaattggaatagtgactgcacgttaacgactgcacacaatttcgaccgtccatttttacgatcaacggtccaaatgtaaagctacagtaaccgatgtgaacagcattttgtgctgtagtattactgtattactactacagtactgtgaacagtacgctgctcgctcaggccgtccgatttgtatccgatgatgcataccgctactgcttaagttgcagtcgctccaaatcccttgagatgggcctctaggaggtgaggcccaagttggaagacgcccacatccaaaattagagcggggataaacgcagaaatgctattaggcgcagttttgttgatttcgtcgcagaataagcatgctaatgtacggttagaaaacaaggcagattaacgacgcatgcacatatatataatctatataaactttatttatttcgttttatttgcacaatacatctgtgtttcactagtagagaaaccatctttggtcggtcgacccaaatccacaatagtcccggttccattaaaaaccggaactaaaaatgatttttagtcctttttaataagaggaagatctttaatcccggttgtcgttaaaaatgattttaactccaacagagactaaagttcatttttagtcccggttgattccatgtcaggccgtgtcagggccctatgatctttagtcccggttagtaacaccaaccgggactaaaaacctatttttagttccggttggtgttactaaccgggaataaaaatcaaaacacactatataatccatagtaccgatcctcttttcccgtccacacaacaaactcctccctctatctctttttttcctctctaacttcttatctctttccttatctctaactcccctcctctctttccttttttccttcaccacagtgcaggcggccggcgcggcggcggcgcggcggtgccgggggctgcgcggaggcggtagctgcggtgggcggccgctcggcggcgaccggcacggcgctggccggccagcgcggaggggaggaggggaggcggcagtggtcgccggccggattttttttctttttttagatgtgaatctatgatgtatttttgtgtgagatgtgaatctgtgatgaattttttagaaccctgtgatataatttttttaagagtttgtgatgtatttggagatgatttgtttgaggattttgagatgttctgtaatatgtgatgatttggatatgggaggggatggtgtgaaatcaatattcaatattaaaagcagaaaaaaaagaaaaaatatctttagtcccggttggtgttatcaacccgccccaaccgggactaaagatgctcccaaccgggactaaagattgatttttagtcccagttaagatagcgatctttagtcccggattcctagtcccggttgaaaaaccgggactacaggagggttaccaacccggactcccccaactttctccgccagtgtttcttcgtagcagtaaaactgaagctccttgtaaagcatgcaggccaagccattcgattttagtagcttccaaacaagatcggccgatctatatacttatactaagctggattggggcacatctgatcagtgacagaataggttgagttcggacggtcttgccgcagaggcccagaatcaccctgatcgaggaggaaggacgccatagggcctttgagagccggcacaggcagtcagtggcgcccctgctggatagatcctccagcggtgggcaacactgttgcctagcctggcttggatttagtaccagatcgaataacgagag

SEQ ID NO: 63785 - DNA, 3054 bp, Oryza sativa
cggacgtccatttctcgatccaacggtagtttccaagtttctactacatatgtggtttgcactacatattttcctcagataagtcaaatattattcacagcataatacttgggccgaggatggctgttggtctgggcttccagtcacgccaaaacggcccacagagtccactcataggatagctaccattattgttcagagtttcagatacgaaaatacaaagtctacaagtcaatgcagttatgtcagataaagttgatgccgtgtgattggcgatggcgatggcgatgttctcgtcctctccagggagaatggtttgggagcttggaatcatctgttatccaccttgtcaatgcgtctcaaaatcgatcagcatcatcttcagaaattcgccaaaaacgtgtaaacagatatgtgaccttataatagcattccagatcatacatactttattaaaaaaaattattactatgcagagcatctgaatgacatagcacacagaactacttagaccctgtttagatgggactaaaacttttaagtccctatcacatcagatgtttgaaaattaattataaatattaaacgtggactattaataaaacccatccataatcttggactaattcacgagacgaatctattaagcctaattaatccatgattagcctatgtgatgctacagtaaacattctctaattatggattaatcaggcttaaaaaaaattgtctcgtaaattagctttcatttatgtaattagttttataagtagtctatatttaatactataaattagtgtctaaatacagggactaaagttaagtccctggatccaaacaccaccttagtacaaaaatgaagcaaacctgacatactactagacttgactacagacacggagaacgcaatattacattacacagtacagtagagactcgattacactacaactgaactcgatgaagctaggaacggttagatatatatccaatctaaatttgatcaagaaattaattaaacacagccgagataatatccaaacccattccgatgctaccccaaatgcatgatgaagaaatccattatccatgtgttatgtgtatcatcacttggtccatggatttcaggatgcccaaatatatgcaatgaaaatgaagctttgatccgttcgggaaatcatgcagtaccctttgtacttgatctcgaccagctctcgccggcgccgctacgattcttacgatttcgccacggcggcgccgccgccaccgtcgccatcacaggtggtgatggatatatcaagcacgagctgcgccccgcgcagccgccggagctcagatgcttgcatggcttcctccgtccgtggctcacatcacggagcaggaggtgggatcctcctccatcgaggggtagaatgggacgccgccgccggcgccggcgcgggggcgaaactgcggctgctgcggcggcggcggcggcccggccgccttcttgcctctcctccgtttgcctcccttccctccgttctgctgctgcccgccgcccttgttccatccaccattgttgttgccgttcttgccggtgttgaagatctcccgctgcgactgcgtcgacgaaccaatggagaagaagattggtcagctcagctcgatcaattggataaagaaaaaaactaggattagtttgatgattcatcatccatgtgtcttactgagttgtttgcgcggcgttgattaggttgatcgcgagagccagcggcgacggcgagcttgtcgagcttcttctcgatgcggctgccgttcgcggcctggcggtcgatcttctcctcgatgcggacgccattggcggcctggaggtcgacgaggcagttgctgatcctggcgttgacgtcggcgaacttggcggcgagcccgtcgccggtgacgagcatgagcggccaggacaggcagccgccgccgctctggcaggactcgacaagctggagcgcgtcgtcgagggcgcccctgagccggcgcaggatgttcgccgccgtcgcgtcgcccctcgccaccgccttggagttggagtccggtaggatcttggcgacctgctgggcgcgctcggcgagctccttgcagctcgccgcgttccggcgagccgtgctcaccgccttcgagatcgcctgcaccactttcacgatcgcgcccaccgagtccatctcttgatgacttgctgatcaacgatcacctgctgcttggtttcgctaatgttgttgggtgttcttgcaagaggtggaagacgagtagcgctcaacttattgtcatgttgccattgacggctgggccacacggagttggtgctacgacggcacaacgctaacgccagaatgggaaatttaactattcgccactcttatgacatggcaattaacgatttgccacaccctgtcaatgacatgtgggccctcgtatgtctatgacatgtggacctagtggcaaatcgttaagcaacatccgtaagagtggcaaatagttaaaagcccccgccagaattggggttgggatagtaggtaatttttcgtttaccattaacacttttatataagagatttgttctagtccaataaaatatatctgaaggtatcgatacctcacggtacggtacgaaattgttttcgatgactggtacctcaagactctcttcgtgtatttgcattttgccgtgcgatgcaggaccgtctccaaatgatgagaaagctatgacccgtgatcaagtatagtgttgcataagacaagacactgtgacggagtatttggactgacgtttactcactcagtggaaaatcagtgggctgagtagaggatgactacaagtcaacggtcaatggagcttcggctacgcggtggttagttttggttgcttgctttccccgcggtttcttgagaaaatttgcaaattgccaaggagacgggcatggagtagtttaacaattattctatttcgccacgtttacttcagtgaggatgataggagtacggggcatgagcttactaaaactagcaataatttttttaata

SEQ ID NO: 63786 - DNA, 1072 bp, Oryza sativa
ccggatcggctccgtgagaaacgcagccgccaaacggccacaagcgcacgttctctcttcacgtgagaaccaagtcttcagtgattgactcgatcagcagaggttgttgtatgcaagcatcttttcatcaacacatgctgatcgtgcggctaagcattaggcatttaaattgatgaaatgatcaatgtctccaagcatgttatttccatcacaacctgctgagtcagcacgcagggcccatatgtcagtgacttctctctttctcctcccctctctcctccctcaattctctctccacctcatctcctcctgcagttcccctcttttccatgacatggcggcagccgagtaggccacggggcggtgagctttggggtaggaccgtaggagagaggggaaccaagcagcaaggccgataaatttctgctactgatgcttcgtcggtgcctcttctctcttctagagctccagggccctttctccccattgtgttgctgcgagatagtcgtgtacacaatgacgactttgaaaagatgtgcattcaaaagtagaagaataaattaacaaaagaaaattgtttagtagttagcaatttaataagatttttttagatgacttgaatattttgatatcacgctaactcgcgaacacaccagattaatattcttttttatgaaacacatcaaagatttgtatattcatatgtatgcatccatccacttttaataagttttgggattatttctgctcagaactaaagcaagcgagcacgcgaatgaaaaaaatgggaacgagatacaatgtcagccatgttgtgtttagtgtgttaccaaaaagaaaaaaaaaagaaaaggttggcccacaaacagtgacacagtggctacatcggacatgaaagctctctaaatatgggcggaaaagaaaatctcacgctcgtaagctcaaacaagacaagcccagctttcttcccaacttgttttcgaaatgagttgagcccaagctggctcgcgagccattcgtttggctcgtttagctcgcatatctagcctagccagcatagcccattttgtag

SEQ ID NO: 63787 - DNA, 2012 bp, Oryza sativa
agttccttcctcaattctccatacccatctcaccaaaattcccatgtctcccaatcaaacaaaacaattaataacctcatccctctaaactccaaatccctcctaaaaactccctccaaccaaacgggctgtgagagttcacacagaatccagaatccagctaaggctgtgtttagatccaaacttccaactttttccatcacatcaacctgtcatacacacacaattttcagtcacatcgtaccaattttaacccaaacttccaactttggaaggaataaacacagcctaatctgcataagctcctacttactgtatctgcataagctgcaccgtacacctctgtacttgtctactgtaacctgacacacttctaacagtagtaacatggatcgatctctgtccatactcctgcaaattatcctaacaccataatctaatcaatcacccacgaccctgtgtccccccatcagatcagatcatactaattctctgaaagtttctcccattatgcatgcacattgcactgacagtgagtgacgaatgctactacagcattcatggctcgctagtacagtacagctgctgagctgcatctgcaggtgcatctcccctaaaaagaaaaatcatctgctactaataataatcagattcagacgccgactgaaatcccactgttcgcgctagcgtccattcggtgcagagacaccggcatgtgctccccaagaatccgctccattttcttttcctctcttttctctggaactcagctgattgttttattctgaattctgatcagaaaaagggccagagcatcgtgtgatgattgagctgtaaatgagatcaagctggatcgtattcagacagcagattggcgactctgatctgatcacgcttgctatagctagcttgtgatgattgatgattgatgattgattgattgattgcccggtcccagagcctgcatttgcatcagccagctttctttgctcgtcatggacagtggcagcagcagctgcagcagacagcccacgcctgggtgctcatgtgggaggtcgctgcatatctagcagaatcgcaatccacatttcctcctgcggatatctctccctgtctccctccctccccctcccaaatccaatcagtcagctcctgcatcacattgctgaatttattattaatgcttgcttgcttgcagcactagcattctactggtatttgttcttcagttcttcatgtctctctgaacttctgaagctgaagtgagactgtgcagccatttcttgtgccaaactgtcactcttcagtttcttcttcgctggtctcctcttgtatttatgggtttggaggtttcttggttttggctcggctgctgcgcgtgaatcgattggtgagttggagccaagaacctgaaatcttcccatttctccattcttcgcttcgatttcagtatttgttttcacctgtcatattcttccctgttcttaatctgttccattgcctttcccctctcgtgattaacgactccgggttcatcgccgctcgcagttcggatttctacacatcaaggagaaacaaatctttggtgattcagctagggtttaatagtcctcccaagaattgcggcgctggaggttatcgaggattgcccaagatgaagatggagtctttcgcttggttgctgttgattcttgttctattctcgattttggaggatgtgcgaggatcaaaatccaagccgatcttgatcaactgcggctcagattccaccaccgatgttgatggcaggagatggattggggattcttctcccaagaacttcacactcagcttaccaggaacagttgccacagctccagattctgatgggaaagagacatatggagatttgtacaagaatgcccggatcttcaatgcatcctcaagctacaagttcatcgtcgccgctgccgggagctactttctccggctccatttcagtcagctacccactaatttcagcaccaaagaat

SEQ ID NO: 63788 - DNA, 35806 bp, Oryza sativa
cgcccaccagatcccgcgcctccaccgctggaggggctcgccgtgcaccggagagcgtgcagtaggccggcgctaggcgtcgcccaccccttccgtcgctgccgcctacgacaaccgccgccgccgttgtcgccgccaggagggaggagaggagaggagtgtggccgggagagagaggagaggagtgaagccaggagatgaagtgtgaggtgggagagacaaagatagggggagggtagaataaaaaatggggtggacgaatatttcacatacgtgtgggtgagttaagagacccgcttgcgaaaatacccttatttttgcgtgcggatgttttaagtgagccatttggaaacatcgatttttttcgtacgggtctcttatggagccgtattcgaaaatgagggctgatttttatagacgcggacacttatggcccatctgcaacctattagattgcttgtccaggaaaatcatttttgaactagtggggaaacattgttagtaccgggtttggttctgaagatcctgtctagattcgttatactagtatgtgttacatatagtacaaggttgctatattttggtacggagagtaaagtctatcgacccaacaacaagctacaagctataaaaagataaagaaattgttaaatatgtgatccgaattttgggcccataatatattcggattgattttctaggagaactccatgtctatcctacgtttgtaatcaactcctctgcagtgatcattgccggtcggcgcccgtggtttttttctgcaagggtttttcacataaaacttcgtatctctgttgtacatctttttttcataacagaaatgacaagtaaaagtttacacgaactaaaagtacgggtctcccattcccatgtgtcacatggttagcgccatgtgaccgtactttgcttccattctccgtttctcccccaacccattactgtattgtttactctatttgagactagtccaatagctaataattatagttcggaaccctgtgcttacttgtctatatattgtatcgaagactgatctgatcttaccgtaactagaagggaacgcagcatgcatccgcgcacacagacatgactataaacatgacttgagcataaattttattagttaaattcagagtaagtatattattggttgaaaatttcctataattccatttaacataaaatggtgattttagaacattgtgtgataaagaaagcattccacaaactaattcaaaagataagaaaaattaactaattgcccatagggtgccaatttccccgctggggctaggaccccagcctaatgggggcagaggccaagtcaggtttcacacccatgggtgagcggcggtgggggaggttatattcaccctcgggtgacccagcggggccccaggctattagcgcgcgatgctgcaaccaccctccgtctctccttctccttcgagtcgtcggcttgccctgcctatcaaagcatgacgccgcaaccacccttcgtcccttcccctcatcggagctgcggggcccactcaactgtcgggtcctctacaggggcgggggtggctcaggttattcacccggtggccaatgtgaggccgggagcggggagaaatgtgggggcgttcctgcccaacctggccccgccccaccccgctgccactcctaattgccattggaatattgtactccatgttcataccattacttgcctggtatcgcacatgtacattaattaaaatataaccatcaggtttataccatggtcgctaatagtatgtaaataggttcacctaatttgtcattttttatagaatcaactgattaaaaagatagatcaggttagcttcgaacgtgggctataagcctgttgagctaatgaaatgtaaagcacgtgcatagacgctgattaaatgtaaagcacatgcataaactacattaccactaagtttagatcttgtcctgtgttgttctttcagttgtagcttccaagctgtgcatatctcaaacattgtttggttcactctcaaacattgccaaacctaaggggttgtttggttcactctcaaacattgccaaacctccatgccaaacatagccaaatctgtggcttataaattgatggctacaccttaggcaacttttggctataagatgggtgtatgacatgtgagcctttgaattgaaaaactttggcatgccacaactttggaagtgaaacaaacaagtatcctagaaagtgtggtaaagtttggcaaagtgagggagtgaaccaaacagcctctcagtgcaatcgtgcaacctcctttgtgtaccgttggattgaagatggatggtccagatcgagcacctcatccctatcgcacattttgcaaaaaaaccgcccgcctctcattgtctttttatgttttggttcttggactcaacttcctttctctttgtatcgtcccactcttctcaccaagtaaaaaaatttactcacaccagtatccaggagtaaaaatttactcacgcttaaagtcgggagtgaaaattttagtcatgcttaaaaccaaagatttactcacatctataatcagagtaaaaaatttactcatgcctaaagtcgggagtgaaaattttactcatgcttaaaaccaataacaaatttactcatgccccaaacttccatgcttgaactttgtcaatatcttgcctcgataaagagaagaacaatggctgattgagcggagtgccagaactaatactgaattaatcacggttggatctcgttggtcttttcctattagaaggtggaggcaagctccaaatggtgtttaaatgagctcttgttggtgtggagctcgagcacgggtggatgcgtgcaatcggcggatcgagcttgtgtggtagaccaagctcgagtgtggatggacgaccaccttagcctgtggatcggtggatgtagatcaagaagtggagtggcttggtcggagaaaagggaaggaagaagaagatgaggcagaggagagcgaagagggcaaaattgacttttcagctgtctccactgttcctcagctagttggatacattattttagtacccactgtgtcttgtagcaaatatccacacaattatagtgcccataagcaaaaaccggttttcattgtgtcttctagtaaatatcacattattaagtgttcactagcaaattttacataaaaaaaattgtgggagttagatcgatctcaactacccatagaaactgcacgtacgttgcctggagaaacaatataaacttccattggctctaaatgattaattccaaaacctaaacaggctgtagcgcatatttatagtgttgattactcggcgtatcgatcggagctcttcatactagcaagctagcttgtgtcgttaggatcgaattgcacaattcgtgcagtccaacctaagatggcctgcctgcagctgcaggttcttctcctcctcgcctgcctgctgcttgatgctcctcatcttagtagtgctgcagccacagttccaacaccacccttctccttcaacttcgacttctccaacatgtccacatacaagccggatgacttgagatttgagggcaacgcgactgtgcacggcagcttcgtcgacctcacctgcaacgcatatgggctggacatctctcagtgcacggctgggcggatgtcgtacaatcacccggtgcccttctacgaccaaaccaccaaggaggttgccagcttctccacacagttcaccttcaagattattgtaccaagatttaacaacgacaaggagaagggagatggtatggctttcttccttgcacgttacccatcaagaatgcctccagattcaggcggcggcagccttggtctcatcaccaacaacaactatagtagctttggcccggaccagttcgtatccgtcgagtttgacacgtacaacaacacctgggagcagcctaagcagactggtgaccatatgggcatcaacatcaacacagtcactttttcgactaacacaacaagtgtatccagcttcagcccgaatgagagcatgatgaaggcgtccatcacctttgacagcaagacctcgatgctggtcgcctctctgcagtataccggtaattattctaactatgcccctgttaacgtcagtgcgaaactcccagatcctacgaccttgctcccgtcggaggtggcagtgggattttctgcagccaccggggcagccttcgagctccatcaaatacactcatggtctttcaactcaactattgctgccccggtacaaaaaggtatatatgcagttactacatctcttgaattgattgttggattaatgcattgtactcgttggaggtacttctgacgcagcaattgacaccttagtagtttgtattttttttgaatgaatttgtaatgcagcaattgacaccgatctgccgtaacatcgatgcagatcacaagaaagccattgccgtaggggtctcaattggaggaggtctcatattggtgctcctggtgtggtctattctctcatggtggaagtggagaaaaacaaaccgtgaatttgacaagggaactcgtggggcttgtcggttcaactaccaccgcttggctgctgcaacaaaccatttttcaatggataataggattggagcaggtacgttcggtgaagtacacaaaggtttcttgacacaattgggccgtgaagtggctgttaagaagatcttgagggaatccagagcaggaaacaaggacttttttgacgaagtccagaccatcagtagagcaaagcagaagaatcttgttgaacttcttggttggggaatgaagggcagctcgatcattgatttcgtcatgtgctggcgtaggcagaagaacaccgaccttttcctggtatatgaatttgtggataacggcaacctacatatgcacctgtatgagaaggaggccctgctgtcatggagaataaggtacatgctgcgagctgagcaatataatttatattcaaattttaagaacctagctaggtattattatattactaccgcacacataaccccaaaaattattgtctaataatgttttacaaaactccaccatgtccatgttgagcataatttttctaaaaataaaatatagattgtatatgaaaattgtaattactgatttcttgactaaggttgatagtttaacttttcactgctttaaaaaaattattttagatatgtttaaattaaatgacatttcaataatacctatatatgggttttctgccacatagaccctaaaacatgttgtttcctggaagtaactattttgaatatggaagtttgaaaaaacgagctagtaatgttgacaatcattatgtacgttcctcggaacaagaaaatgattatgcatgcaaatgttgtcttttcaggtataaaatagtgaagggcattatcagcgctcttgtttaccttcaccatgatagacatccatacattcttcacagggatatcaaaccgagcaacatactcttggacaaaaatttcaatgctagattagcagatttcgggctgtcgagaactgccgacaatggaacaatacaatcgtcaatggttgtaggaacggaaaattacttggatccagagtgcaggaagacgggaaagttcaaccgtagctcagatgtcttcagcttcgggctcgttctgctagagattgcttgcaagaaagacgagaatagctatgcacaagtctgggaaaggtacatcgacaaaactctgatgcaggctgctgacgataggttacaaggtgcgttcgataagaggcagatggagcgtgtgatcgtcttggggctgtggtgttgtcagcctaatattgagatgcgacctacgatggagaaagcaatggatttcctggagagtgatgggccgttgcctaaactggccaaacccgaaattacctcctcaagtgcgccaagcaattgaactgaacaggatcagtcgaaatgtataagttgaaagtaagcaagtcacaccagatatattgtgttttacattggatttttttttctttccttttaattagtttgggcatgtggaagttatcacgtacatagaggggttgcagttgtgttaatttgcttgtggctgtagtcatcgtacatgtacatgtggagtcagtttttgtatagccacagactattcagagtttcagacgtgggatgttgtgttatttgccgccgtggcatcaggagtcttttgtacgtttgttttggattcacgattgagtataaaagaaaacaagaaaacgccgcagtcgttgtgcggcaccatatttttttttccctcgctttcctttttttcccactcccagctggtgaaaggatgacgatcttttcactcaccattctctccctcgaaacccccagcttgtttagcaactcgaggaaaggggattgggagtttacacgaggaaattgatggtgaggttaagatgggaatttgatttttaatcccagtatcttgtttggaagaggtggtggaaattgatagggagtttagggcttgtttggtacagctccaactcctaaatataactccaagagttgagtctggagtggagttgtggagctgcctacattttgtgagagagctccacccaactccacttctagttttggtggagctgaaactgtttagctgagctctagctccaggagaggtggagttggagctggagttatgccaaacaggcccttagttagagattaggtcattaatgaaaatagatggctgagatttgtttacgcagagtaaaggaggaatttcctcccaattaccaccccctaccgagtattgaaaaggagggagttcctccctcaattccccatcctcatcccaccaaaatttccatgtaacccaaccaaacaaaacagttaatagcctcatccctctaaactcccaatccctcctaaaaactccctccaaccaatcgaggtgacgttcagcctcatagccaagaacccaatattcggtgccacatcggcaatactcggtgccaaaacaggtactcggagccaaacttggatactcgttcttcgaatgaaaaaagtagggagaagctgggagaaagtgtcatggagggcggagcctcgcgcgagtggcttcgcgcaggcatcggcggtgagcgcgtagtactccagtgacaaggatgggagctcgtcgaacggcgtcatcaccgcgtgaccgtccagatgcccccaccgtccatcgctcccgtgctagaggaggaggaggaggagaaggaggggaggtgcggcggaggagaagagaagaggacatccggcgtcgattcggagctggcgagctcaatctgccgacggcgccgtcgctgctagggccgcccgacgttgttatcaccgctcgcgcctcgcgccgccctcgatccgccaccgcgtcgtcgcctttagggctgcctggtgccgctcgggctgtcctggcacttgcaccgcccttgatccgtgttatctaggtcgccgctagggctgcccagcgccgttcgggccgtcccgctgcttgcgcctcgcgctgcccgactgctccatcactgctcatctccgtctcgccatcagcctcggttcctctggtgggggatgaaaagagaggagaaagaggggacttcctctggtgaggaataaaaaaagggcgaggagagagggagagttaaaaataaaaaagatggtacctgtgggacccattacaagcaacttgcactgtggaacatatagcttaacacgttcttggtctatgtggcatgtgagaaacggcaaaaacgagcaacgcactgctaatgccataagataatcgattctaagaaacttccggaggggattttgtagtgcgattctctctttgtaggtgatggtgcacatagaggatgatcgcctgcaataccttttgtatcaagtgaactcactcaactacaccgactgctcaagaaaatcataagtaatataaaatcagtcttaaataaataacttcaataaaccagtagaaagaaataaactaaatcgtaactgatcattaatagaaaacggagacttctccaattctgtgtgcagatctctgtatggccacaacgaatgtcagagcacgattaatgcgagacttggtgggtgggctcatcccgtcaagtttgaatatcatcgccaactcggccaaaacttttactccttaggcagcatgccctattgaagctacgagccgcgttgcacgagtagcgtcctcctgcaaatggtccgggggagagtggaaagaacagaaacacttgaggacgggagagaagggcctacccagcaacgtctagagcatatctgccgttgatgagcacctccacgccatgaggttgataggatggcgggtgaaggagagctcaccttcattgcctccacaaccatcatcccaatcatcacaatttgtggcctcctcgagtgagagagagagacagctagttccggcgttcgttggtgggacggggagaagatggtactggaagaggagcggtaaggggtttgcggggagtgagagagtgccatttttttgacaaattatcttttcaaaaacttatttcaaaactagaccttgctaaaacttcaaccaaaaatgcttagtgaccttagcgccaggcccattggcaccgaacccccgccaatatggtgcccaagaagatccgctcgccgacgggccaggatcatagtgccgaccaccacgacgctaaggtgcccaacctcagcaccaagcatgttggcgctaaggtaatggaattaaccccatgcgcggccacacccagccgccttcttcctctcctctcctctcctctgcctaggatttgtacgacggagccaccctcttctctctttcccaaatgtacgcaaatccaccccaaatcgaaggggaatttatgggtagtgcgttagagattgatttgcacggtgaagtccctctgaaaaccctaatttccctaatgtttgcccatgtattgagtattttgattgaaaccgtggttaatttgttaaacgtggcacaggatgcgttgtgaattacggaatgtgggtcggcatgtaaccatgtgatgttgaggttgactagtgcagcactacgtggctgcccaacaaaagagttgtgttaggcagatcggtaacgtggcaaaatcctaaaccttagcgctaatgcggctggcgctatggttgagctgagtagcgccatttaggcttgggggcctcacttcacgaacctaccacatcagcgaggcgatgggctcaagctatatgtggacaggggattcaggaccaacatgcctagcattgagctgtaggacctcagggccgaggctgctggcgttgaggtcacggatcatttctagttaaataagtttttgaaaagggctaaattgtcaaaaaggaagagagtggtggcggggagagtggggatcaaaacagcgagggattatggatatatatgcaggtcttttttatcacaatgtctaaattatatgaagtttcaataattatctaatagagagtattacatgggttgaaaaatagtgtctaggggctaaaacgaaaaaaaaacactaaaatgtggtttgaagaggtggcggatatcggttctagtgaaaataagttactgaccattgttcaatagaaaaacaaaatgtttcctaatagcaaaaaatgagatgataattttcgttactagtgcaaatgaaagttatttgtatacaaaaatataatactcttgaaaatgatgattcttctagatctaagaatgtttgttttgatccaaccaacggtatatgtacatacaatatctacttaatttacatattatcagcgaagaaattgggggtacaattaattataccctcgtgtcctagagggtgggctcgtcccatgcggcacaacttttcttcatgaggacctccattaattgtccatgccctactttatttggatcttccactgcctctttgccgaccgattaacttctcttttccttttctttttcaaatcggaagttaaccgagtactggtcagtacatgtaatttcataaaacagggtaatatagtcaagggtttcactttgatgtcattttcaaccatatctttttttttttgcaaagttgccaaaaaaatatcgaacgtttagtttgttgtcaaatttgctaaatacattagaaatcctgtcaaaattttagcaatattgctatcctgctaaaatttggtaaggtttattttggttacaacctgaacaggccccaaatcattcgcaaatgtcctaagttatttgaggagacggagtgcttgctaatgcacatgtcacttgtgcacacagagtaacctttgggaaaagctcccaattgaatactcgagggattcatgcccaagtggatatatacgatcccaagctgcatcgtaattaatctctatagatatactatatcaaactaccaacgaggccagcccgattgacgaagttgcattataagttggtacttgggactgtataggcattaagaaaggtttcatctggaaggttagaagtaacagatcaatcacaggcatgcattatcttgattagatttgggcaattactatatgcatacttcaagggagataattattaaggacgagagagctacaggaagcaaagtacaagataagaactactgtagtgtattgaaccaattagggaccaaattaggcaatgctcataaaacaaggcaagatttgcatcatagctgtctgtacatcctcctcaacttccatgaaaccgtgagcgccgttgcattgcagggaagcgtaaggctagcagcctaccaaagctaggcagatatattagacgaacgcagagacgatggtgaaatgtgatgatcgatatatgtcgagtgtctctgataaggtaatcgcttattcaaatacgcaaaagttatctaggaaaattatgaaatagagtagaatttgcggtgggtccataaagttagaccgtaatatcactttggtccgcagtctttaaattgctctcatctatatccgtaatctagatttgatgttacaatatatccataacacctttggttgtccacggtagctggaacaaacttgtatagctatagtgcacatagctattcatctatctcttctcaattctcctcctttatattagcacggcggctctaggacgaggtattctgaaggggactaaggtggccagaagtgctctaaaaactgggtgtccactgttagggttggaggaaatttgttgctacagtgtctaagagagagctgaaaagtagcaaaactatggtcagcatggatatccacgtaggcagttcatcatagcaaatcaatatacacctttggatctgttgtgatacattaagcctgggttgggatgtagacaagcaatttataataatttacaagattatatctcagtccaactttaagatatataagggccgcatgaacttttataatattaccgaccatgaacttttaactatcatatataagtgcaccgcgtgacaactcaactataatatgatcttgtttcaggagttgtatggtttccttttttttaaaaaaagaacagatcactacgtaattttgtaaattagaaaattaaaaaaattctacgttctaacatatatataagcatttcaatatgttccatagaaaaaaaatctaagataaagagaaaatattttgttttagtcacttcagtcgtaaaaaaattgctttggattttcgtgcatgttggaaaccaatgcttagaattggatatattgtaataccaattttaaatctgagaaatgttaatattttacataggagagtgtaattgatctacggcgtgtgaattaccttggtacttctgattgattctaaatttctattttgttcaattacttcggaacatgggccttcagaactggcccgcacgtgattaccaaatcctttgagaattagcaatatagaacgatatcaacgaaccggcacatcactaaggccgcgttcgatagcgtgagattgaggggattgggtgaaagcagcactgtagtccaccgaataatttattcatcgtgaaatgcagtctagactgtccagtgacaggtgttagacagcagtagacggcgccgtttgctactgcacagatgccattcatttgggcttaggtagctgtagcgtctttttttttctacttgcaagatgatagatatttttgctgtgtcaaatagtagttacagcgttctattaaaagtagtgacgacaaatgcagaaaaaaaaatattgcaatttgacatatgggaaaaaattgttggaaaaataaaatatactccctccgttttttaatagatgacgccgttgactttttctcacatgtttgaccattcgtcttattcaaaaaatttacataattataatttattttgtgatgagttgttatatcactcataatactttaagtgtgatttatatcttatacatttgcataaaatttttgaataagatgaatggttaaacatgtgagaaaaagtcaacggcgttatctattaaaaaacggaggtagtagcaatttgagcaaagtaatgaaaaaaattattgaatacgagttggcacagtccaaagacttgaatgcagtacataatacatatatccatcacgaaatggatttcttattaaatcgtacatctaataaaaagctcgtacactgtacaggagatagttcatgtacttctacaggttctccaccgaattggcaatggcatcacggtatgcgttcatcgcttgtgcgctattgccggcgtaatacatattggagaaggggggtgccattggtgctataggattaccattatacagagggttattggcctggaagtcattttgcttgctgtcgattcggaagttgtgcaaacaaaacgctgccaatattatgtcgctctggacattcttgtatgggttgtacggtatgccttttaagattttccactgttttttcacaattccaaattgcctctcaattatattacgtagcttggcatgtatgtagttgaacttctcttcccttccttctggcggtggagcgtgtggccccttgaattgatccttgtggtaccgtacacgtgggtacggtgccaggaagcccatcctactcggatatccggagtcaacaagaagatattttcctacaaaataataaggaagttatacatgaaaactatcagtgcacaattaatgaagtgctatatggtgtacaaatgtagtacttacgaaaaggtagtcttggaaactcctctggataagagtcaatagcttcgtttaggactcgattgtcatgcactgatcctggccatccggcatcggcaaatataactctaccatcgaatccaacaattgttaggacattttttgttgtctcgtcatggcgattcatgtgttctatggcactatccacaccaacagtgaccggaatgtgtgtgccgtcaacagcacctacagcaaactggaatggtccaaaacgactatcttgtagtaggcgacgagggatgtccgtaaaattcggatcaattggcttgagtattttcgaccctaacataaccattcggctaagaacccttcgaaaatagatagacaccgtcgagttcgaccggacccaacgattgttcgactcccttgcagaattatttcctgccattgtgaacaagaagattcctagtgcctccaaagaacttacatcattactcccatgcaggttgtaaggggcattttccaaaattacatgtagagtgtatatctgatattccgttaaacggaaaatcgcacggcactgtgcagaattcgccattgtctctagcatccaagttattccaaattgggttgggacacgatgaggagctcttggaggagcagctaaaatctcttgcatcattgcaataatagtgtcatccttatcgctcgtgtattgcccttcagtaccatacgaactccacgatgaaccgtcgctcattgtgtgattccttcgaaacaagaaaaatatttagcttacattaaccattacaacattatttgtaaaaaaatgcacgcatggtgttcaataaaaaaattaactgcataaaaaatttcacagtgacataccacaagtaccagttcagactacaagcattagaaatgagtaaagcagatgctaaaaatcatacaacaagatgctaaaatcatacaacaagagggtacaaatcatacaagaaaaaaacagttaagcagatgctaaaatcctactgcaaacagtatggtgagcattattttttatgcctctcatatgaatctcctcctctcagtgagctccaagcaactgaccaagcaagagcaactcaatagaacccattaccatctacgctaccaggacccccacctccaccagggccacccccctaccaacctccaaaccctgtatgacctcctgaacaagttggcgggggtactcctccaccataaccctgctggccagttggcgggggtgctcctacaccataacactgctgcccagttcctccttcgtatccaggctgtccacctccttggccaccagctccttttccgccaaattgcttttgccatgtctgtactatgtaatgggaccgtgactcgggtgtagggcagtaatcaatgaaccattgacgccaataagcacgctcaaatacatccagtgccataaagaataaatcactccctgggttatgtccatcagctaccaccaactggatgcaagctgctgcacttctagccctgtcctcttccaccttccgggaacggctctccatcaactccactcgcaaatcagctagccggtgcagggcatcaccggctgagtcacttcgactcttctttgaagccgatcccctcgaagtgccagcttcatctgctagcctcttgccttttcctgcacttgaaactcctggagtcgcaatgttttgttgttgagctagcagctgtgagatattgatgttgggccttggagttggctgctgaggaggtgctggtgctgcgcctgcaacagcagagtggttccctaccactgtgcgccccgaaaaaatagcacagtgaaggtcgatgtgcttgagaggggaatctttgaagacacgagctccgtcctttttctgcaaaaatggttgagtaacaaaataaatttacattgaaatgaacataagtagtttcttaaatcgattttcatttttgcattttgttgacgctttttgaactaaaaaagcagcagcatacaagtacataactaatgtacgcagtaacatagctattattggtggcaccatgttttaacatctgcagactgcaggtaacattttacctagattttacggtctaactaattcaagaaaatggaggaagtactatatgatattgatatgcattgacaataatagcagatgatgagcagactaaaaatcaaaaaactttatgccatgtaagcaatgtgacatgtcacatagaggttgatgtcatgtcaaactatggcatcaacaatagcataggaataccaaatatctcaagatatggctcagttttgttgaaaagacctacaagagaataataaaaatagtaccaaccatgcatttgctgcttcctaatcaatttattggaaggtagtgaatagaacagagaaattgtacccccattcattatagcaaaaaaattacattctgattttgtagcctagaaacacaaggttttacaaaggtacataacactttctatgaacaatatgtatgattatacctaaaaatagataactgtggagatttcatgaactaaacaaatgtcatgggtccttgtgttaatgcaaatcagtatggaaatcactatcttcctagttcgaccgaacacaacataagggtaggtgacatacctggtccttgtcttcccaccaatcgtcgtcagcaacaatggcttgagttatcgggtcacggccaatgccggtagcctttgattccagccacgtccaaagcatccaccttttacgacattgacgccatatgtacttcacttgatccttggtgaggtttcttccgattctctccttcatcttctgtatgaggttcttgtagccttgcggctttggacaagtggatgttatggtcattgcggacaactcctccaagcatgcctcaagaaatatgccaatttcatcgtcgctccatcggattttaccctccgccatctaccacccaatgttaacaaagcacaaatgcaatggatcaaaaacaaattacaatgggcattaccttttgtggcgagatgggccggatcaggtccaaatcgagggaccgaacaaccgtcgccggcaacacacgacggacgaaagagcgaacgccttctggggaggtcgcacaaacggctgttaggaagcgggcggccacattgatgtcattgtcacaaggaggggcagagctggcgtcagatttgccagaggcgctcgaccccgtccccgaatccagattgatgagcagtccgtgaggagccggtgcggcgaacgccaaaggcacagcctaccccttggctgcagtcgacggatggatgtcctcccctctcttccactttgttcccctggtgcccattgtccacccggagaaggaggcctcaaataggaggccggaggcgagaagaaagcttccaactctgccgaatcttgacgacactgtgacacccgagagcactccaccgagtacagccgcatgcggccaaagctgcagagcctgatgagcagctaggtgacgcagacaacaccggcagcgctccccgacttccgcctggcttgatggcagctccgccagagaatcccctttctccggcctcgattcgccttttcagcagctcccgtgacgagtggtcgatttctccgtgtgcctaacagccccaggctgaccacgacgaccaccggacgaggctcagcagtagggcacaacgattccagccacgacgactgcgcgtggagccgtcgacgaccgagaaaatttggcgaaggaagaaggggatcgatgggagagagagagagcgagcatggctgcttgcgctggtggtgggttggggacggatgggccgacgaatcgatccatccaaatgccgtctgtgccgtttgtacaggtgccacgtttagtcaccaacgccatttaatatgcagtaaattattcagacatatacagtgctgaacagtgcacaattcaccaaatcccctcgatctctcgctatcgaacgcggcctaagttcacacatcctatacacataaatttccttgcacatgattaatgcacaccaactaagaaatatcgtaaaaaattctagaaaaagtacaaataatacggaaactcaggactgcgtttaaaatgggatggagttagcactttgctaattagttgctccttacctagcatagttattggtatttatctctttcatcaaaagccgtaagtagttaatattactatttcttatcccaccaaaacttcccccctaagctcctgggtaacggcgagcttgtctgttatagctagtagcgaagcaagggtgcaacaaaatcaagataaaaatctataacaatttaccagctattggggagataaagtacaatcgtacaacatattaatgttatcgttagttacaaattattgcaagttgcagcatgggtcagtttctagaaggtatagtaggaatttcacttcaaattttgtattatatattttctaggaactgttttagctcttatcggaacttggatatatattatgtgtggcaagaatagttagaaataggaatatatagggtgtatatatattgtgaaataagatcagaattcaagattaaatatgttgaagttaaaataccttcaatttctttatccttatccccaactttcattctaatcctaatgacagactctttgatattacataaatactagctagagtaattaatttaatttaactgatgtgctgtgatgaaggtgctgttcaatcccatgcatcaggttggatccgcccctagtttctcactatcaccattcgaggtagatacctcctagggtaccggatctaggctagaagccctagagaatattcataagattattaatttgtaatggagaacaaagtatggaatataccctagaatatacactcatataatatatactgtagctaattacttccacttgcctaaaaaaatatctctatttatacaaacatcttagtgttagagttagttaattcattatctagaaaaaaagagttagttcattcattgccatatagatgaagatgatagacgattataaatgaattgaacgttacaaagttgaaaatttacaatgttaaaaaggttaaataagaaatgatggtgaagaaagttacggaaagatcgcaataatctattacatatcccagacatcgtccgcggatccctatttgaagactttttaattcctctaaaaaaactatgcgtatgtgtacatatctattttttcaacatacaatataatcacagtattaatttactcaagagccactttagatttaagtgtataatcctatttatcgtcgtaaacacggggaacaaaacatgacacgtatgggataattggcatctaagattaatcgtttaatttcataactgaactagtgttttaattttttttttgaattaaactagtgttttaattaagatgggtcgtctagagatttggttttataggaatctttttttccatgtagtcatgtattatccgtttcaacatataagtatttactagaaaaatacccgtgcattgcgacgggtaaatactgttttaattttattattgttatacagtttagttatggtaaaattcactgtgggaattcgtttcgatttatttttaaaaaatcatgagctgcagttaggagtccgacttttcatctcaagttagtaggtggagttttctaaagagatttcttatatgactgattttgtatttttaaaagcaaacgagcttaaaatcgaattcaaacacgcatatatattttcccaaagcaaatgatcttaaaagccggcttaaacacggatgacataccaaaataacgacaaaaacatattcaaattttacaatagtcactactggagaaccccacaatactcccggttcgcaaccctctcttttcctgggtatgcaaccagatactcaatctttagttccggttaaaataaacgagactaaagatatatagatctttagtgctggtttgtgggctaaatgtttttctattgtttttttctgtttgcatattgattttaagccaaactcatcacaaatcgtagatcacaaattaattcacatatcaaaataacaacacaaattcacatttcattgacatcacaaaatcacatactcaataaaattcacagattcatacacaacatcaccacacatcgcagattcacataaacaacaacaaaaaaaaaaacaagcgctgggagggagacgagctgtcaccgcccgcggctgcctaggtagccgcggccctctgcccggccgtaattgccgcggctcttcgaggccgccgcctcccgccgccacccacagctaccccttgtgccaccctcgtgccgccgccgccgccgcccctcgtgcgggcccacgtgaggccgccgcccagccgcctgtcgcggggccggctcactccgctgccgcccgccggaaggggaggggaggagggggaagagagggggccggatctgaggagaagaggaggagaaaagagataaggtgttgaagggatcgagacgagggattatatcggagagaaagaaggctgccaggaagtgcgccgatcagggttgattttaatttccggttgtttaacaactgggactaaatatagatctttagtcccgattggtagcaccctcttcctgcggcaggctgcatccaagatgacgacagtgactgccccaatccctctcgggtgcggtgggcggtgaggcggacgacggtggaggtagcggcagtggtgacaacattgactcgggagctagggtttctacgggttgtgggctagggtttcgatcggtttggagttctgaattttttaagtgggtgcatgcaggccgcctagccacatgcatgtccatctgaaaattgatttctgtactagtgaagtattaaaaatttgataaatcgatttatttgatttatttttaatatatatatatatataatatttctttaaaagaacaaaccttttatcggtttgagaggtgtgttcataataaacaagcgaatcacaaaatccaaactcaggttatagtaagtacgtaccgtaccatgagttgtcctgctgtgcatataaaactgccatgactctaaacaatttcccaacaaaaacggcttataaaagcacgtaggctctctatatatagccgatcagcttccagctcttcatcccagcttgcatcgttaccaattccaccttcactcgaccactccaacaaaacatggacatctctcacctcctcctacgcttcttcctcctcctcctcctcctcctcctcgccttctcgctcgacgatgctccccatcaccattgcactgaagctgcagcaacaactcttcctccaccaccaccaccaccattctccttcaaattcgacttctccaacacctacacctaccgcctagaagacctccgattcgagggcacggccgccgtgcacggcgccaccgtcgacctcacctgcaacgtcgcccagtgcacgacggggcgcatgtcctacggccgcgctgtgccactctgggacagagccaccaacgaggtggccagcttcgccaccgagttcgccttcaagatcgtcaccccggacaacgtggccaggggagacggcatggccttcttcctctccagctacccctcacgcgtcccccccaaccccagcggccagagcttcggcctcatcgccggcgacgccgaccacgccggcgacggcccggaccggttcatcgccgtcgagttcgacacatacgatgacaccttcgaacggccgaggccggccggagaccacatcggcatcgatgtcagcagcgtcgccgactcgattaacacgacgagcttgaacttcagcaggaacggggccatgagggcgtccatcaccttcgacaatgtcaccaggatgctggtcgccaccgtgcagtttactgatcagactactgcttcgcgtgctgcccctgttcaggtgagtgcgaaacttggagatcccagggcgttgctgccatcggaggtggccgtgggattttctacggcgaacggcgcaacattccagctcgatcagatactgtcatggtcgttcaactccactcttgcgtctccacatcccgtaaccaaaggtaagcaacagcgactctctccataccaaaatatataagaagttttagaattggatacggttattaagaataggcatagaattaaacgggaagatgttgtgattggttgagaagtagaggtaagtgagaaaaataaatgttggagggttctgattggttgggaagagaatgctgatggaaaaattgttatattttgggacggatgaagtataactttgaatagtttcagttttatttttgggtaaaaaagaaagtcgacatgttcttttctgccaagaaaatattttttattttccaaaatctggaaaactaacgaattcgtgaatttcaaatatcttcattcaaaaattcacaaatacttttagctatagtaagatttagaacagatagcacatttatttggtatatatacagcttgttttttatcccgttaaatttgttgttgattaatccgcggttacatgcattatgcctaggtgtgttagcggcattgatatttgtgatcacttgcatccatgttcattttccacgtgatgtgccggtatattgggaatctattcagctcaggattatttttttattgatgcaatttgcactgatattgatgcacatgcaaatgcaagtcattattccattccaaattacacacgctttcgtggcttatccatatttttctgcattttgctcctactatagaaaccacatgttttacagatggctagatataaacaaaaggaaaatgccacattctttagttacgaatgcaacacttttttccaatggccaaatgccttttttttcttagttatctttatttatttcctatggagaatgtaagggtagaattgacattttaaatgttgaatttgcatatgcaggtgatgtggcatgtacacgtggcatttagcctttgcatctgaccgaacaccattaattgttgcatttatgtatgcagcctttggaaatcaatttccacgcatcgagtttttctatacaaaagaggggaaaataatttgtatattcaaatgattttgtgtgaaatacatgtgcgtacagcgtattcaaacccagaacctccggttgcccgcgtagcctccatagcatctgacctacaaaagcacttcctacttcaatggacatgctacctggtcacatagaaaaaatatcatcaacaaaaaaaaatatggatctcgtcaaagtctacaacttttatgtataacactgtgtccatctaaggtagtttaaaactctcttaaaaatcagtgatccaaatagatatgaaactgctaacgtaatttggagtatgtaattgatctataatttttaatataaagtttttatttatccgatttcatagaaaaaattatgtaaaaaatgcacgtatgagtggaatcattttcagagagacacagtcactcaaaacaactgtcccaacaaataaggctatatttattcattttcaaagagaagaacttaaaacaaccgtatctgagagtcaattttcatcttaatagagtcaattttaaaggtcttccatgaccgcgggcccctgacatagtgcatagtagtgtaacaaaagagtcgacccacttcaaaaaatagttatttttgttggtgtgcatgaaccgattattggcacatgctggacttaggaataaccagtccccatttttaaatccatagggcgactccccatcattgaatatggtctcaccgatcacttatccattttatatctctcctcctatggacctacatctttcaatattcctagcattgaggtcaaattatatagctacaaagcaaattcattttgcacctcatgttattatcatttattttcaataacgcacatctagctaattactaataaatacctgtaaatctgttatcatggcaccatggatatgcaggtcatcacaaaaagaaaggggcagcaggaaagtttgcgattgttggagctcccatatttttgcttctggtgtggtctatcctatcatggtggaaatggagaagctcaagccgcgacattgacaagagaactggaggtgttaggcagttcaagtacaacgagttggctgctgcaacgaatcagttctcctctgagaataggctgattggagctggtccgttcggtgaaggctacaagggtttcttcaaggaaatgggccgtcatgttgcgattaagaagatttcgaaggagagcagatcagaaggaagtaataaggacttctatgacgaagtgaaaaccatcagcagtgcaaagcacaagaatctcgttgaacttgtcggttggtgcgtgaagcgtagatggaacatgtttgatttcatgtgctggtgtagggagaaggcccataccattttcttggtgtatgaatttgtggataacagtaacctccgtgttcacctgcacgagaaggaggctgtgcttccatggacaacgaggtacctgtacatctacttgatgagcgatgctgtttaatttcctttttgaaacatggaagtaaataattaaagtggtatcaaaattaagtctttaacatgagatattttacgttgcttgagaaagtacacttaaaattttggtacgtcgagatactaataggtaccaagttttaaactagaaaatttggtacgatcccggtgtcttcttaaggttgtaaaattgtctctttaatttaacatattgtctatgcatgtatcatctgtcaggtataaaatagtgaaggacatttgcgcagctctggttcacctccaccatgaaagacgtccattcgtccttcacagaaatatcaaaccaaacaacatactcctggacaaagagttcaacgccaagctagcagacttcgggctgtccagaactgctgacaaggtaggcaaggccagatacctggatccagaatgcaaaaagacgggaaagttcaagcgcagctcggatgtctacagctttgggattgttctgctagagattgcgtgcaagaaggatgaaaatagctttgcgaaagtgtggagccggtatctagagaagtctctgatgcaggtagctgatgacaggttaagaggtgagtttgatgagaggcagatggagcgtgtcatcatcttggggttatggtgttgtcagcccaatattgacatgcggcctaccgtgcaacaagcaatggatttcctggagagtgatgggccattgcctgaattggctgaaccggagacctcctcaagtaaaattggtaactaagagtagtattagtcctgctctaccagcaggatcaggcgaagaactgctggacttagttaataaatgcttggattaatacgagcataattttttattgttgtgattcctgcaagttattgtatcttctacatccatttatgtttctaatcagttgtgtcattgcctacttcgctttgagatttggatagatagcagcattttgggtaaactatgaaataagcccgcccacatactccccactactgtgctctatttatattaccaccctagttagtggtaggataaatgtggagggatattattttttaaaaaatggtctggagaggtataagcatcatttagcaatgaccaagctttcactactacagaaagggtaaaaggtgccggtcgaaaccctagctaataagtgccggttttccgaaccggcattaaggaggcgttttgacctaaaaaccggtacctatatggtttaaataggtgccagttctaagccagattgcaacgtaactgttaaataggtgccggtttttagtttaaaaccggcaccaatacggtcctaataggcgtcggttcaagcctaaaaactggcacctatttattgggtcaaaaaaattatagtaaattcatccacacaaccccaattccatataaacccaaatttatccccacagccccacatccatacagcacattcattcacattcacattcatcaacacaaataaaaacctacgagccattaatcacaacatataaaaacctacaagcctaagtcaaaattcgaaagtccaaaatttcctatctttaaatcctaaacatttgcatatataacctaactcaaaatatacctagtttaaaattcctaagtcaaaagattgtaagtctaaaatttttaagtccaaaaaattctaagtctaaattgtgaacattaatttgcacatatatccttaggtcagaaattcaaaagtctaaaattcatcagtccagaaaagtataagtgtaaattctagacatttccatataatttacattcatatcctcgagtaaagagcaaaagagatattgctgggactcagcgtgccagtcaactttagcctgagacgtgcccgtcaaaccacacgaaggcagcgaccggatgtgttacacatcccaggagacttgactaaatcgctagagctctataacatctcaaatgctttaaacatttacatatatatcgtaactgaaaaattcctaggtctagaatatctaagaattcataagtgcaaaaatataaacgtgattgttttttacctccaacatggggtgagcatatgattttaaaagtttcttgtcctcaagtcatcgagcctataatagaaagcataaaatagaatccataataatagtaaatattgaaatgcattacacataaagtacacttccatagttcattcataaagactaattaaatacattttttcacataaatctagctagttggtttttcttttcctaggagttaatttcttcgtggcttggtcccgagggggagggacagaagattgcactcgttgtgggaccttgtcgatgttgtattcgccacttttgccctgaaaaaactttgaactcatttttttaaaactttcacctaaacttaataaacattcatatcaaatttaataaaaccttcaactcgattttttgaaattttcagctcaaattttatgaaattttcaactcgattgtttagaatctgagcttgtttagaatctaaaacagaaacttcataggatggtaaatagcaaccaaaatggacaaaataaaattacacaaaatttatcttagatgccacttggtttaccatactagacttgccattttcctatgacgggaactcagcgaccacttcaaaataaactggagcgtctgaactgccggagtctaaacgacaaacaaggcacacaataaatacaagctataaagctactaaaacagcaaaacaaaccaattttaatggattcttggcattttaacgaattcactgcaatttgaatgggttaaaacggagcgcagattatttagttatgaattttacaagatactttgtgttattactaataacaaaaaaccttagttaatttacagagattagagcccaaaaggaatgtaggatcaaaggatagattgactggcaaacgagcctcacgagatacggactcaacaagtcacttccacgtgacacgggatcacccaaatcatcaactgagaccggcgagcggaatcggtggctctaaacggctctaacttaaggacgattcgggatggacgaacgaacgaaccacaggggacaccttgttcgaacgaacgagcggacgactcaacaacgactgcacgctagacacgattcacgataaagcctcggtacggcaaacaataggctggtaagaacctagggttgcaccgacggctaggcaactcaactacggagctacggctaaagcggcggctaggcaaagacgcacggcggaggcatggcacgtggcgcaacggcagcggctcggcagcagcggaggctaggcggctcttctcggtggcggcagcggcccagcatggcggcgataggagcggcggtgcggcggcggcacttggcagcaacgcagcacaacggctagggagcggcagcggctagggcacggcaatggctcggctagggcgcaacagctgcgacgcagctactatgacacacgggaaccaaataccaacaggagggagcttctcaccggggtgcaaaaccggcgagggaacacgacgacggcggcggtggtctggcagcaagcacaagatcgatgacggtgcggcgctagagaggacacaacgggctaggttagacagcgagacaatcgacattgggtttaaccaattcaattgagagggataatggattactggcgacgcgagggcgacgacggcgacggtggcggcgcgacagctagggcagcagtggtgatggcgcgctagggcggcggtggcacctagctaggacggcggcggcggcgggctagggcggcgcggcagctaggggaggaaaatgaaagaaaacagtgagggaacacttaaataggggaggactagattaggaaaggaggagtcctagagggagttggactagaaggaggggagggagaccgactcgggcaaggggagggaaggcgtgcgtggcatgacgtgggagagggtgcggccggctgggggaggggaaggaaaaaaggaaactaggggagactaggactttcccaaaaaggaaaaacaatccggtgctgttttaggaaaagaaaggaaacagtcctgcgaactgacactgatacggttcgtcatgcaaaacgaaactgcggactgagagggaagtgaattgtgcacaactcacgaccaaaggcaaaggaaggaaattattatcttgacacttttaacttagcaacattgcctccagtgatcgaatatttactctttaagtcctgttagtgattttcagagtaaagagaattcgaagaaaattctctctggcaattccgattattaaatgcattgttaactggggttttctcttggttaacccaagcaaattcttgaagtcattttttagcgatttggaacctaagggaagggaaaactccaggtgtgacacgacggctagggtttgacgacgtaggaaaatagaaaaaaggagggggtatgatgacttatataggtggaggtggagttggattaggttagggtgggttcggcggtaatgcgcgcaaagagagggagggcgcggcggcttcggcagccaagtaggagagggtgcgggcgcgcaggccaagagggagagggggaaagaattatggtgggagggggaatccaaataggaaatgagagggaaacggtgccatttcgggaaaggaaaagaattaggagtcatcttgtcataaaaaacgaaaccgcggcgacaaaggggttggcggatacgaggaaccgcgaacgaggagagtgaatcgggaatgattcacgaccaaaggaaagagagaggaaacaattttgaattcaaatcctggcatttttctttaagttaacattattacttcctctgctctgactattccttttaaagtcctgctattgatttaaagcaaaaataatttgaaaaaaatactccctgactattctaattattaaccgtattgttaattagggttttcctcctggttaaacatagtgttttctatagacgatttgtcaatgatttagaaactttctccctaactattccaattatattgttaattagggtattcctcctgactgtattgctaattagggttttcctcctggttaattaaacatagtgttttctatagacgatttgtcaatgatttagaaaaactttctccctgactattccaattatattgctaattagggtttcctcctggttaaacatagcgtgatttgtcaatgatttagaaaaactttctccctgactattccaattatattgctaattagggttttcctcctggttaaacatagtgttttctatagacgatttctcctagttaaacatagtgttttctatagatgatttctcctggttaaacatagtgttttctatagacgatttatcaatgatttagaaactacggaaaagggaaaaactccgagtgtgaccttttgacacgtgtgacgtgcacacgcgcctcacgatgcgaggccggagagcgcccgcttgtgttccctttgttctcttcatctcatctcagatgcctgaagtggccaagagacaatcctcccttataaggaggtctctatctcctagaatagccaatgtggtactaaagtcatcatgcatgccatcctataatgtaggattttgtgatttttcgaacaattaatcgttgaatgtactaaggcacatccattaattccaacattagaaacgtagcaatacctccattttcataaaaagtaaaacttctactttgatcgaaatgaaaaaaaaatccatttgcttcatcgaatcagccgaaattgcatgtttccatgttggaatttcttagtttggactttaccctattatattttttacgttttttactctttttgagtttttcgtttctttgtttcgaacagggcctaatgactagagaaccaaatagtctaacacactacatccatcttaaaatatagttcatccatcacaaaataattaaacctattatgagatgtgacacgaagactacaaatctagacaaagccctccgttctggtttaatactaatttgtatcattatattagatttgtttatatggcatcgaaagaaaaagatttgtttatatgggatagagggagtaagatataagggagtactcttatactactcgtcccaaactatagcaacctaaaaccagataagatatattctactattataaatctggacatggacatgttcagaatcctagtagtaaaatatgtcaattaagttttagtaattgtttagaggaagtatatattttaatcagagattgaaatttcggtttgaaaattttgaaatttcggtaatttcggacccccacggcatgacaatatctcagcagaaatttttggtttttctcaattttttgtgaatttagtcaaaatttagtcaaattcagttaaattatgtcaaattttcagaaaatttcggccgaaaaattactgatattttggaaatttcagttctactggaatggcgagaatttgagccaaaatcgaaattgaaaaccctgattttaataaggaagttaatactatgttggtactcaattatattcatggggtgggcacacaggacgtacggtgtgcacctggcggcagaacagcccattaatgggcttgtttactggctttcttctctttgtgggctcgaccatgtcgcttgtgtggaattgaagcgtacaacaaattcctctgtactaatataaactcatttatatatataggaataggacagaacccactataaaaaatcttacttaagaaatgaatgtaactctccaagcgattatttcctatattttccccactttttcaatcatctgttttatgcatgcaattcatattaatttctatatttccttattcctgtgtttgcattttttgcgttctaaagaagcccttgatctcttcaaaagtacagtttcttatatttttccatcgagggaggaccaatcatgcatgtctaggttttgagctggcattattcatctatatgtacactagagaatcggtccaaaactccaaattaaagcttccaatcaatttgcgtcactgtgtcatagtcacttataaatgcatatacatgttatgagactagcatattgttgaatcaatagttgatggcaggtgcagattagatggagctgtttggtgaaactgctgacaggtgcagcttctatcagaatgttcagattccaatttatcatccacaaatctattatataaaaatccatcaaactttatataaacactcctaaaacgtcacgtagtacatttaacaacgcttctaaaccatcacttggtaacattataataagtcggcccattgttttttcctaaaaaaaaaccgatgatccactattaatatctatagatgtcataggttgaattggttaatatagcaattctttgaaccatgattaaatatttgtgcatatctgtgcaaatatgtgaaatttccatttttactatacctgcatgatttgcacagagatgtttccatataagtttgcatgcatctactttccaaattatatgtacataatcaaatccactaatttcggtgtaattgctttattctattcttcgtgtatatatatatgggcagcgatgacattccattttttacacactctagtttcatctgtccgttctgttacactccggatgtcgaccacgagattcgatgcaaccactcgtccatgagcatcattgttgacaacggtcatccgtgaccttcatcgcaactagtccttcacaatattcgtcccgatgccattgtcccaccggacgtgcccgagcttcttcgtcgcgggctgctggtcgtctgcgagatctgtggatgacattgttcgtccacgagcttcattgccacagtcaggccaccacaatcttcgtagtcaagctgttacgccaccagacatccaagagtttcttcgttgccaccactggtcatctatgagcttaatttgccgcagccactggttgtcgcgaccttctcgtcctcaagctcgttagtcggcccaatacattgttggttttgttcatggcttgggattgttttttcaaacccaaaatttgggtatacatactgttccaaagttcgattcaaattttgttaggttcgttaagatctaattcacttccaaaagtattttccatgcatcagaattacttttgggttcatgcccaatatttggatatatgcacatattcacgcgcaaaattgggtatatacaaaatacttgactatatacccaatatttgagtatatacccaatatttggttatatgtacagttctaaatttacacgtaaattgggtatatactgaatatttaagaatatacccaatatttgggtatatgtacggttctaaacttacacgtaaattgggtacatacccagttttacatgctttttttccgtttccacctaattccaaaaaaaaaaaccacgcatgtataaatgcgccaaaatgtgtgccccaaaaatcacgggtgtggtgtactttttgtctgtaagattgaaagtgagccgtactacagtaataccaaaactaatgacattataaacgataaaattagctacatctacattaccatatattcagctgcaaaatatatatacacaaataacatatttccaaatacttagtttctatgtcgccaaatactgagtttcaatattccaaaatacttcgtttctaaaatttgtttatatttttccaaataattattttccatattccaaaatgcgacattttccatgatgttagagatatataaccatttattcaaacgcgtacgtgagttttcatatttacatgatattattaccaattacatggacatgcaagatttccattctgaactttaaacacacatatggaaagtctagtaaatgggtttacacctgttaagataactaggaaggtagcccgcgcatatgcgcgtgcatcttatttaatgtacgtaaaattttatacgaatatccatgtgtggatgactttgtcttaaaatattcttttactatatctaaacaaaaaaaaagaacttgctagttataatttttcatatttacatgatattattaccaattacatgcacataaattctaaactaaaattactcgagagagtacacttctcaatttatgagaaagtattatgtcgaaacaatatatgtagttcctatgagataattttgggtattttgatttcctacagagataacttacccccaaacatttgctcacaatatccatttttttttgttagatgctatttgaagttttacatattttcattccattaccgctgctaaaagtttgaatatttctatttagaatgggtttttaaaccatttcaaaaaaaacagataaattttgtttgttttcatgtccattttttaaagaaatttggagaattccattctatgaagcatctttgaaatcttttgatctctgcaatttaggttgaaaacataagtgggttgagcctacaacttgacatggggtaaagtcatctcttctaaattatctcacttcaatagagtaagaaatattaaaatagaggtcatgtaataaatacacatttctagattgttctatactaaatgttaggagtttacaatgtagcgtagcaagtactaccaaaatgaaataaatgacatgatttttaattcctatatggaagtgactcattatattggtaaggccacctcatcattgtttcactactaagattctttgttgcaacccacatgcttatatgatcaatatgatgttcaacttagcatgtttttattttcattatgttgtctataaaaaaataactctagatggggtacacattatgactaaaaacaatatcatttaaagtttttctctaatttagtagtgacttcatagatcatatacataatttagatgctatgatcatctaaagattatttatttatctcctaagtggatcatttattgataaaaagctcaaatatcaaattgtatgggcaaatagcccccatatacatgttgagagaatttaattaagttgatagaaagttgttaggtgtccaactagatataactaatgggtgtaccagctttattaaaaattaaggtgggatatttcaattttcaatgacgaattttaatatcttctttatttagtgttggcctcaagatggatgtaggtctgcaatgtaatttttatgttggcatttaaatatggtcaatatgaatatgaaagtattgatttcactaaaaatataatagttcaaacagatcgtaagttgaatttatgatttgaaaagttataattattttaatttatgttgttccaagttatagtaagagaagaaagagaagaacagtgcgatacctggctagaccatatatgtggaaggttcatttatggtttttttctccataaagataattttaattttagttatcataaataaagataaaaataggagaaaaggaataacacacaccggacggggacagaccggaagggagggggtgtttttttataaaaaaaatgattgatctaacaacttaaaataatgtgttttgatgtttaagtcgaaaccaatggtcggatgttttgttttttctctcataattttgtatgtttttttaaacttaaaagagacccctagtggtttagaaatatttataggatgtttaatgtagttttaagtcttaaacattgtaggggcagggaggaaggaaataaggtttgggagtttttttaaataaaaatctaataacaacctaaatgataatgtctgtttaatatagttttaagtctttaacattgtaggggcagggaggaaggaaatgaggtttgggagttttttaaaataaaaatctaataacaacctaaatgatatgtccatcgatttaagtcgaaaccaatagttggatgttttgtttttaaatttttatgattttctcaaatttagaagtgtcacggggtggtttttaacgttgcatgggaacgcggagggagatttgtgattttttttgaaaagattttattttttttagattttctctaatttaagagtgctatacactccctccgtcccataaaaactcaaattagaatatgatgtgacatccaagaacaacaaatctcgacatatgtttagaaatatttatatgatgttgaataaactatttattaggagagaatatataaagagttggctatatctaataggttgatgggctttttaggcccataaaaaagtatttaattttaattgttttggggattaaaaaaagaaaggaacggtggttggagggatcgtacatatgtgcgcaccaaggctgacgtccggactccggacatagattttttttccttcgattgaagataaatctaactatcaaaattaatgagtccacctatttaaatgaaaatcaatggtcatatttttactattttattaaagtgacacatggtgactcgagagcgtttataagatgtcacatggcagtttaggagcgtttgaagaaagtttaatggacttttaatatataataagagttgtacctcacatgatcacaccgatcctgtggctcgcaaccaatgagctccacatacacgcacttgtgtttctctatgtatgtatgtatgtaaacactataccgcacccagggtatattttagaaaaacgctccataatgtctttgttcctaaggacgcttaagctgggtttgggaggtggagttaggaactccacctacccgcacgggaaacaatgttgctcattaacacatgattaa

SEQ ID NO: 63789 - DNA, 3987 bp, Oryza sativa
ttcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctaaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactttgggctatgttcagtttgatgatttttgtgagctcgataatttcaaggagaaattatttgctaagtctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacgtttttctgtgaagaaggggaggatgatgtgaccatggctactatggatacgaccattgctcatatcatgaatcaacaagaagacatcaagatcaagtcctccatgtgctgcaatctgattcggccacgtgttacattgctgacttcaaacggccgccaaatctacatacgtctccgttttgggcccgtgagtacttgatggaaagctctcgaagtcctccttccaacggatccagcctcatctcggaaatctatctcgtttggccggaatcacaaaagcaaggtactgcatcacctatattgggcctatgggcttgtaacttcatttgggaccctggcccatgtggggcccatgtggggtgcgccccaagttggtggagcacgaccctaggcacccctaggtcgtcctcccacccctatatatagctagttaccccttcagggtttctcgggtttttgttagattaaagtttagccattgctacttgcttgcagcgcgcgtgtcggctagaccgtccgtctgcttgttcttcgaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcaatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcattacaggccgagggagagagagggaggactttgggctgggctcggcccaaaggaggaaggagggtttatttttagtttttctttttagtaaactttgataattgttattgttgcttaataaatattttcggtgctctgaaaattcaagtaaaatttgagggctctttttagaccaagaagaatttgacaaaatttctccgggccacattcgaatttttcttgtacatatttagtgtttgccaatttcatttcgaattttaattaattctattattccttttagagaatgatttttaattcgggatgaatttatcaggacgtgacacaaggagacacttggagaaggacttagagccatggaggatcatcgaggacgtccaagtcaaggtagtggcccaaaccaattcgacctcgggtgcaattcggataccaggaccagtctgcactaaaacgggagcctaggtcgcatacgtgctcggattggggcattctttatatggatggaaagctaagaagataacctttccaatggttttggtcccacatccaaattatttccgagtcaatgggaatcgaccaaacaagttgacattcagaatttgttccggtgctgcgtcaccgtatttgggcctttgggccgtgtatcgtgctggaacccagtagggttgcgtcgagagtgggttgcacgaccctaaactctatatatcagtaccaccaccatctttaggtttttggggtttgcttagattaatctgtcgaggacagtttcatcgctagatcggtttgtaagaccccaactcgtgagcttaatcattcatctgcaattttggttgttttctatttctctcttgtttttgttcttcgattggcaaactgccgggtcccaaaactaatgatttggtaaccgacatgttaaaactgtatcaagccctggatcagtagattgatacaagttcaatattttggatcgtctttgcttacgtttagacatagctttgaaggagatattattacataaagtaatagggtatttacaagattgtggttaactattacagcagaagctttagaatggcctaactctgttgttttgctatagacttaaaccatctatctaatctagacttgagaattaggttgaaatgaaactaacttatatgattgaactcccagcttcggcacaaactccaaatgaactctgaaaaagggggttgaagcaagggtgagtacaacgtactcagcaagctattatatttaatcaacaatgaatgtatgaaataataatatctgtgtaaagctaggtttacttgcaaaaagcagagaatgtagaagtagaaaacctgtaatgttttaaatgcagcagtatttaataaaatttcaaattaggtttctatccaagatgccatagtgagtcccaatgctcgataaccgcgagcacggctatttgaatagttttgaggatattcatactacagtagatgtacgctttacccgcaatccatgacgtgccaaacacattagccttgtcatggcaaagcttttcagttactaacatcagtggtacctgttccatgaactctagtccccatgcactctgaacgtaacgttatcagcagcgagaggagttctggcgttcccgagggctttagagagaactgattgtatgacaccatgtcatcgcaatcagggttcacaaacaatttgtgcacaattcatttcatatatttacctgcgcctcggtaaatatcacaattgcccttcgcggcataaatttgcctcctgcacgaggacttaagaagaaccactatacagaggtaccacttttgctagataacttaatcagctaggtctatgcccatacgagaattgcggtcgtactcatatgttcttcacatgtacttggcagtcttatatcggttggaacagtactagccacccggaaatcaaccatttctaccgtactgtcccaatctaagttcattatattttatgcattctaactaggcagggctaagcaaaagctagcatatatctggtttgctatatattcaggttatgcattcaaaatcatgtatggccaatgcacaagatactggagatatagaatataggattattatgctcaaatgggaggaataataacttgccttgctccaacgcaaacaaatctgagataggcaacctgattatccgatcctcgaaacaccacaggttgccatccaaaagataatagactctactaagaaagacgaagaaccaaattcaataaaaatcatgaaatagcaagaaagtgataaacag

SEQ ID NO: 63790 - DNA, 9939 bp, Oryza sativa
acatttaaataacttaaggaaatccaaataaaatattaaaatagcaaatttggtatcaaaatgtagattttgaatttagatgaatttaagtccaaatttgactgtaatcggatctacggtttaggagatatgggcttctaaataataggttttgaattaaatagagaaaataagaagagacactatgcaggggacccacctgtcagtcttttctttttctttttctttctcttcttcttcttcccgcttcttccttcttcttctcttcagtcgaacagagaggaggaggagaggggcgtcgaggctccggtagtggagaggcagcgacgccggcggccagtggtgttcccgggtacagaacacctagggaaggaagtggtcggcaaagggggttaagggaatggctggaacggcgagcacaagaccgtgaaccgacaggagagagagagcttcggtggggcttgatatgggacgaaagagaaggggaaaagtggaaaaatgggtttgccggagtaaggcaaggttggtggtgagaggatttggttagtggtgctccggtgagagagatcggctgacggtggcggcagccggtcttgaggaagagagagagaaagacagagctcgaagagctcggatggtgtggaggggaaaaggggcgacctcatcatctatttataggccgcggaggtcggttgccgaaggcggttgtagaggcggtcgtcgactcggccacggcgacgctgtcgtgaaggaagaaaagacagtgccagcttccttctctgattggatggcgacggcggcgcgtgcacgtggtggctgccgtatggctgggcggcggcattagagaggcacggcacagcgacgccttggcgtggtcggcaagttgactgcggcggcggcgtggagagaacggcgggcggccggtttcttagcggcgaaggaaggcgttggcggcgtcgtgcgcgtgtgcaacaggcgcacctggaggcggctcggctatgggccgatttgggccggcttgggctgatgggagatgaaaaaggatttcggcccaaagtgaatagaaactgtttctgaattttgaagggggtttgggtaatggaattgaataggatttatatttgaaaagaatttgaataggaaagtttggaaggaaattatatatggatataatttccaaaagagatattttctaatttgagtgcaatatttttggaagtggaatatagtggaatttatatagatgcactcaaatgggggagagagatatatatttgagaatgtgggaggaaaatggagggaatggaataaataaaattttagcccaaaatatgtggtaggaaatctagaattaattatgggctaaaagaggttttggatttgggatggaaggatgaaatatatcttcttagcacaagagcaatatttgcaatatttgtaataatattattcttgtgccgaggaggaaatcaagccacgggaattaaattggcggctagattgaaaggaggaatttggatacttgagatttgtaaagggaactaaggataggtttggaatcaaaggatgggtcgacaattaattccaattaaaattggaatttcaaagagttggtttggagggttttcttggaccataattcatacaaatgaaaagggtttcaactaaatttgaataagaggaattttgtcgaaagaaggttttaatttaaaaccaaatcaagaaacaccttaatttaaccaaatatatctttaaatgaaaaacacaaaagaagttaaataccagagagggattttatgcaaattagttttaggaggtcctactaattatattttcctaggtttaggaagttattaaaaacataagaagcggcatgatgcataattagaaaatagctaattttcagtatgttacacaaacagggattagccttctcagcgaggtcacccacgtttcgacacgggtgataaccagaggagacgtggtgctgcgattgcggggctcaagtgtgtgcgcattcaagaagccggatcgatttgtgtcgcggctccgcccaaatcgttgtttatcagaacctttcggaagatcgggaaccctagtgcacatcactgtcattggctatcgtggccctaggacttcaactcttcttcaagggctcagcagagaaccagccgataccggtaaaaagagaaaaaccaggtcatcggctgcagatccatcggctcaagctccaaagatgaaagtcaagtcaaagaaaacgaagccaactgatgatctgcctgccctagatccatccattgaacaagctctggatgaagaagaaatcggcgaggatgttgaccaagccgcagatgaagtaagcgatactgaaagaactccatcggcttcacctaagtaaactcctcgaactccttctgccctagcccatttttcaagggtaagcaacttcccttgattccttttgtaatcacttcattttatggccgattactcacagattttatagttgcagaagaagaaaactgttgtgaagaagaaatcggcaatagcaattctcaaatcagctccaccagtaagatattcttaactcttccactagttgatctcagcctgattttatctaacacttgtctctttcgtagcctcctcctcctccttctcctgtacaacaatcatagagtgatcaaactccatcggctgtagaaagccaccatattgaagaagaagaacaaccagctgttcctgctatcccagtaagtcttgtctataaaaatcttgaatcggccaaatagctcatgttgatactcaactgttttcaaattccttcttgcaggccttagccgatctgttctctttcgatattaaagactatcttgatgaagaaacagaagaagacaccaccagcaagtctttagttcccttgtccgatgatgtgaagaaaacccttgaagacatctctcatcggctagaggcatcatcactagacaacttggtggtaaactgtgggccgattaggactcggttacacaagatccaacctctaatcccagatgagctagccgatgtcttcacttcagctgtctatcttgagcagcatcaattcaagctggaaaaagccaaattaagactagccgaacgtcgggagcgcaaggacattcaagtcaatcggctgcttgtgcacgaagagaagtccaagcttgatcagctatctgagggcccgatcaagtccaatattgatcggctcgaagcccgtaagattgagctcttggcacaacttgaagaatgcaacgccgagctggatatggaacataaaaagctagccgatctcccaaaatctatcgaagaacagaaggcaagactaaaattggccatcaagaatgttgctgatctcaccaagtctttaaaagtcatccctggaactgacactcaagatgcccaagtaattgaagaagtagaacaaatcaggcaaagggctatttcggctatccagcaatatttgtctcaatgatatcttgtgtaataggtcttagaaatttttgtaatcggctaagaaactttggctctttatcgaacttatcctcataattttatgccgattcaatagaactccatattttgctcaaaaatttgcaattttcatatatgtgcccccctaattttacaatctcaaaagcattgataaaattataacttgaactaagggcgatatgaaaaaatcggccattgtcccatcggcaaaccacaaccggttacgataagaaaaaacaactaagggcgatataacaatatcggccattgtacatcggcaaaccacaaccgagtacaatatgaaaaacaactaagggcgatataacaatatcggtcatctgaaggcgatgtaaacacatcggctatcatgtatcggcaacattagccgatcatgcgttaacccaaacacttgggtaatatttcttcaagtacttgccatttagtgctcgtccataaacttctccatcgagtccttgcaacatgtaagctcccttagacataactctatagatttggaacggtccttcccaattcggtgaccacttgccgaatttgctatcccgactcccaatcggcaaaatcaacttccatacaagttcaccttccgaaatagttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtaaaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttattactggtgggtaggcgaacggtcgcttgagcgggctatatattcctgttgctctatccttttcaccgccacacttgccattttaccgtgcgcgctctctttctccatctcttcctttcacagcgtctttcgacccctcaggcgtttcgccgaatctcttttttcgccaccgcaaacgcaccgttcgccatggctccacgtaagccaaaccctacttcggtgaaagggccggatcccggccgagtcgatgacgacagcaccgcctttctgggggtctctcttgtggacgacgtcgagctagcgaagctggtcagctccggagggttggttgaggggcaggctttcgccctagggaaaaccgtggtgccgaaacctgtcgacaaccggacggtggtgttcgccgtattttttgaggcagggctacggtttccctgcaacgtgttgttgccggagatccttcgcctctttgaggtggaacttccacagctgagcccgttagcgcttgttcagatcgctatcttcgactgggcgtgccggacttccgagtttgagcccaacgccgagctctttggcgccatatttttcgccaccgtgaactcgaagaaggtaatcaccctggctggaacgaaaaaaaccgtgttcgggagcgtgaacttcaacgttcgccccgagcggtccgatctctggccggtgaacgctgctatgtcgaagtgggaccgccattggatggcgaggtggttctaccacaccatccctttcgaggctggttctgaatcagcgaaagccctccggtgccggcgtagggtgattgcgccgaaccggagacccaagatcgctgtggacggcgccatggaggcgcggttcgttctactgcggaaggtttgctcccgccttagctgccgtgacttggtggaggaattttgtatgcttcgcatttttcccctctcccagtcatggcaagtcgcggttgaacaaggcgaagaagtcaacggtttgccgaacctgatactccctgaggggcgaacagtaagactgttctattgctatatactgctgtgctttgttatttcgccttatttgacttttgacgtagcttcacgctctacttttacagtgttgaccctcgaccaggccgaagtcgaagcccgcaggatgatcggcgatgtttcggtcatcgagtatagtcagctgttaacgcgtcaagcggctgggcgggcgaaccgggtttacaatggcgaactgcctccccgggcgaatccccaaaaggccgacgacgaggcagggccttcgtgaaagcggatgcgtggacaagtgaagcttgcccccaagaagcgaagggttcctgcttcgtctgactccgacaccgacaacgaggatgatgccgaagaacgtgacggcgaggaggaaggagaggaagaggaggaggtggaggctgtggctgataaggccgcgggtgaggcggtcgaagaccgcgccgacacccccgggtacactcctaccccaagtcctagtcacaacgaaaccggggtgagtcgaacagctccccccttcgtcagaaggatttggaaggggcgaaggccctagttgcgttctcttcgggcgcgtcggcgaagggaggtcctgtcaagaaggtggctaaaaagaaagggctcgtcaatgtcgctcgcgtttttagcaacgacgagtcctccgacgggactccgacttcacccgctggtcgcagcctggatctttcggccgcccccattcctccacttggcgccgctagagtggacggtagtaccgccgctggggcttcggcttctgcggaaaggattgtgatggccgcggcgaaagtattcggcagtcctccgcatcagccggttgcctcgccgctgatggaggcgaagggaaagagagcggttgctgagatgtccgcttcggaatattcgctctcggtaccccgcttcgcccctggcgacttcgagacgcgagcggacctccttccttttgtggaaggggtaagcaatcttgtactgcctgccagcgccccgagcttgttcaccgaactgaatgagttcgacgaggggtgctctgctataaaaagcctggctgttcgggtacgtttcccccccccctttttatctttactcttcctctatcttgtttttacaattgacacttgttctcttcgccgctcgtattctgcgcccagatcctcgcggctcagtgctcaacagagcgaaccgtgcgagctcgacttgatgggttcaaaagccgtcttcgggccaaggacgacgaactaggccgcaaaaatttggacatggaggcccttggcaacacccttagggaggcgaaggccgaaagcaagcggcttcaatcggaactagagaaagggaaggaagctagggccgaagtcgatcgcttaaaggccgaactggagaaagagaaggcccacaccgccatgctcatagattattataacctcaccgagccgaagatggaggctctttggcaggaggttcggaaggccgaagcaagcgccgcagaggagtcgcggcggttttcgcgggagatggtgaaaaccaccgagtccgcgcggacagcgtgccaaacgcttcgccttgcccttactgatatgggcgcgaaggtgcgggatgtcccctccgaagatgccttagcctttgacttctccgaatggacccaacaggctggtggttcggtttcggactgcgccaccgcatacggcgattgctgtgcacgcgtgtcagcggcctttaccatgggcctcctgcagcagttcttagattttcatagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaaaaaaagcttttttgcatacttggactgtatgataattttaaccactttttaacgattaaagtctttggcatattattatttcactcattttgcattatgccataccttccccttctttcgcctattcttaccatgcaagatgtgttttgccttttctgcactgtctaccagggggtctgccgaaaatcatgcattcgggccccttctgggagctggcgaattcaaaacgagaaatttgtggcattgaagggtttgccgaaggtgcgatgtccatttcgacctgtttatcgcgaaatggaaataaacggtcgtagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgcccccttctcctcttaaggttgtgtatgacattagtagtgatgacgaacctagttcatccgaccattccttagggagggataatgattactggggcgaaaatgtaatttacttgtaaaatgaattgtatcgggttgtaaaccttgtactcttcgattatttttttgaagctaataaagagcgtgctttatttccttttcgctatttttcgcatcgtcacactttgtgcttttgttaggtcggaacatgctggcccctttgcatatagtagcgaaataggtgtagtgacttttcagcttttcgttgttcgtttttgatctgtagcgttctgtgtcgagagaaacgcttttgcttttatgctgatcggtcgtaacgtcgtttggctatttattttccaagacaagctgttgcggtttcaacgttcggcgagcaatgcttcggcagattcgtttcgcccccctggcctttttcgctgatcaggcgtttgccttggggtttttcaacaaattatcaatcacacgaaaagaaataaaaagaaggcggaggagacagagattttatactggttcgggcctccatggtggataatagccctacatccagttttttttctcttttttccttttttttcttgccgaaaggcttacatagtgccaaaaggcttacatgataatatgtacatttttacaagttggcgatttgggtgccacccattctagacatagagcgcttgagggaggcggcgttccaggaatggtcgaactcctcgccctttgagtgtcgctaggcgaaaagatcccgtcctggacttgtgtttgatgatgtatggtccttcccactttggttcaagcttgccaaccgctactgggtt

SEQ ID NO: 63791 - DNA, 3532 bp, Oryza sativa
ttgacatgacttggaaatatctccctaggaaacaataggatttgctgcaataaggttttgtgaatagctgcaaatctttcctgttctgttaaataaatagtaataagtaggcaaacctcagccagtccagcattctttgttgatcaatcgggtgattaacgccagccacagccaagcagacagcacatacatttgatcgtctccggcgtgccttgagaagagcttgagccatcactctttccagtgtctcccttgccttatcttctgaacatatcaaagcaaaaaaaaggacaagttctgatttttggcctagttttcaacacatttctactacttatctacagatcatcaccatgtgcataactatgattctatgaaaaccatgtaatactgaaattttgaataattttgtggccacagaaacttgtacaggagtcctggcatgcagatgagatgatacctccaacagagttgtggttggagcagccggcgacggcgcgggagaggacggggagagggtcggcgaagggcatggccgccgggatgcagacgcagacggtgttgccggcgccgccgtcgacgccgaggatgacgctccccatgcgcgggctctggctcttctccatgtcccatatctcaccacccgtcttcgtgtacctctgcatctctgcggacaccaacagcagctagtgctaaacaaacaaactgacacagtgacaatggagaaggatttctcttgctgtcacctacaagtctgcaactaggtgagtgcaaccttatggttatatatatgtacgcgttaggtgcaccaacacattgcatcattgtgtgtgtgcgcttcgtcgaggagaaagggacagggaagaagaagatgatataggaaatattaatgctgcaattgaagggcggctgtccacacgctcgtccaatggcgagacggccgggttaatttacatgtctacgccggacgtcacaggcttctaatctcgatttgtggttgtcgttttgctacaggatgttactgatcggcgtttctccggctgatgttaccgacggcagtgggttagcatactctcaattatggtatcaaatcctgaatcttgagagcacttttgggtatatttgcatttacaactgcattcttgtgcttgggtaaaaactgacatcaatttttacatgttaaactggcaagttcgagtttatatctaagtgttgttaattttcatctgaaacaatacatgatctttgactttctttttctgaaacttgcaacaggtgacaaattcaatgctggttggttttgccttttgtatgtccgaagagttgcatgatttgcatcagtgacatgtcgaaactgtgctgcagtctagcatgcatatgctccagctctactcacaaaaaaactcaaaccatttgtgctccaaatggcatagtattttgctgtcagaaacggcatgcagattagttcagcacttcaacgctagtttacttttcttacgccacattgtccaacacccactgccatcggtgacggacaaaattcctcttcccagaagacctgccttccattattatcaagactcaagaggacttaatccgtattatatgcagctgcaagaatacatataatctctggtcgttgttaccattgtttttggattgatctcaaccccttgatggcctcttctcctgccaaatggctgatttccatggcaccacagctacagcctataagagtacaagacattcaggaggagacaagtgagctgatgacattggataactttctagcttgcgtccaaacaaaagcagagaaaactagcgtatcttgagcaatctgtcaaggagttaaattaacctcaaactgatgttgctagcagcagatatgtactatccagatggggttgcacttttgtactgcatagagtatgatcagataatgtgtagcctcatgatccaaatggctccatcggatcacaaaatgcctatatcggtctgtttggtctcactctcatctttaggactggagcacaatctttcaaccatcttgcaggattggaacacagtcttccaaccatcttgcaagatcatgattcaattgtggaacaaaaaaaaaacatatatattcctttgggtgaagagcttatttttctttcttggcccaagacgctctctctgctttgcctggttgggccacggcctacagataggcatacaaactttgaattgggcccagcatggcccaccccaccaaggcaccaagagtccaagacgatttgtactaaaggattgaactttttcttgttgaggaaaaaagagtgccactgccagctgaattttgatgagtcaaacccaaacgttccaacctgacaaagcaataggcaaaagcaagcttcgctagtagctactccggagtagtagcaaaagaatacgctatatatgcttgcaatttgttctgaacaattaatcgaataagatgcagcattttctctttttttccatcttttttttgaacgacgacagattgttaatagttgcatcgatctgtaagctttaataatcccctatcttttctttctttccttcaaaaagcaccttttaattcctttcgctcgcctatctttcgccctgtcaacccagctcaaggaagggatgcaccagcctgcctttccttgctgcgagtcgcagtcgcacgctggtcaaaatcgcgacaccctggcgcgccgtggcgcgcccgtgcacgcacaaacacgcgcggcgcgtacgccacgcgtcgcgtccgccgcatccgtcgccacatgcaggtgcaaaccagcttgcttgccttctttcctgcagaatgattccttgtcctcctttgtgtcggtgatgctaataaaaaatttcaatttactactagtagaagtactatactactaccgttttatagaatataaaactgcaatttaatactgttctaaaatataaaaagaattagtgttcagtatagttattaataaaataggtagaattaaatgagagaagattctgattggttgataaatagataggtgaaaaactgaatgattgagagtggtgattgatttagaaaagaatgttggtagataaattgttataatttatattttaagataactttagtgtaagaagttgttatatttaaaaactaagggagtactacattttaccttgtctgttggcttggcagtattaacaatgcggtgaaataaacatataggactattatattactagttttcttttttttaatacgcaaggagattatattactagtactattcataaatttgttgataaaaacagcgaccaaaatctgaagcaacaagagacagataatgagataaacaagtgctgcttcagacaaaatccgtaattactactactcctgctgctgctctatacttgatggcttggttggtaactcgagggaaggggattgagagtttacatgaggtaattgataatgagattaagatgggaatttgatttttaatcccaatatcttatttgg

SEQ ID NO: 63792 - DNA, 2921 bp, Oryza sativa
ttgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagatttagcttacatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagtaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggagaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactaaaagggcagacaccgaacttcgacacattcccaaagctaagggatcactgggacgagttcgttgcatataagacaggtaaacaagggcaggcgatgatagaaagaaacaaagaaaatgcgccaagaagaagtaccatcaccacttggggtaaggaggctatagcgtcgcgatgccgaagtgggagcagatggaggctagcttgattgagaggggtatcgaaccggcaacagccaattggccggaacgatcgaagttctggtactatgttcacggtggaacgctcaacccagctgatggctcactggtcttcggcgatcagatacgagaggctgcgcgatgactaacagatgcagtggaagcctcctctcagggcacgttccgaccatacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctatgaactcaacatgtaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaattgacctgtcccgttgatgacatcactcagcggacaccatgtgagctgcatattcctttcaagaacttatcaataaaggtaagatttagccattccgctagttgctgcttatatatgttgattactaataaataatctctcccaacatgaaggtggcgtcgggcatggccatcccaacggacccttcaggtacttaccaccgcaggccgattccagcagaatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagtggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggatcttgacgcttacgttgcatcagaagtcaagagacaattcaagcctcaaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacagtttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagta

SEQ ID NO: 63793 - DNA, 2506 bp, Oryza sativa
gttaaaacatcaggaagatgtatcgcggtattctttggtcttaggactcttgaccttaagtctcaaacaaacttgtctaatactacctccattttttaatatatgacgccattgactttttaacaaacgtttgaccatttatcttattcaatttttttgtgcaaatataaaaaaatgtcatgcttaaagaacatttgatgataaatcaagacacaataaaataaatgataattacataatttttttgaataagacaaatggtcaaacgtatatcaaaaagtcaattatgtcatatattaaaaaacggagggagtattcagtaatatttatgtttttactacaaaattactgtttatgacaggcattaacaagtgcttactattaatctacccttgatatttttacagataatttagcaatatttagttgacaaaggctttaggatttctagtaggataattgatgccatggtggaggagcaacatgtttcaagcatctgaaatctctccatgagcaaatcgaccaagcgaatatgcagtcattatgaaatcaaggggattcgtcagactcaattttggacctctaggtgaaaggcagttgcaccgcatgtaggtatctgatttatagtaatgtgtgtgtctaaagtctagatatcatgtgggtgatgggtgcagtaacatcgtggaagcacattgcctcactccacagatggttttgtaggttttcaccctgtatggtgtatatagaagttaatactgaatagccttctgatgcagtgattacggtatgtttagttcgtaatcggtgagggttgatagcatttttgcctgcagcctgtatagaaatgatgtttctcttagttgtatactacacatacatcatattgtaagaattcacagcttcgaagtaagttattatttccttattttttggggattaattatgaatacaacgggatactgtcatgtacaatatttgctgattgttttggaggcaaattcaaactaaattttgtaatttctttataatttggaaactgaagttgcgattatttgaaatatcaatttcaattgtgttgttgctagctcgcctgtccagtggcctaaattatcaggtagcctcatgctcatgatgcagttgaaggttttcttgggggataaatttcactctaaagtgtgcagtttttttgtaaactgcaaagtgaaagttggggttcctacactatgttgacactaatgacatgcaaattttggtcatcattttgcagttttggtcgagcaatattcaacatttcaactgcatagtaagtgatgttgcttttcttattgcccttatctgttcatagtcttgtgctgcctgtgcgtgcttcctgttaaagtttagttgataaattgaaattttcatttggagcaaaactctgattctggttacactagtttctttatctttctcatgatggtgcttcttgaaacgattacaaatatccaaagcaacttggtgcaacaaatgcaaaacactaatgtaatatacaagaatatgatggaagatcacattctaggcaacagtccgaggactaccgtctaattcacttgctacagcattccatgccaacagtgctgcaccaacagctggttccacctgcaggtaaagcaaatataagctgatgaagatcaatttaaagatttcgtcatagaatccaaaagatatgtgatgtagctgaatttcttccatttctatttgaatcgatcttaaattttactcaatcattgaagatagaagaatctgaagacgatatcttgtagtagtcattatgatcaaaggcaaactattggtgcaattctgcatttgtgttcaccttggggtgtattggataggctcctggataagttttggtaacacaatctatcacttcttttccaatgtcccatctcttgtttgccatgagaactttaccaaccataacaagaggaaaatggtcttttccatctgcagaagcataagcatcttgtaacatgttttgttgaggtaaagccaataaaggaattttgaggtattatttattttttatgagcactaatttttctcgttttccgtttttatatctgaaattactgatgacttttgtgccaggccagttatgcatttcagttagaaagaaatccctatctcaccttcaccgctcaattcaagtctttgcactacagccttgacactggaagctagttcaccaactgaattgtgcaagatcttgtttgctacttcatcaccagcttcagcagattctaccacaaccggaagaaggtcagctattcgcgcccaagattggtcttcatatgtccagctgttgtgtgaagaagtaatcaggtaagtaaatgctatctatgctcggtgattcatttgctgaaatatatttcctgtgatattatactcttcaattatcatcattatgtgaaagaaatgccatacaaacatttcagcttgataaccaagttctttacaccataac

SEQ ID NO: 63794 - DNA, 1002 bp, Oryza sativa
attcgagcctgtaagaaagaaagttcctgagatcatttcaagagttgatcaaatcattttgaataccataaatgcacctacagctttcagcactaatcaggtacttgaggaaaggggcagattgactggtagaattgattcactatactatgcaaaccagaatcttcgaggtttgcttgcagaaaagatgaaggatattaaggatttatcacgccaggtttctgatgccagcaggaaaatgtcatttcaattgtcactggaggagaaactttcaaggcagctccacaaaattaaaggggactatgaggatctacacattcaaagcactattagagatgaagtgtatcaaactgttacaaaaagaatgtttgatgattataggaacagcctgcaggaccctgcactaacttatcaagaaaaagtgacttcacttgaagctgcactctcagaaaaggagacggcgttacgtttagctaatgaagaaaaccagaggttaaaggagaagttgtcaaaacaagaaaaggagcatggcatccaaaataaccaggactatcctgagttaatcaaacaagacaatgaggaaatgatactccgtgatatcgagatggagcctcatgtatcacctaggagatcatatgccatttctgagcagaatgcagagtatgaggagctcatcaaactgaagcaaactttagagattgcctcaactgccttgaaggaagttgaatcaaacgaattggattataatggtattctaggtaaaaatgagcaagaaaagcaactagaattcattttggtatccattatggatttgtcaaaagaatttgtgcagattgaaaataaaatgtcaggggatatgaagggaagtgaaaaagggtatgtccatctatcttttagtctttctaattactaatctcctgagctgcctaggccctggtgctcatttttcatgcagaacatagtaaaacagctcaattaggctttctttatgataatattatg

SEQ ID NO: 63795 - DNA, 8598 bp, Oryza sativa
aaaagtatacgcgaggaaaaagagagaggtgagataggaaaggaggaacaacataaccttaggagagcgggggcctctgtcaaacagtacaactaggtaggccatgcggtacatggccatggacatcaacctcctcacttgcaagttgcaactaggtaggccacgagacaagttgcagagcatgagttgttgcagcaatcaatcttttatagtatatatatactccctccgtccaaaaaaagacaaaccctggtttccgtgtccaatgtttgaccgtccgtcttatttgaaaaaattatgaaaaaaattaaaaagataagtcacgcataaagtattcatcatgttttatcatctaacaataatgaaaatactaattataaaaaaattacatataagacggacagtcaaacgttggcacgcaaacccgtggtttgccttttttttgacggagggagtatgtgtgcaacacccttacaagtaggaggtaatgtcgatgatgggggcatgatgtttacaggagacctgttttgctatcaagagagaatcaagtggatggaggttttacacgataagaaatggaagtgcattcatggtactacacctgtactacgtactccctcggtcccaaaatatttgcttcatccttaataccacaatggtaggtcaaatttgggatgatgggagtatagaagatagagcacgccgagcgagccggcattacttttagccgatcgacttttattattttcttccttttagattagttttatccgataatgctattattagtagcctgaatatatcaaaacatggcagcaatgattgctcaaaaaatatgacaatatttaataatttagttcttgagattaacaaatggcacaacccgtattctataatggatattcagacccaacaagagtgttcagcacctagctaaagattagatgtctaagttatcccaagaatcaggtcttttcacgacatgtagaaaattgtttgggcactatcaaatgtttcaacttacttgataaaatgctttagagaaatgtaacatttaaaaaatagtgattgcaacaccaacagccacgtgaaacatcgagtcccaatggttattaacaatacactggtcaaggtcacctgtgacgggcccaaaccctcacctttgatggttttgggcttggtcaatgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtaagccgtcacaggtgggtcacctgtgacggtccgacgtttgcgagtccgtcacaggtgaggttacctgtgacggatgtttcttccgaaccgtcactgatgagttaattccagaaaaaaaataaatgctaaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattacgaaaatttcttgtattctgttcgttgtgaacctccacaacctgtcaataagggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacattgctagaaattataaaaacatcttttttacatcacaataaattatctagccaagttcatgagtctatttggcatgaaaacgtcctttcttgttcattatttctgtaagaataaaggcgcacacttcgcctctgatagcgggggggttgatgggtgagatcttgaggccagctctacctttctgtttaataaataagaggttaattagcacgttttgaatatcaatgtagatattgaaatgagcttattcgccattagcaacaacctcagggtcgaaatctttcacctctcttagaagtgttgacatgttgtggcacacgtggaaaccatattggtctccgatctgtcgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacatgaagggtattgtcctcttactcttggttgtgtgtgcacatgatgtactccttgtcttcatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcaaagaggtcatcaaaacctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcaccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgagggcacgggcagcggatagcctgaccaggtgttctttactgtatcgatggacaccttggcatacccagctagcagatctgtgccgtggaccttgtctgtaaccgagggcttgaaagccatgccctcagcgacttcaggagcgaaagttgggtggactctcgctagtaggacacactgtgctgcgccctgcataaggtgaaagtttgaatataatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgtgtcgtgttgtacacgaggagttagttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaatttcccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccatccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggttggaaatgtgaaccatttctccattgccgtccaagctcgctctttctcggcttctgtgaccttcccgatatctttatggaggatcccgaagttctcacgtgctgctagcccgcagcagttagaccatcttccaatgacagtcctgggcgccgtgggcctaccactagcgtcaacctctcttataacttgcactatggtcggccatatattttgtgaccgcgaatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgctgggcattgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggaggaaaaagcaacccaaagaaaatagaacaagtgtagttcatctgttcttatccataaaatagaacaagtgtagttcatctgttcttatccataaagaaaagagcaagtgcaggaaattagagcagtagcaacagcatggccatataatagcagcaataagagcagtagcagggccatataacagcagtaggggtatatatgccacaggggcagcaacagcagggggagattcacataaacagcaacagcagggtggaaattcacataaacagcaacagcagagggaaatttacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttctaatgcataaaaaaagaacaagtgtagaggtatataaccactctacactggccatttaataaggaacaagtgaacaagtgtaggggcaaaaaaataaacaagtgtagataatctgttcttattgagcaattcatcactggccatttaataaggaacacattgggcagcagcagcaagggtatataaatcatcaaagaatgacagaaaacaaaatgcatggagaactttggtgtctaggtcggttccgtcggttcagctaaatataaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcacttattgagcaattcatcacttattgagccacaacaggggcaaaaagaagaatagataaaaaaatgaacaagtgtagataatctgttcttattgagcaattcatcactggccatttaacaaggaacacattgggcagcagaagcaggggcaaagatactccacaggggcagcaacaacataaaacaaggaaaaggtgtattaacaagtagcccacaataacagcagtagcaggggtgtagataaaaaaggagacagtactactaacttcatgtaaacagcaattcatccattcaattcaagcaagtctagataataaaacagcccacaatcattgtggcagcagcagcatgggtatataaatcatgtatataaacaacaattcatacaattgacctattcatagacaaaaagggtatataaatcaacaagtttagataatctgcaaagttccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagaattatagaaaacaaaatgcattgaaaattttggtgtgtaggtcggttccgtccgtggactacactgaccaaaccaccaaaattccccatgcattttgtattttgtgatggtttgataacccttaactagctagcttaataaactatttctagctagctaccctacctagctagaaacactattgccaatctatcaatccatcctttttcagctaaatataaacatgatccacaaaattcaataggtctagcaaaagggaacaaaacaacatatatagcagtacacactccatgaatggttatatgtccaaatggcacttaaatccacatccaagttgcaaactagctacacattcaagttttaactaacagttgcaaccataggcagcagcatgggcaaacatagacagcaaggggcaagtgtagataataaaatagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggaggcagcggcggagagggcggagatggcggcagagagggcagcagagatggcggcggagagggaggaggagaggttgaggcggcgacggcggagatggcggtggagaggacggcggagatggcggcagagagggcagcggagatggcggcggagagggcggaggagaggttgaggcggcgacggtggagatggcggtggagaggacggcggcggtc

SEQ ID NO: 63796 - DNA, 23234 bp, Oryza sativa
actaaatctgtagttttgtgataaatgaagatattaaacatgtagttttgtgaaaaatgaagatattaaacctgtagttctgtgaaacaagttattaaatttgtagttttgtaatatagtgttcaaaatacctgtagttttgtgataaatgaagacattaaatctgtagttttgtgaaactagttctaaaatctgtagttttgtgatagatcatgtaaagtatctgtagttttataaaatttactctttaatttttgaaccatatatacttatttcttggtgcatggaggaccaaaccacctcatagtagaaagaggctgacctatttattgagttgtatattcaacaaaaagaataaagttcgatgaaaatcagcattaccttggtttttatattgtgatgcttagctaaagtttggtataagtactcctgttttcagcgattcattttatttgtaaatggactccgagttttttatgtacaacattttgtattaggcgaacaatgaaaagcattttttcaatgacgtggatgtacaacatttgtattaccaaatgccaccgtagcattagcacgggtatactactagatagattagtttagttttaggttcagagaatagagaggtggaaacaccccatcaaagtttgacccgaaatattggttcaggccaccttgtacatatactacgcaataaggttgtcatttgttatgtgtaagtactacaaattcaagcttgtatattgttgtaggctgggatagacaaagggaacctctctcgtgcaagtttactgactttgtatttgttagccatcttggccttgttttgtacatgttgagaagattgagaaaattctgaattgacgtttcaagaaactgctggttcaagaattgttctcagtgaagatacattgttcattgttgcatgcatgtataacttcacattttggcattttctgttgaaacttaattagtacacactcctatgttgtttatgagacctctgattcactaaatgaggtgcatttctgcaataatattagtgttgatgcggtggactgatgaaagcgaaattattccttacaaagaacagcaaaattacgtctgattttgcatgtttcatcttggtcaattagcttcagcagtgaatcatcatctctttagtttataatggccattttcttaaaacaattgttcccaactcttactactattctgcttatatataattgttgatggtttttaattaattttatcaaataatatgaatttttttattttgctttccatatactccctccgttttatgttataagacattttgagtttggttaaagtcaaactgctttaactttaaccaagtttgtagagaaaaataataacatttttaacccaagataaatttattgtgaaaataaagctcaattggacatagagagtactccatcctgccatcaccgcttacccctgtgctcaattagaagtgttttctcctcgcatcgctcggcggaagatcgctaaacctactattctttgcgcaaatagatgggccccctaggaatgggggcccctcggggctggctctggttattgatcaccaaaaacaagcgcatatgatgacacatgaacacacgatatttgttaacgaaattcaaccgaagcctacatctccagggttgtgataatgggtgctcctccccaaccaatatagcaccaagtctctacgagtacatggccttaattatcactgctacattgtaatcgccatggttatatttgtggtatccttttctatgtttaagagagagcctccattggtgtagaagccgggttttataaatttccattatctaaaaaaatatttaagagagagcctatgacagagtgaaactctaactctatcctacacatattccaacttcaagttaactcctaatagaattagtatattcgacacctattctaacaaaagttcttggtgtctaagtcaaaactaatgattttttcaaaaaaaaaactcaaaatctggaaaaacaaatttttatggttggttgtggaattcgtatgtataaaccatcgatttctacatcaataagggattcaaagtggactttttccttgggttgacgctgcatcgaggccatgcatgggccaagcccagagagcagcggttccgcttcgcgtgcgcctaaaataaaaaggaaggggaggcgtctctcccagtttgtgaggaccgatcaagcgatcaaaccctagccgccgccgcctcctcctccttctcctcctcctccagatcggcaatcggcatggcgcttcgtgctctcgcctccaagctgaggatcccggcggccgctccccgctggactcctccgccgtctcgccccgtctccaccgctcctaaggtccaattcaactctttcccctaatatcgagctgtttgacatctacaatccttgcaacgttttactaactattcttctatttcctcatatatgcaactgcagcgtaagctctctgccacctccaaaacctgttgaaaaaagttctctcgattttcaggaaatgtacgatgcagatgcttatgcttagttaatttcctttgtttttcctttgtttgttgactcatgtcttttcctttattttttttctcttttcaaggctactcttggaacggattcgtgcacatcaagacaggtttgcgcggaacatgatgatttctcaagcaattggtaatttagttgggtatggcatcttttggtatcttgtcaacgatgtttccaagaacttggcaaattgatcgggttcaacaatgaacctgttatgtatggcttgatgaagcacctgttatgtatcttctaaaggtcctgaagatgaacctgttatgtatggcctagtatgtgctgatgaacatgtctaattattttgtatggatgatgaacctgttcaaatcttactatgttctgatcaacatgttgaatttgtctttactttggccacgatgaacctgttgtggcttgtttgtgtactttttggccatgatgaacctgctatggcttgcttgtgtttttttaatcaagtatgaagctgcaaatagcattgcctatctgggccagggcacgcttgtcattccacatcccaccatgatggcaagctgatatgtctcaccacagtagtgaaattggcaaattgttaacagaaattctctccaatggcaaatctgtaagaaatatattaagagtggcatttggtctcgcctccaagctggacgaagtcaggggagctaacaactatcgatgtagcatctacgtatctggctccttttatgttatgtgatagcgtgacagcactctgattatattgtggcagctcttgtggaataagaactttctagcatctatgcgatatatatgccttgtaatagcaccttattgtggcaaatttgagctttagcaaggcacttggggcgaggaactttgaattgagaaggtaacaaattactagacgatggtttcgaactagtggcctttgttgtaatgaatggcttgatgatgcacttgttatgtatggcctaaaggtcctgaagattacgatgaacctgtttaaatcatacgatattctgatcaacatgttgaattgtttggccatgaacatactgtcctttttggccatgatgaacctgctgtatggcttgcttgcatccttttcatccatggcgagaccgtatgcgctgctggagtgctggtctccgtcaccgaaactgctgatagtgccgagaaggtctagatcgccctcgagagctgacctacgtctttgactcgccgttaacccccagccatggccacctaggtactttatgtttttattaagattgactggatcagattcaagcagcgagacagtggtgagcgatttaattcccttgaatcttctgaagatcttaaagagtggtacatatagattgtttgctgaaattaatttgctcatgctaaaggaattggaaaccatgtgctttctggatctatttacgtacagatggtgaacactttatgagcaataaactttttgattgtccaccaccagcgttatactactagctcatttcaaattttgatatgtatgggagtcatgttcttctacaggatttcatttcttttgcattgttagactccatatcagatttctcgcagattttgttacttttgtactgtttgactcgatatcagatctctcgcagactgtaatcaggtagtatttgatagaatgtacacaattttggaacgtagatttgttgggtcacctttggctagagttgtttcacttcctatttcctttaaagagctttcatttgcagatcttttttcatgtaagatcccatcagtcaatgtaagatagtttagacaaattttcagatcagtagtcaggacatggcattgttgaaatggcagcagtcaatgtaagagggtttagataaatgttcagaatcaggagccaggacatagcatcgttgaacagggtaccactatgaaatttaaaaaatgtggtcgatatgacgatgtgccattatgaagccttgcactgtgaccgtttggtaggttgatagaaaagcaaaatgattggattgggggtgaaatggatctggatgattgaataaagtgcttcactgttctgccaattgtcaaattcacttatattttccagtgcaaaatttagattttcaaaccatttgtccttttcttttcatgctatatctaagaaagcatatgaatgtgtattcactactacatccacaccattattctggtgactttattttggatgtaatatattttgctgtccaggggaaaggtgatctcttcttttggcacttatcttcgttcacaaatcacatatattaaagtttctggtcttggtgctatcacaaattaacaaaatgatatcagtgatcgcctccatccaaattgatgtttgctttggataaagatgcatgaattcctgttttgctcgattggtttgatgtgttgttgaggatgaaatggaaatattgtggtctactgttccgtttggatgaaaatatggtggtatactttcactacgtcagatcaaggctttagtaacacagctatgtgctactacaacctcaaaaacctgttgtggttctcggtaacacaaattttaagtgatcttatagcccatgttacttatgtacactacagtagcacaaaactagtgttccgacatacaagaaatatgtgttacaatcatgtcacatacctagtgttaccagatacactagtaacacctttttgagcatagctcgtgcagcttcccatgagtcctgtaagacctatcttagaggcagcaacacatatataggcagcagtaacacacaatcgcttagagccggtaacacatacaaatattttttttttttagagaagggtatttttttacccggcctctacatccaaccggatatatacggccattgaaataaggaactcaggaccttggggtactactcaggtcactataaccactaggctacatgccctttcatcggtaacacatacaaatatagacacgagtaacacaaaatcaacgaatctacctccagcagtaacacgtttataattttcagaaatgtacaaacatacttttatagtctttgataagcatcacatgtccacaataaggaaaaagtacgaatcccccccaactatcgcggtcgaccgaattatccccctaaactcaagtatcagacattttacaccctaaactatatataccggactaacgactcccccccctgaacactgttctgagcggttttgacttgagctagcacacgtggcgccaacgtggctgactagtcagcaaaaaaaaaatccctggcccacctgtcatccctctctttaacccaacctctcccagcccccttgctgtctctctcgtgcgcgtactcggacgaccagcggcggagctcgctcgcgcagctgggggcggaggtggaggcggagaagagccggttcccccaaatccagccgctgccgccctcttctcccctttggccgcccgcggaggaggcagccggagctcgtggtggactgtggtgcggggaaaggaggatggcgacggcgcgggggcgggcggtgtgcggggtcggcgacggcaagcttcttcgtggcttcgtggttgcggagcaggaggaggagaaccccgtcgcggcaggaggagctcccactaggtggaggcccagccgccgccggggaggaacgaggccggaggcagatgtggaggcggcggcttgcggcccgggacgacgaagaggaagccgaggaggcgcggaagcgacgtgtggtggcgagcgtggcacgcaccagcgcggcgggggaagaggcggacgaggtcgtcgcggagcgcctcgatgccgcacgtcaccgaccctcgcgcgccgaccgcccgtgcagctcgacctgtgcccgtgcggccgccacctcgacgccgcccatcgccggccctcgcgcgccgctcgatctgcgtccacgcgcgccgacccctgcgccgttcgagctgagaccgtgcggccgccaactcgacaccgcccgtcgccagccctcgcgcgccgaccgtccgcgcggccgcgcctaaggagtgtcgacgccagagagagagagaggggaagaggggaagaggaaaaggatgacatgatagagtatgaaaggtgggacccaccatgttttaaaaaaagggaaaatgctgattgggttgccacgtgtacgccacataggacaaaaccgctctgaattgggtcgaggggggtaattcgtccggtattaagttcggggtaagtgatgtctggtttttaggttcaggggggaaattcggtcgaccgtgatagttcagggattcgtacctttcccccaaaataacatagaatcaacatgacaagttgtattacataggaaaccagtaaataatatttttacatcaatctataacaagaaatctatagcaagattctataagaaatacaatgtctatatgactctgggacgatcaatatttgtcacttgatccattcatgagatgaacactgaacaatatttttcccaagttaaactaatcatatacttgcatgtacatttggcctggttacttcttacaaaaccttgatgaatgtgtaatggtacctgcacctcaccaagatgaagatattagaccatagaaattgacaaaaaaaagtacatatatacaggacatcaaataaaggagttcactgtagatttagttaaatccaaaataaaagtatctaagatataaatagtatggtcttcattcttttgtttcttttccctagccaggacaaatagtatatggtctagaagaaaaacagcatgggtaaacaaagggggaaaaagaagaaaaactaactattcgagaaataaggcaagcttttttctaggaataaaaagcaacaatgacttcacacagttgagaaataatataaaaggtgttgttttgaaacataatatattttagccatgacaagctactaagctagtcggatgctagatgaactgttgaataaaatattttcatgattaatgttggatgaaacacttcagctttaacatatatttcctatacatagatcagatctgcatttgcattaattattcttttacctgaacccctgaaagagttctgaagaaagcatttttaaatcagaaacatagaacattcatgttgaacagtgtagggagagagaaatacagcgaatattagaccacgttatattgagcctcaggggccggtattgttgacgcgaaaaatacacactggcccgggagatctgcttagatcaagtgcaggtccaaaggttgatgagatgcgggcgtgctagtcagtttgaccctgcaactgataagatatacaaatagcagatcaatgagccgatcggctgacaagccgatagattaattacagccgatgccgataccagccgatagcgatagggttttgagctatcggctataattctgatgtagattctgacgcttgatgtaaataacaatatgaagacaatcgcctggtgataatgcaagaaagcaacaagataatccaatagaaaccaatcggctaacaatgacatgctcgagtaagcactgatccgaaggttaaagcatacatcggctggaggtccgatgtcacaaaatccacacgattagataaacagtaaaatctttgttgcgatcggctaaatccaatatgtatgcaatccttgtaagccgatgcaacgtccagataacttatcggctaacaccccgataaaacattagcatgaacctatcggcttaacaagatttatattatcaacaacaatctagtaggtcgaacctaaccgatagagcacgagaatgcatatgataatctaatactcgatgagccgatagatctgtctaatgtgatggatataacaaatctatctagaacagcattgtgattgtagagatatttcggttaagacagaagatcagacctaaccgagacagttccaactaaactgatacgtctctaaacacaatgcaattagagataggactaagatatcatgtaggcaaatatatcgaccaaaccagagcaatccaagagatcgaagcgatgcatccttgaacaacaccaacggcgctgagagtagtattgatcgagagatattttacaatgacccagggtgtacatatttatacccatggggagatactagtccttgtaggacaagaaagaaactttcctaaagataaaaaggaaaacataaagtctttataggacactaaacacaatttcctaaagataaaaggaaactaacaaactactcctaattaatagataaactgccatgccgcatccttcttgaactcggtcacttctggataagctttctttaatagattaatttccttaaccgaatatagcaggaatcggactattggcgatgtgataattctcttaggggcttaccaaatttcactgttaacaggtatatataggttacatggattggatcttaagtatactgaaagagatagatatggaaactaatcctatccaaccataacaaaccggatacgatacaatcctatccatatactctaacatccccccgcagtccaagagtgagcagcgcgggcacttggactgaagaagaaaccagcaagaatgctcaatacggatgatagccctttgtgccatagtcgatgtagccgaaacgaagggtgtgagagacccgtggtcgatgaagccgtgcgtagagtagctgtcatcgatgtagccgaagtcagggagccgatgatgtcgaggtagcccagctgcaaggtgcgcatgggacaccgtagagtgaggtgcacgaggacatgctaaagacgatgacagtgatgcaatcgcgacagtcattgaggaagatgacgccaatgaatagtatagtatagggagagaggaatactgcgaatattaggccacgctgtattgagcctcagagggccgatgcatataggttacatggattggattttaactaaactcaaaaagatagatatggaaactaatcctatcctaccataacaaaccagatacaatatgatcctatccatatactcaatgccacgtttgttagacttccagtttcatgttatcacagtattattgaaccttatgtgcataagcacttaacaccaggacaattggaaaactaatcgtaaactgttcagcattgccaattctagcgctatcagcctattaatcactataagcttgtaaaaattgcttcactccctcacataaaaaatattatacatttgagcatattcaaatttagccctaaacattaacaaagcatagtggccaaattcagaaatgaattttaatatgcctatgtgccagtttgtagtgttacagcgtaaattttgggttgaatgaacaatatgtgctctgattgctctaaggaaataaattatccagaacagttaaagataaatctttgaagcgtgaaaacgattgctcaagctctgcaaacattcaattcttaaacaactgcacctcatggggatagataggaacttgtgtagttctgtgttccctgcttcccctctgctcgcaacctataggccaaatctcatcacaatcaaaacataatagttcagattagtaatacagagaaagagtctgcacattagagaaaggcgaggaggagttaaggatttagtaggcggccggggggggggggggggggctgtttgtcagtgttttctccaatggatcattacgtaaatcaaatttgggcccaaactcttccaatcgtgctgcatcaagacatcaagtgtgttcgagctaaatttttctgcatcaatctgtgagatttcaatggtagcagttgtgtgcacctaagtgttatttttaagaacggcatgtttctagaattttccaccttttgattccctatcaatattcatgcaattcagtactgatttttcttagtgcaatttaccaaatttttatatgagatgtgctcttttccatggaatagttacagtaagtatatttgtagcttttcagttcagttcacaatgtcataatagttcagttttccaatcaggtattaatgagtcctggatgtatcaatcatttgtgatttataccatgttaattaatttgtttcatgattggaaatttaatctttgaaattcaaatgagcatgttcttggtagcacattatgcttgagtatattcatcctgattggcttctaggtgcatgtccgttaataagctgtaagtatgtttttggtctgcagggccatggagaacaagcacaatttggttgcagagccaacatgacttgtccctctcactagtcactagtcaccacctagctgaatggtcagtaaacatctattggcttttgtttgcaatattgtaccggatcatactggatcttgcggttgaggttatcgactgatataatagtttaatttagcttatattgctaatgtcgtcatgccattcttaattactattgatttatgctttccattcatacatatcttgagagaaaattattgaaatccatgttcatgccacttgtttattggaaggcttgaatgaatgagtgaaactctatgtggggagtagcagcaggttcatttggattaaatcatcaagggataatgtttacatcttaaaatgaatgatactctctccgttgttacaagacattttaactttggtcaaagtcaaactaatctaagtttgactaattttataaaaaaaaagtactccctctatccacaaaagttgcacctattactttgtcatcaagatcaaggaaaaattaaattatcttggatgttacaaaatcaaggagtgaatgtaagcatgcaatcaatgagtatttagattactccttagattctaatcaaacatttaatttatctcttcatttaactcttgaatgcataaatactacaaatatgaacaacttatttggaaaagctcaaatgtgaaatatgtgtaacttttgtggatggagggagtaatatttttaacccaaaacaaaaatattatgaacatttatttaattatagatttagtgaagctatatttgtgttgtaaatattactatttttttctacaaaattagtcaaatttaaagtggtttgactttgaccaaaattaaaatgtcttatatatatcctgaaacggagagagtagtgaataagaaaatggtgatcttgacagtgatttgaggaagagcactacaagatgaatacttatttgcttctatattatagcaacccaattctaattaaaacttctattttcatttttcaggttccaagttgtacgcaccttaaaacttctcggctagtttttttagaaaagcgggttgttatccatggataagtatgagccgggcgcgcgcgctctgacaagacccgacgatcgagctgtgctagccgaagtagtactagtttcagacccacgcaatcgtcatacaagctagctaggccgcctgcatcgcaacatgctctgatccaaattagttttattaaattaataattaaatatatttttataataaatttattattactatttttctataaacttggtcaaacttaaagtgaccaaagtcaagacatctaacctgaaacagagatagggagagagtatttgctttgctatctacgagatcttaggctgtgtttagatccaggggtgtaaagttttggcgtgccacatcagatatacggacacatatttgaagtattaaatgtagtctaataataaacaaattacagaatccgcctctaaaccgcgagacaaatttattaagactaactaatcaatatggtttcaccgcagccgttatcaccgccaagtcgccaacagcttcctcaccgttgtgatgcgcctgagtatctcctccctctgctgcaccagatcatcttgcgtttgattttacaatgtaatcatgaaactgatactggatttacagtatgtttttagcccaaattcatggaaaggtagctaggaaggagtcttatgagcaccttatctgatctttgtgtcattagaggaattaactgacattcatttattgttatggctaatcagaattatttgatctgggattgctgcattcattgtaacgagctgctgaaaggcttttttttttcatatttgaaagaagaggcaacctactgggcatgatgccgccctggaccatgtacaggtttggacgatgacttgtagtggaatgagcactaatgtttttcttcatggtatttattaggttattccgaatcagaatatttagcatattgccaaaaaaaatgttggtgtttaccttctgctagcactctgaaaagcatattaactttttgctcactgacatgtggttcctaggtttgataaattttcccatgtgtgctgtcattgcaggacgccaggatccagttaggccttaattcttctattttatgacgaatactcatatttgatatttggtatgtatacctgtggtcctgtgcagatacttgccttgatgttccaataaatgtaacaaaaacttcagataaatgagcaatcatatgtttggagtttagaaataataactgaagagaaacataaccaaggcataaagcaaggtagattgctactaacactagactgaaactgaaggaatcacctattgcaatagctttatccaagcactcataggtacaacggacaagctgcttggaagcttcatcaacatttccaacaaaatatgtctcgttcaaatcacctgcagtttagttatatactgtgtcaaaaaaaccaacaactttcagcagcgaaatacaataccaggctgcagagaacttaccatgaactcctttgtaatatacagttacgtcgacatttacaatgtcaccatcttcaagtttcctattagagaaagatcagataaaaaccaaaatcaatttacctgtttgttttttctgaaaatagcagaaaacgttatcacaatactgatataatagaattgttacatttctatagcatttaattcattctttagaagttcaagaaatggacctttatgtggaatctggtattctgccttttctgttcattttaattatagagaaaaatattgattgttaatgtgcgcagttgttgaattggttgtcatgcattgtgtattatttttgctgtgtttattaatcatagaaaatggaaattttctatgtttaaggtgtgccatagcacttctgtcactgtactaaaaatggcaaattttatgttttcacaaattagtgatatttttacaaattttgcagtgtaaaggtgtgaaaattgagcttccttgaatgtcttttttttttacagcttttactaagtgggcatgtgttcgggaggattataatagtttagcctaattacattatgatttgataatatggtgctacagtaaatatttgctaataaaaatcaattaggcttaataaatttatctctaatttatttttattattaaactatgtttaataatagtgtgtcgtatatttgatgtgacaccagaacttttgtctgaacagccgcatgcatagcgagacagtccacactccagagtctcgactgcctccagaccggcgaggccagggtgagttgttggtggccacacccacacgtacagtacacacagagcaggagcaggagggcgacttcctccattggttctgcacagaaatggtggagtgtaacagtagtacgtacccggtccgtccattgcatgcagactgtatgtactcggatatgtacggtttatctatagcagtagatatgctcacttcacgcacgccaagaaccatactccgttcaatgtacaccgtgtttagttccaaaaatttacttcaaacttttaacatttttatcacatcaaaacttttcaacacatataaactttcaacttttccatcatatcgtttcattttcaatcaaaatataattttgactcgcaatcgctccctgcatataccaggtgcatttaatttgatcaatcccatcggcaagcagcgcaattaatgtttgctactgtaaatactcgcatcggagtagctggatggaatgtccacgaatacaattcagctatgacttactccctctgtctcagcgattttaagttttcgctcgtatcgtttgatcactcgtcttatttaatttttttttacaaatataaaaaacaaaaagttgtgtttaaagtactgtggataataaagtaagttacaaataaaataaataataatctcaaaattttttaaataagacgagtggtcaaacgttgcatgtaaaaacttaaaatcccttatattatgggacagaggaagtatataatattgctccgttcccactccgtatacatattttaaaattcaacttttaaaatatttggttagtaaatattttattataaattagattttatttaatgaaaacaatatcattggattattatttaaatttacttttatatgattatgattttgttgctataaatattgtagtatataagaaatctgaagttaaatattagttttaaagacttagttatgtttgatcacgtcttagtgagtaggacggagagagtatatgtttcttagggagtgggccagccataaatttttttaaaaaatatatttttttagtttgttgactagattgccatgtgaccaaattgtcatcgtgcaggtggcagctaggaccaatactactttgaatgttaggtaattcgtctagtatgaagagttctgttggtagaatgtcgggtttaagaatttaggggataactcatacattttgagaatagttctagagttcctgatgagatactaaaacatcgtaccatttctattgtaaaaaatatcctaataagttgcctatctaattacataatggcagtaccaggatttatgaaaaaaaaatcggttgctttagggtgtgtttagtttacgtcaaaattaaaagtttggttaaaattgaaacgatgtaattgaaaaattgaaaatttatgtgtgtgtaggaaagttttaatgtgatgaaaaaattaaaagtttgaagaaaaaatctgtaactaaactcagccttaatctgaaaaaacattcaaattcgatgaagaaaacatgccaggtcgggcccatcatatatatcccgacgtagtggccgatgaggaggatgagggagaacaaattaccgaaagaggaaagagcggaaagctgcaggccgaaaaacaacaatacgtgcagggtgtgcaggtgtgagagacatactgtatttctgaagctgaagcagctgcaggctgcagcctggccacgcccagagccacagctagagctagctataggcgtgtttgtactgtttgcactgcacccctatgccacatgggtgtgttcctggttccgggaatttccttccgaatcgaggaacggggactacctggaacttctgtctcgaaaatagatgggtcgttattatgctacagaacttagaaataggattgctgctaattgtataatttgaataggagtgctagaactagggagcaaggaggagaaaggttagggcaaataagctcatgattatgggtgtgtttagttctttgggtgtaaagtttttgaagtatacggacgcacatttaaagtattaaatatagactaataacaaaacaaattacatattctgcctgtaaactgcgagacgaatttattaagcttaattaatccgtcattatcaaatatttactgtagcttcgcaatgtcaaatcatggcgtaattaggctcaaaacattcgtctcgcaatttacatgcaaactgtgcgattgttttttttcccacatttaatgccccatgcatgtgtccaaacatttgatgtgacgtttttggtaaaaaaaaattaggatctaaaccaggcctatttatagtactgttgtttagttttggtggcatatttaaaatttgagtttcaaactgtcatgtttgtaagtggcgtcaataatgcggatacggtagaatatatgcttttgtaaactcattaatgttaacttggtcagatgttttaagttcattcccaacctaccaaaagcaacagtatattctccaaataagtacattaattagttcattgaatgtgccaatgtgtacttccagatgtctatagatgcacttttttctcttccttaatgagtgctaaattagaaataatcccctatatggatagggagagtaagaatctccatgctcggatgctcttatccctgtaaaatcaaagatgtttttgattatttttctgtgatgaacaattggcattgaagattatcggttttattatttggaatttatttatgaagtggttttggagatgattggatttacagatgaattgcaggtgttgttattttatgtggaccggtcagaccgggcagtggttgccggtcagaccggcgtgtattgcgcggtctgaccggacgacactatgtcggtttcggtttcggattgtttgtttggatatccgtgattatttcatgattatgtcttctagatggatactatgcgtatgtaatactgttgtttgctaatattgagtcaagttggagatagcttggtctcggaatatggtttctttgtttgttccatgtgtaggtaactcgatgtctcgagagagtatttgcggtgatggaccgggagtcggcttggggataagacgacgtccgtggtggtcagatatcatgcgggatacttaggctagagttgatgcacgtggttggtgaagattccatatggcatacgatggaggtgttgtgtgcgtataggatgcggagtcgaatttggaaggagtccaaatttggtatgagtggttatgtaaagtttgtttcttgcatgagaaggtttcctatggggatttggacttctagtatgagtttggttcgtggctttaggctgcctaccttatgtataaatagagagggagcgtgaggcttcccggtatcgcttttgagagcaattgagttgatagtttagttagggtttcgagttttctcgagatttttgtaaagagtgttgttgatgtactttgtaaacacagagataatcaataaagtcgtcatccactttaagagttcttcgatttgtgtttcaccgggtttctgtggtctaaccggcatctcaccggcagtcagaccggcgacaagcggcggtcagaccggtggcttaagggcggtcagaccggcagcgactccaggcgcgacaggcatcttcaggcggtcggaccgatcgatctacaccggtcagaccgacgacatcagggcggtcagaccggtggatcatcttcggttagaccgatctagtcgaatttgagggtaacttttatttccgctaaaagtttaggtttttgggtgttccaaccattcaccccccctctggttggcttagttcttactgttcgatcctacaatccccactataggagtagtttcttttgagccgcttactaattttaaaatgtattttttgatttttttcaattaaagcttctttttataatattggttattaaattgctaagatacatactcctatataatttttttaccaataaacctttttctaagttgttaagccattgctttatcagctaaagtttcgtttttttcctgttagcatacactatcatagaacatgctagcttgtgaaatttcgagtaactactgtacgttaaaaatttaaaagactatcgtttgtttggagctaacatgaacttagaaatagggtctgtttggcaggccgactgcgatggctgcggctgcgacggcagctacgcacagtgagtgcggtagcctgggcagccgaacaggaccatagaccggccacggccaattttaaaatttactacaatttaatcagctgtaggagtagtctgtatttatctggccatatttgctttaaaatcactaatatcaatgtatattattgtctatattagctgaatatttatggtcgtagagtaataagattttaaaccaataaattagtatccatgtaatactgtagcttaaattgtctgtcccatgcatggttggtatggtataggagtagtagttcatcaggggttcttctgaatgaagcgtagcaattccacatgctagtactacgcggataaaaatgaaaataggctattctatggttgcactttatggacggatggacaagctagggggccaggctcatgttgatgaattaaaatactatcaagggtgtgtttagtttcacgttaaaattagaagtttaattgaaattagaacgatgtgactgaaaaattggaagtttgtgtgtgtagaaaagttcgatgtgacgtttttagttcaaagtttaaatctaaacagagcccaaattataaacttctctcaaacagttacagtacattattatatactactggagttctgttaacacgtttcctgattaagatgattatcttattcaatttccatcagcacgttttacaaactattttaaaaaataatttatgtatagaagttgtcttaaaatattaaatacatctgtttttaaatttataataattaaaacttaattaatcatgtatacgcgctgagttgatatttatcttaatctctcttaaatactccctccgtcccataatataagggattttgagtttttgtttgtattatttgaccactcgtcttatttaaaaaatttgtacaaatataaaaaacgaaaagttgtgcttaaaatactttggataataaagtaagtcaaaaaaaataaataataattttaaatttttttgaataagacgagtggtcaaacagtgtaagcaaaaacttaaaatcccttattatattatttgacgatgggagtaccatactactctacgtgatcatgatactattgttgaaaaattagtactcctactcctatatcgcacgtcttgctagtgagtgacatgtgatgtactaggtgtacagtactctacaaaattgacaggagacctacaaaattgacaggagactgttctagctcgcagtctcgcaccgtgcgacacccccgacgaagcaatggtgcagtgagatacatactcctatataaaaatgtttaccaataaacctttttcgaagttgtttagcttctaactttttttcaaacttctaactttttcatcacatcaaaattttactactcacaccaacttttaacttttttcttcaaacttccaatttcagtcaaatttctaattttgatgtggaactaaacacaaccatgttgttttaccagctaaagtttcgttttttttattcacacactgacatggaacatgctagcttgtgaaacttctagtaactgctgtacattttaaatttaaaagacgatcgtttgtttggagataacatgaactaattatatatatagaccacggcaaattttaaaatttactacaatttaatcagctgcaggagtagtctgtatttatctggccatattttctttagaatcaataatatcaatgtatattattgtctatattagctgaatatataagtacatcctttaatttctttcaaggctgggttaattctattgtgttctggtattcagcttaaccactttgctagtgaatgtgttctccggaccgctaaatggtgaatattaaaaaagtatagaaaagtttattttagaaaaaaatcaagtaataaatctatttttaagtttacaaagttaaattcaattaatcatgtcatattgactcgcatgctacttttaaatattataattttatttgaagtagaagtctaatgaaggcggatgcggcacggctaccgtggcgggcacgagttggagtggagcagctcgtagagcataccggtgcttcttggtggtcaacgatgacgtgaaagtcgaaaaagccatagatgttgataaggctcgggcgcagagagaggagaggatgtgaatctaacggtgatgatagaaaatatgattgtgatggtattgtttttagggtgtgtttagttcacgctaaaattaaaagtttggttgaaattggaacgatgtgactgaaaagttggaagtttgtgtgtaggagagttttgatgtgatggaaaagttagaagtttgaagaaaaagtttggaactaaactcggtcttaattttacaaaaaattcagtaacatgtaggagtagcaaatattacggatagtaatagtatttttataatataacgattatgcaatggtatattggcatgtatcggattaatcctaggacaaatatccgtagccagtcggtctatcagtctgtagctggtctggttaacaagtgttgtgtctgcgttgtttttctgcaccctctcgagtccaatcgcttatactgtatccttgcatcaagtgttgacaagtttatctactaccactatagtacagtactttctccgttacatacagaaccaatctaatacttgatgttgatatacttcatccgtattttaatgtatgacgccgttaaatttttaaccaacgtttgaccattcgttttatttaaaacttttgtataaatataaaaatatttatgtcatgcataaagaatatttgatgataaatcaagtcacaataaaataaatgatgattacataaatttttttataagacgaaaggtcaaacgtttattaaaaagttaatggcgtcgtacattaaaatacggagggagggagggagtatcatattatcatgctttgctgtaactgtaattgtcaatccaaaatacggaatactatggctgtcttgggtgctgagcgaggcactatgaggtcccattgtttcgtttattcatgaaataaactaaacaacatatttacaaatgaaaagtaaatttatggctaaacttttatatatgtgttcttagcgatctaaaagcaaagactgaaaaataaacttgaataaaaaaaactccaaaatcagcatcaaatttaatgttgaaaaatcaaattttagctgataagtataaccatgagcgaaaatatgagatcctgtgattgacgccggttgtccaaattacggttggtcgtgggcctctagctaaacctcaaatatttaaactccttttctagaaaagaacatatatatatatatatatatatatatatatatatatatatatatatatatatagtatatatattgttttgcgaaattggtaagacgtttctctattttctctagcaccttcactgctactgtaaaaaaaaaccgctaatagccaggtaacccctgaggcctaacctctaacctctatggtttttaatagaatcgtttaggattatttaatctctcagtgctaaaaaaaaactcatttaagaactagcacaactacgtacataaactatttctgtagacggacaaaaccagttttcttatgcggttggcatcccgcatgcaaaaaaaatatctatgaaatacatttttctgcatgcggctagcataatcgtatgggtagatcaatctttgcatgcgagcaaatctacgtaccgctcgaatgggaagagcccattaaccgttactagtatagactaatatctaacggtcctgaataatcaatagtttttaattaagaacccttagatcgagtctaaatatttgtctgctctgatttggtggaaatgcgtaatatataaaccttagagaaataaacaaaacaacctttctattttaaatctaaaaaatatacttcgacaaaaaaatcactctaaaatttaagtttcaaaatttacatgtggctcatgagcttaattacaagtagataaggagagcctagttgcgtagtattcattctgtctcgctgaataaaacgtattgaatttttgtgtaacagtacttctattgtagatactagctacactgtctactacagatgacatgactatcatttttcgtagcatgaaaaatcaacatagttcgtaatgctttttggctagagctagctggccacttttatggagaatgcactggtttatcctctgggacaagcccgtaaggaatattgagtcgaacggtcgaatcggcgttgtgtgagagccatctgtaataaacgcattagttactccattcattctaagctaaaataaacaatttgatacgatatatatgatacatcttagtacaacaaattagttattaagataatatatttagattcgttacagaatgtgtcccattaagtttgtttattttgaaaacgaaggaagtgcttaagggaggagtactgtgtttacagctgatgtgatagtgtgtgatgttttgattggataaaacgactgtgtcaccctcccacatactactaaattattacgtggcactctaataaattgatgaacctatttattttttttaaaataaaggccccatatacctcacctctctatcctctttacccaaatacctaattgtagttttatattgtgtacgtgggtacgtgcctcctccctcccctcctacttggtctcccctcttccttttttttaagaaaattaaaagtaataaattccataattttcgaaaagagtagtgacatgggacatggacatgtactgtagcactatctagtggaccacccccccccccccgcgttgccccc

SEQ ID NO: 63797 - DNA, 4111 bp, Oryza sativa
atatgggggacgtggatgtatcgatggtgttgatgtcctcatcacttagcaacatcatcacgcaaaatatcttcagagacatgggatgcaacacaattttcttatcatggtacagaaaagagtactggtttgacctaccatgatgcatagaatccctatcaaattgccatggtctacctagtagaatattacatgcttgcatgggcacaacatcacattcaacaacatcatggtaatttccaattgcaaaattaatgtgcaccagttttgttaccttcgccttaccactgttgttcagccattgtatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctcccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcatttggcctatggatgccattgaagaagcactcggtgctggctgagcagcctttgtcgctgacttgtcactagatggaggaggtgctgctcgactggttgtgggtgtggaagatagagaagcaatacggccggccggaggagtggtgcgttgccatgatgaagttttacctgtagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcatgtcacatgcatcgtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaagaaattcatggcatgcaaatttttggtcaacagcaatctcccaagagaggtacgcatcaggatcatattttccatcaaaggaggaatcttaaatttaattttagaaaaagcatcatcattgttgcgtacctcgcgtcggcggcgaccacccatacctcgtcgattgttgtgtagccgtcgacgatcttgagcatctcgatcatcttgttcagtgtcagcaatatattcatcctctaaattatcctcgacgtactctccgtcaatgtcatcgtcattacccccaccattgcctccagcattgagagcatcaaaatgcctcacaagagcagcaaggctagtgtcaatgcgggcgaccgctgtctccaaccctgtaagcttagtgtttgtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacgaggtgtatcggtgctgtagcaacaagaccagtcaagctgtagtcgggtttgtggtggagctgtttgtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtggaaggtggtgacaaagggggaatggtggggtgtgctcactggatcctctttttttttttgcttgctctctctagtgctgaggagagagacacaactttttttttattattattttgatatttttttcacaaccaggagcacactagaaccaaccacagaaaatcttatctcaaacggacaaagtatgaagcttgtagaattttttcaaagttgtatgcgaataggtcccgaagcttctcgccacaaaaacagaattttgcaagaggaatttggcgattttaaatttgccgaacccgacgtagcggggagaatcggatgtaactttttttgtagatgtccgtggatatattataagcctaatttcgagtccgtatgaaaaagatatgactgttttaaggaaggtcactcgaatcagggttctatttcctttctagtggcggcaggatacatggcaactcacaaaagctatcggcaacagatcaaacacaaatagaaagtgatttggtgggtgactgcgatggtggtgacggtggtgatgacgcaaaattgatgaaggtggcgatgtgcggtggtggcaagaactggaaactctaatcgcctaacactaagaccagcaaattaacacaaccgatgcaatcgaaaactcaacaagacttaactaagcagtactagtaaaaaggcacaattgtctataggatcacgggaaaactaatctactattttttttggacttttctggactataggaaaaaaaattaatgacgaagggaagggtaaattctctcaccgatgaaccacgctctgataccacctgatgcgaacccgctagggtttgtggcccgatctttcgatgagaggtaagggataactcaattagatgaagacgacgttcacgacccgactacaactgtccaaagacgctgggccttagcaaccgatacaccgtctccaatggtcgccgcgaacttgtggtgcgcgtcaacccggccacgagggcactcgtcctgcaagcaatcgaagaacaagcaagaacaagtaggacaagcattgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttctttgtggcgactagaggtataagaagaggggaagaacgaccatagggtcgtgctcctaccctaggacgcgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacacccaaatcggagttcgcatgaagtcgtggcggccatcagaagttggcgctgccctacagtccgaatccaccccgcgcgaatcctcttccctttgggtcctctccatcgttcctagtaaaacacgagtgcacgcgtctccggggtataaagacgaggaatatgaactcaagaaagaactcacctgataatttagttgacgtgcacgagcgcgggtaataggaccatcatgttgtacatggggggacgtggatgtatcgatggtgttgatgtcctcatcacagcccataatcgcgggcatggctattcgaatagttttactctgatcagaggtgtacaactgtacccacaagacacagccccacgaca

SEQ ID NO: 63798 - DNA, 856 bp, Oryza sativa
acccttcccaagcatgggcattgccagttttttccaaccaaagccatcaaatgcgcatagctcaactcttatattccaaattgtggattctcaaaccaccgtacataagggaccaacaaacctgctcccaagcaaccaaacaatttgccaccgttagccttttcatgacctgcccaaagaaagcctcttcgtatcttgtcaatagccttgattactgttagggttggaattgtgttccaccgaagggggaaggatgcggaacgacggggaacacaagcgcgcgaaggcgatgggaacgcaaagccagtgggcgcgagttgcgcgtgccagattgctacaggactttagcttcatctcaattagttaggattcactctcaagttatttagcaaatattatccattttcttcagctaaattagttacaaatgtttgttcttgtaagggcagactcaaggaataaagcaagccgaattaatctcatctactattttccatttcctcgtctccttccgattgcattcatcagcgccctgggtcgccgatctaccaagctccctaagcgtcggctgcctacatctcattcatatcctattcgatcattgccaggagctcgtgacaactttgtatcagaccatggaagaaacctccactgccaaacaaccgcttctggaaccctggtcccctcgacaagctgcaggacaatggtggatgtcctcgccagcatttcgctgctcgcgtccaagattgatatggttgatctcagtcgatcggtcgccgttgcgacttctcgcatcactgcacttgagcagttccaggttgcgtcgtctacatctacgtccaacaacgcgccctgg

SEQ ID NO: 63799 - DNA, 15771 bp, Oryza sativa
caatccctagttcaatatctagtcatgttatatcccaagctaacaaaggagcatggtacaaaaatagcatggctataagagaaggtaaacatcccatggtatcattgtaaaacaatgcaatatttgaaggaaaacaatagaacatttacaatataggatcaacatgttcaagtgacaagcatgacttgccttgctctgctgctggaggaacctcggcgactaattcaaagtacaccggagcgtcgggagagccggaatctaagcgtcatacaaagcaaacaatacaaacagactataagactactgaaacagagaacaaaaccatttttactggattctatgcatttttcttgatttactgagacttgaatgggcttaaacagagctcggatgaattttctatgaattttagcagattcccggggagagagacgcggcgccgacatgcgggccccacatggcagtgactcggggggcggtccgcggtggactgggtccacggaccgggtaagggacggcgcaccatgtggtgcacacgtggcgccgacgcggcgcacacgtggcggccacatggcagccacgcgggcggcgggattggatggccccgatctaccctcgcgacgggagcgcgtggccggcgcgcacgggcggctcatgccggcttggtggccatggcgcacggcggctcgactcgacatagcggcggtgcaaggcggcgaccggctggcggcggagggcggcggcgtcgcggcgacgcggatggtgatagcggcggctaagcggctaggcggcggcgcggcggctaagcggcgcgggagagagggagaaaggggaggaggtgcctcaccgacggcgattgacgacggcgagcgacggaggacgatgacgacagcgggacgagctccggaaccacctagcgaacacgatgaaaggggttagagagagagaggaagatggaagagagcgagaacgccggccgaaggcggcggccatggtggtgctcaccggcgcacggtgcggagtgggttccggcggtggattccgacggaggaggggtggacgggatgatccacacgacggcgaacgcgacggcgtcgacggcgcgactcggcatagcggctagcggcgaccggagcagcggcggcagcggcggcggggaggagggcgacggcgctagggtggtggagtgcacgggagcgggcgattgcaaaacgaaaaagagagaggagggaacgggggtgctttatatagactcacgagggttgatcgtggccggggagaccgcgatttcgccagcgtagtggggagaggtggggaggagagagaggcgggattcaaaaattgaatctcggccgtctcgagcacgagagcaggcaggagagagagggagtgggcgcggggaaggcgggcgcgggcggcgacgtgggcgatgtggcccgggagatgcaggagcgagcggggcggcggttgcgggatgcggcggcgccagctggaggtgggagacgggcccgacaggtgggccccacctgtcggcgacccaaagggggagggaggcgaccggctgagctgagcctcggcctttggccggcctagtggggagggggagaggaagagaatgggccggcggcccattcgaaaaggaaagaaaaagagggaaaaagaaagaaaaggaaggaaatgaatttccagggaattaaatattgcttgtgctcatttttaattggttaaaattatttctagagctctgaaaattccactaaaaatcttcttaacgtatttcgacatgtagaactgaagaaaaatcccacatgccagttccgattattatttgcattaattcctttagggtttctctcttgcttttacaccgatattttcttgagaccatttataaattcaatttaggcttgggaaaagaacttcagggagtgacaattcagaaccaagttgatagagctgttgaaggaattcagagattgcttatcttgggagtattatgagatgcccggactcagccgatcgattgttgaacatcggctacttatgtcacgtcccaaaacgactctaaaatatatcctttaaattatgcctagaataattaaaatccttgtggaagcctccaaaaattaaaatgtgcaaagttaaaagtcaaataaggcttggaggatttttgtatatttcctaaaagcctaaaatgtgtaaataaatttcagtggaattttccgagcgcaaataacaattatcaagaaataaacaaagttgaaaaggctttatgaaaagaaaaaccctaaaaccctctcccctctctcttgggccgaattcagcccaactccatccccttctctctcctctcgccgcagcccactcggcttcccctcccttcccgcgtgcgcgccgctgacgggcgggcccgcccgccaccctcgctgacgggaaggggcccacccgtcatccccctcctcccgccgctccgtcactccctctgcccgcgcctagcgccgccgccgctgcaaatcccgccgcccccgaccgttcccgcgtgccattaagtggggggaaatattccccgtgattccctctccctttccccccattttcccccctctctcccgcaaatctcgccggcgccattgatgccgaccgggacccccgcgccggtttccttccccgccgtccaccctctctcactcccaaacctatataaaccctccccgcaccttccttgtcagtttccgccgtttgccgcccctcctccccattggattcgcgcccgcgccatcgtcctctctctctgccattgccgtcgacctccggctgggcccagccgctcgccaggaccatcccccgcctcggcgtcgtctcctccggcttcgccgcaccaccgccgaccccatccaccgcctcgccgagctcgccgaccgccgaaacgctgccgtccccgtcgacccgagccgcaccaccgcctccctccactccggtcgcctcctccgtcgccgtcgtcgccccgtggaccgccgcctctttcccccttcccttactctctctcggccgccgctgggccgcgcctatggccaccgccggcgaccataggggcgcaggcgccgcctcccgccggccgcgctgacgtggccgcctccgggcgcgccgtgtggccgccgcgtggggcccagccgtctgccgcccgtgccctcgggtacggctgacgcgtggggcccacggcgccggctggtgagcagcgagtgcacccggtccaccgtggaccgaggagctgctgcgtgggacccaccactcccgtggacccggtgcacgcaccccctcccctcggttgacgcaataaaccctatttttaattaaaatttaaatgaagaaattcgcaaatattcacattaagagcatataaacttcaaatggccatatctttgccgtttgaactcggaattggaacgttcaagtctctaacttttccttaagaagtcaggaacctatttttgtgctttgtttctgcttgttatatggattttattagagtaaaagcctttttctttccattggtcatgtagacgctgcagcttcggaagatccgctctacgtggagcttgaagctgatgtttgggaaagcgagcaaggcaagtcacatcatccttgaacatattgaatcccaggttataaaattagtttggtttaaattactgcattatcgctttatttaaattcccgcgttatcactgttttatttagccatgcctatttacctttgttatgaccttattattattgctattgttattattaccttgttcaccctaggataaacaaaaccctaactagtgggtaccctattcatggttccactagtatgaatttagctagctgcttcgctgattaattaggcaacattaggtggttttataaccttagtctttgggaatgctcatatcatttggacattatggaatggttggattattggaaatagacacacacacctgggtttagcctgggctcgaggtgcatggttttgatagtagcacctcggccactacaaggaccagtcttcgggcctctgttacaaagcactaccgtacttccacatgtctagtgggtaaggcttagtttgtggctctgtctggtcatgggcaaaagtacacggatagagatggacatctctagggcaaatgagggctacacgagctgcggctcggtagtcgagatgtcatgccacagggccggtgtcctgctgctaggggctcaaccttggttacctttctcgggaatcccggccgtagccagggttgggtcggtactcttgtttatggctaggatgggttgggaactatgtcacgtcttgcgtccgtatgccgtggtggtatgtggcacatggttacacgtgaggaagatgtgtcttgtgggtaaagatatacacctctgatcagagtataatctattcgaatagccgcgccctcggttatgggcaagcctagcaatgtacccaagttagtgttttaattcttaaaacctgcttaacaactaaaatgttgaatggttggcctgggttggcttgggacgagctgggacctgggtctggttgccagttcggtctgaatcatcgtaggccttgggttaaggcaggttcgtgcgggttcacggccttgattaataacattgtgtagctctagaatcgtctttacaaaatagcttcgggcatctaagtgacttttaaatgctgtttactgcaaaccctaacccctttattataactcccttgtactcctttgcatttattctgcattcgtgggtgtgtcttgttgagtacgatggttgtactcaatcttgctcaatttttccccaacccagaagaggagttcctggaggatgaaggctttggtgtctagctcgtgcctgtcgtcaagtgcctatggtcgtcaccctagtcttccgctgttttccgtttatcttcgtgtgtgctgggccttcatcgcccatgtaataaattaactatttatgcttccgcttgttaaactctgaattgtatcaacttttgatgtaccttgcctcctgggacaaggaacaatacacgcacgtatggaatgcccgttgggttaattccggtcgtgacaacctatcaaaccaggggttaggccacaccaacaacctcctagaagatgcaaagccgatatgcttgaacctgtcaaggctgagattaaacggttatatgatgctggttttattcgtccttgccgatatgcctagtgggtttctagtatagttcctgttatcaagaagaacagcaaggtgagggtgtgcattgacttcagagatttacataaagctaccccaaaggacgagtatccaatgccagtagctgatcagctggttgatgctgcctcaggacacaagattttaagttttatcgatggtaatataggatacaatcaaatctttatggccgaagaagatatccataagacagtttttaggtgtcctagtgcaatcggcttgtttgagtgggttgtaatgagttttggcttgacaagtgctggggggctacatatcaaagagccatgaattatatatatcatgatctgatcggctggttggtcgaggtctacattgatgatgtggttgttaaatctaaagagatagaagaccacatagctgatttgaggaaggtttttgagagaaccaggaaatatggcctgaagatgaacccgacaaaatgtgcttttggcgtatcagctggccagttcttgaggtttcttgttcatgagagggggatcgaggtaactcaaaggagtgttaatgcaatcaagaagattcagcctccggagaacaagacagagttacaggagatgatcggcaagataaattttgttaggaggtttatttctaatttatctggacggttagagccttttacaccattattaatattgaaagccgatcaaaagtttacttggagggcagagcaatagaaagctttggataatattaagaaatatcttagctctcctccaattttgattcctccacagaaggggacaccttttaggttatatctgtcggccggtgagaagtcaatcggctcggtctggattcatgagctcgaagggaaagaaagagttgtattctacttgagtcatcggctcttggatgcagagactagatattctcctgtggagaagttgtgcttgtgcttatatttttcatgtacaaggttaaggcattatctattgtccaacgaatgcactgtcatatgcaaagccgatgtcgttaaatacatgttatcggctccaattttgaaaggaagggttggaaagtggatattttccttaactgagtttgaccttcggtatgagtcattgaaggcggtcaaagggcaagctatagccgattttattgtagaacatcgtgatgattcaatcggctcggttgagattgttccatgaactttattctttgatgggtcagtatgcactcatggttgtggcatcggcttggttataatttcccctcaggaggcacgttttgagtttgcttatactatcaaaccttatgcaaccaacaattaagctaagtatgaggtagttcttaaagggttgcaattgctcaaggaagttgaaaccgatgctattgaaattatgggggattctttgctagtaatcagtcaattggcaggaaaatatgaatgcaagaatgatacattaatggtttataatgagaagtgccaagaactaatgagggaatttcggctggttactttgaggcatatatctctcgagagcaaaatattgaagctaatgatttggcccaaggggcatcagggtataagccgatgatcaaagatgttaaggttgtagttgctgtaataacagcctatgattggagatatgatgtgcatcaatatttacagaatcgatctcagtcggcttctcggaaattgagatataaggcgttaaagtatacttttttggttgacgaactctattatcggacgattgatggggtgttgcttaagtgtttgagtgccgatcaggctaaggttgcaatcggcgaagttcatgaagggatttgcggcactcatcaatcggctcataagatgaagtggttgcttcgacgtgcagggtatttttggccaacaatgctagaggattgtttcaaatattacaaagggtgtcaagattgtcagaaatttggagcaattcagagggcaccggcgtcagctatgaatcctatcattaagccatggccatttagaggttggggaattgatatgatcggcatgattaatccaccatcgagtaaaggacataagtttatattggtggcaaccgattattttaccaagtgggtggaggcgattcctttgaagaaggttgattctggggatgctatacaatttgtttaagaacatataatctatcgatttggtattcctcaaacgtaacagccctaaaatttgacaactttttaaaaccgatttagtttgctttaatcttctaaaaaaaataaccgtcgagttagtagttcatttaaaatattattttccatgtttgtattcgacgtttcttttctcatttgattttgtcgcaaagtgcatatcatccctcaaataattcctttgatctgatttaattctatcccgaatatcggaccatctaaattccacaccaattcaaatcctatctattttaatcttccccaaattttccttttctctatttccaccttaattttatttttccatattttttttcctttttctatttttgttccctctccttccctttctttgtttttcttttctttcttcttcctctactcggctaggccgagccaggcgaagccagcccgatgcaagccgcgctcgagctgcctcacgccaaccctgtgccgcctcgcgccgcgctcgcgctgagctcatgccgccccgcgcgcgccacacgcccgcacacgctcgcacgaggacgaacgacgaatgaatgccgccgcgacacctccatcttcccgcttctgtaactccttcgtctctcaactagaaggctcaagactggaggcaaaagaagcgcattttcaacctctttcacctcatcaagtccgcccctacttccgctgaatcaaatcgtcatcaccggaggaaaaatccccgaaaccctaaatttgcaccattgatagagctcccaaattcgtcacatacattgcaaatcctctgaaattgaaggtaaaaacggattctccatgccgagtactccctttcccctctctttccccatccaatccgtcgccggaatgccaccggtgccgcctcccggcgtcgccctctgttcggccgccgccagccgtacggcgcgccgccgctcccgaccgccccaggccgagttgccgccaccaccgcgctccccttccttccctgatgcttaccaggcccgttgccctcaccggagttcgccggaaccaccgccaccatggccgccgccgcctccagctcctggccgccgtcgccagcctcgccgccgctgcctgcgccgccaccaaccatgggaacggagtcgctgcaccctgtagatcgcaaaactggcgcccctttgcccaaaaccggccatctccaccactgacgccatggagtggtcggccgttcctgtgcagaacgagaagaagaagaaaaatccgattttcctattgaaaaataaatcagaaaaatcctttttcttattctatcaagttgaccatccgtttgtcctcgaaatcgaaatccgacacctattccaaactcctagaattattccgaatccatccgtgtcagtttcgttgtaatccgagcacccgttgtcgcgaccctaattttagccatagggttcgccgttcaccgaaattccaaaaaaatccctaaaattatttctttaaatccttttcacccattgttgcactttgtgatactattttcttttgtttatcttttttttctgttatttattgtggtgatgattgttgcgtcaatagaaaacgctgacgttggtccggtagtcgaagcgagtgaaatctccacggtaggaggagacggtttgtacgactacatcgagcccgaaggttgaaagacatgcaccctcctttgaacaatttaatcccagtagttagagagttattttggtagcgtacttgtcctttggagtacgatagactgcacgaattcttttaaattaattatattgcaattattgcattatatttttctgttgtttttataaataccttaatgagccttagagtctaacaaacttaggataaattttgataaacacttaaacaaatggttaattatttaacatgctattgatttaatatggatattattattgcatatgaaaacatacttatggaactatttatggctatatgctaagagctgttgacaccgcatgtgagcaggtggtacacatgatagagttcatgtgtttggttttatggacctgtttatggtcgtgatggatatatgtatatatttatggttatttcttatttaaaattgatataataatcaaccaccttgtgtcaataagaatgacatagttggccacacgatcgatttgtcgaacctggccgtatattgctccaattgattgaacttctgtaggcctttcggtgtactggccattagctttcaagtgtatgaagcaaagtgacatggttcatgtttatatgatttatatatgtgggcttgatgggccccgagaattcagaactaccctatgggtccatgaagttctgggctgcccatcgagtaacaaacaatggtaagtggatgcggaggtaggttggcacacacctcggaccggatcactccgagcaacatcccgagcatcctttaacttactaggcagaagggagagatatatggagcaatattacaccttgttacttttcagcccggccagctgtgggtatcgtgtgggtaaagctaggcagacgctgcagagtcgttgagtattcgtatacgccgtgctctcggttaatggagatgtgtctatgggtgattccagattatgggcacaagttaaactaaatggctactaattaatatggttaacttatttattatttgatgttctatttaagttatctataagtaagatttgtattttttttatgctcgttattattgtttaaattaaatgttcaatagtgttgtttatattaaatgtttattaagttagcctctaagaaataactgttaaggttagggtttaaaccttccagctctcaatactgcatgtttatcataagcatgtcttgctgagtaccatttgtactcataaatgggttcagatcatgaagaggaagatgcatgtggagaacctgttgatctgtgttggcggatggcatgaggccctgcgaccaaacctgccgaaacccatggcgaaggctatggagcgagagcggcgcaaggcgaagagtagcgccaggccagaggcgtctcaggcgaagggtgcaaggcgaagactgtctgccgaaggaggatgacttcgccttgacaagttcgcccccgcgagggccgaggaaacctttccggcccatcaggccggcgatcgccagacggcccatcaggggcccatgagcccctataacattatgtacccctgtaaatgccccttctgtaagggtaatcatgtaaattcccctgtacaacctaaaccctggtagtaaggacctgtaatggggctataaatagtctcctagggccatgtaatggggggatcccaagtaaaattcaaaatttagtacacttcatttttccaaccactgttgagtaaccacgtctttcgacgtatgcagttttcgtttcgacaacagctggcgccgaccgtggggactccgagcgaaaccactgagagcgaatgccaccgaagagggtcgtgaaggagaaggttgccaggcggaaggagagcgacgccggaccagacatggccgccgaggaaggagcagagccttcggcgcccgtggccgaagctggaggagcacaagcgccatcacaaccgccttcggcccctgcaacctcggtgcacgtgccgaacgaggccgacgtggcaaaggcggctgcggcggcaagggcactccagaccagggcggagatcctttcgacaagccaaccggtggtgccccaggcagctccatcacagccggcagctaccacaaccgcgctcaccgttgtacagtcccaaaccagccttgaccccgaagcacaagccgaagccgacatggaagccatgcggcagaacatgacacggctccaagacatgcttcgccaaatgcaagaacaacaacaagcatacgaggcggcaaggcgggtcaaggccacgtcggctccaatccttcagtattcggcaggctatgtcccacatcaagtccatccgcaagtgacgacccagccctttccgccacaagccgcacaggcgccggtgtagttcgccgggcagcatcaaccaactggccaagtgccacaaacagtggcggaagggacttcggctctgcaggcgcaactccaagctttccttcagcaactcaaccaaccccactacatttcaagtacaaccccatcggttcacccggtggggaatacaagtcaaggtgcgcctacttggttgccatcgattcagtcaggctcgggagcttcgccgtggaatcagggactgtagttcgactgcgccaacgttgctcaggcgccaaccgttcggcagcaagctccgaccccaggcttcggaacaaaccaagcaccaatccaagctgctatgacgtggtcgcagccaatttttgacccatccatggcggctcagcaagtgcctccagttggagccgggcagccgaacgccatggcccaacctcacgcacaagctgcgatttcgcccttcaccagaccgtacccgcagcaaggtgcggtaaacagggcgggaggcgaaaaggggctaccgctgagtgggggaatcaagactcatccaatcccaccccagttcaagttcccacccgtcccgcgctattcaggcgaaactgacccgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcaattgcgcgatgtttttgtccttaactttcgaggcacctacgaggagccgaaggcgcaacaacacctactcggcattcgccaaaggccggggaagtcgataagggagtacatgagtcgcttctcgcaagcccggtgccaagttcaagacataaccgaggcgtcggtcataaacgccgcatcggctggtctgcttgagggcgaactaacgagaaaaatcgccaacaaggagccgcagacgctcgaacacctacttcgcattattgacgggttcgcaaggggtgaggaggattctaggcgacgacaagctatacaagctgagtatgataaaggctccgtcgccgctgctcaagctcaagcgcaagttcaaattgccgaaccacctcccctctctgttcgccagtctcagccggcgatccagggacagccaccaaggcaaggccaagcccccatgacttggagaaagttcagaacagatcgagcgggcaaggctgtgatggctgtcgaagaagtgcaagccctccgcaaggagttcgacgcccagcaaacaagcaaccatcagcagctagcccgcaagaaggtccgaaaagacctctactgcgcctttcacggacgctcttcgcacaccacagagcaatgccgaaacattaggcaacatggcaacgcgtaagacccaaggccgcagcagggagcaactgtcgaagcaccccgtgaagcagtccaggagcaaacacccccagccgaacaacgccaagatacacaacgaagggtaatccaagtgattaaaagagccgacccgccaagccagttgtcgaaatggtagagaaagatgcagatccgcatggtccacagcatcacttcggcgggtgagggggcgccacagtacgtgaaccagctgatctctttcgggccagaagacgccgaaggagtcctgttcccgcatcaagatccactggtgatctcagctgagatagccggttttgaagttcgatgaatcctggtcgatggagggagttcggtcgacgtgatcttccccgaagcatatgctaagatgggcttgccaacccaagctcttacaccggcacaaacgtcgctccgggggttcagcggagaggcagtgcaagttcttggccaagcacttttgctgatagctttcggctcgggagaaaacaggcgcgaagagcaaatactgttcgacgtcgtcaacatcccatacaactacaatgccatcttcggccgtgcaaccctgaacaagttcgaagccatttcccaccacaattatctcaagctcaagatgcctggcccaaaaggggtgatagtagtcaaggggcttcagcattcggccgcttcaaaactcaatctagccataatcaacagagcagtgcacaatgttgagaccgaaccgcatgagcggccgaagcacacgccgaagcccacccctcacggcaaggtaacgaaagtgcagattgatgatgccgaccccacaaaactcgtatcactggggggcgacatgggcgaagaagaagttgagagcatactagaggtgctcaaaaagaacatcgatatcttcgcctggagccctgacgaggtggggggcgtcccggcggatctcatcatgcatcacctagcagtcaagccggatattaagccaagaaaataaaagttgcgcaagatgtctgccgatcgccaagaagcggtgaaggccgaagtacaaaaattactccgggcgggggttatccaagagattgatgatccggagtggttggcgaatccagtgctggtgcggaagtcaaacggcaaatggcgcatgtgtgtcgatttcacagatctgaacaaggcgtgtccgaaagacgatttccccttgccgcgaatcgaccagctcgtggattcaacagctggatgtgagctcatgagtttcctggatgcatattccggttaccaccagatccacatgaactcgctcgacatccccaaaatgtccttcatcactctattcggcacattttgaagccttcgtcaaaatgaagcctccgtcaagcgtacatgaagtacaaaagcttgcaggagctaaagcaatacttgcaaagcccaccagctctgaaaagcccacccctaggaagcgaactgctattatacttggcagcttcgccagtggcagtcagtgctgcactcgtccaagaaacagagtctggacagaaaccggtctacttcgtctccgaagcactgcaaggagcgaagacaaggtacattgaaatggaaaagcttgcttacgctctagtaatggcttcgcgcaagctcaagaactacttccaggcccacaaagtcatagtcccatcacagtaccccttgggcgaaatactccgatgcaaggaagtcactggccggctcagcaagtgggcggcagagctatgcccgttcgacatgcattttgttgcacgctctgctatcaagtctcaagtgctagctgactttgtagctgaatggacaccggtacttgcccccgaccccgagcccgacgaccagttctgggtgatgtgctctgacagttcgtggtcgcacaagggggcaggcgttgcggcagtcctcttttcgccgaatggtgtgccgattcggtacgcagcgagattgcagttcgacacaaccaacaatgcagcggaatacgaagccgttctccttggcctaagaaaggcgaaagcactgggagtccggcgcctactaattcgaactgactccaagttggtagcaggccatgttgacaaatccttcgaggcaaaagaagagggaatgaagaggtatctggaggctgttcggtccataaaaaatgcttcaccggcataacggtcgaacacttgcctagagaccaaaatgaggaagcagacgccttggcgaaatccgctgcttgtggtggcccgcattcgcctggcatctttttcgaagtcctacatgctccaagtgtgcccatggacagctcggaagtcatgacaatcgaccaagagaaactgggcgaagacccatatgactggcgaaccccatttgtgaaacaccttgaaactggctggcttccggtagacgaagcagaagtgaagtgtttgcaactcagagccacgaagtataagatggtctcgggtcagctttaccgctccggggtacttcaacccttacatcgtttcatctcttttgtcgaaggcgaagaaatggcaaaggaaatacaccaggggctatgtggcgcgcaccaggctgcaagaacagtggcctccaaagtgtttagacaaggagtttattggcccactgtgttgaaagtctgtgttgagcaaatcaagaagtgcaaaagttgccagcgtcatggccaaagccaagccgtgccccagtatgatctgcagcccattgcaccaatatggcccttcgccagatggggactggacattattgggccattcccggtggcgcgaaacgggtataaatttgcaattgtagctatggaatatttctctcgatagatcgaagccgaaccccttgggttaatcacttcggcagcagtacagaagtttgtatggaaaaacattgtttgccatttcggggtg

SEQ ID NO: 63800 - DNA, 2925 bp, Oryza sativa
agctaagcacaggagtaggatattatgcttctcaacggcccaaacctgtataaacccctttatctcattgttcttgaggggcccaacaccctctacaccacacttctcaccgagtcctcgaatctcacccgctgtccccggccaaaccaacaaagggggcctcactgtcccccgcttgcggagttcaccctccgacagtcagccttctcatctccatgcctccttccttacttttcttataagcccttgactatgcaaatctaaaggatagggggttgttcacaatgccaccctctggttccccatcctctgctggtaaagagaggaaggggattcaccctgccaatagatctagtagtttggttagatttttctctaaataaagttttaattttttgttttgcctcatcgacgtcaatggcggtggcgatgccacaatggtggatcttctagtgttggtccctatccatcttgtctcggtggtctattttatggggtgtgattggctatgggcttcgtttcacctagcttcgtcgcatgggtgaaaatgatggcgttctttgtaataacagtcctccaattctatctctttgcttcaccggtggtccatctggcactagtgaagggattgtgagggtcgtgtggttgcgccgatggatggtggagcggaggagcaaatctggtttgggtttgggtgtaacatacccaaattttagaccttaaaaatttcctgtcaaaatagttggaagttaagttttttatttttgggagccaaaaatttccattttaaacctaggtaaactttgatctaactcttgcatgaataaaatttgagaacaaactttttcatctttaacctatagcatagatgcaaacacaagtgtaagcatgcatacttgcataaaacatattttaacttgagtcttctttatgcatttggatttttggttggcattgcatattaggacccatgagcataaataaaagataaagattcactaagcaaacctataaccacacttgagcaataattataaagacatgaaaatgaagtcaaatgataccacctcaggtcaagagtagtctaaataaatttcttacaactatgtagatccatttataaattggaaacctatataaagaaaagtcttgctaattatctaaaataatttgtgcaagataaaatcatgggaaaattcatgtaggctctacttaaaacatgcaactcatagtaattttggtacaatttaataactaaatttaatatctcaaataaatcagtcaaaccagtcaaataatagtttaattataatccttaatcggctaaaaacctaccctcactaattgtgcattaaactgcatggaagtgtataggggaaataatttattcaaatattaggttaattatcatgaataaatataattttttcagaatttatcttctctacttagttctcctaaaaattcaaattagtttccaataagcccatcttcttttaatttctgtaatttctgtgagcaatctatccataatttttgagtagaaaacgttaactaggtacattcatttacctccaataaaatccacacgacctcatatgcaacacgaattaatctatgaattaacaagttagggaagagaaaataatctgaaaattcgtccaaaaatctctttcacacagttttctacccatccccacactccagcctagtgtacttcgccctgggcccacctgacggtgtcacaagctagctccaactctgtgcagaaccttcccaccgatctaaagactgagagaaaaagagagaacgagagagagagagagagccgaccgagctctggggcgcgtcgacgcgtggccgagacgtgtcgccgctccaaacccaacatctcttgatctcttccctcccagccgcttcacccatcactactcctcactctcaaaccgaagaagccgagggagaaggctctctgctcctccggcgctctcaatctcgtaaccggccgcgaagaagaaggacggcagcaatcgtcgtcgagccgcggtcatctcctcccttcatgcgttcccttgtctactcaggatgccggcttcattcctctaagtttcatcccatttggtgcagcggatcgtcgggaacgcggacctcaccatcgttgctccggagcgcgcaccgagtgccgccgtcgggttctcgtcgtcgttccgaccgctgtagaccaagccaagccgagccgtcgcgccaacatattctccttgaagtcctcctcaaaacccttcaagaatcccaggcaatggcgcagcaagtgcggagatcggccaccgtcttcttcacctccggtcgccgtcgccattgtcgattccgcctcctccggtgagccattattagattactcgcgcacacaccatctctctggcctcactaacctcatggacacacatgcatgatagttcttggagccgattgagccgtcgccgttcaccccggaggttcttgccgccgccgagccgttacacgagccgccgtcgtcaacctagcttcgccagccttgttttacatctcggtgagcacactggactccttagaaaagcacatgcatgcactcccttagtcgattcgcgcctatggcacaacatgcctacccatgccaaaacatcctccgctcggactcgccgccggcgttactccgatgtccactaaccgagaaaagtataggaatggaatcacaataacatgatcttcatttttattttggtcgtacccccaaacgagtcatcgtttgccgccggcgagctcgagatcgagctcggccatggcgctctgttctcgcagggacttcgttttgagaatttaaataaatataacgttcatgagaatttatttatttaaatataacgtttaaataaataaatttaaataaac

SEQ ID NO: 63801 - DNA, 3862 bp, Oryza sativa
acattttgataaggtataagctatagtgcaatcagcacaatgtcaacacaaacatgagcttagacttatttagggtgtatggctcttgcatacttgccaaataaattaacaaatatctccctagatatatcgccgtcttttgttgtttgctttattttaccaaatattttcatagtgttggcacgggcatatatttttaaaagtaaaagtagtctcacatctgtgtgaaacattatcaatgagattgagtgaaagttattcaagctacattatttcatttactccttcctacaatcaacatgaatacagattcatgtgtgtgagaccagctgccagatggtgtcaaccgtcaagagatcatatatatgttccatgacttccatgaaatcaatggtgaaaacaacatgatcttttgataatcgtcaatgagtcatgcgtctgatattgtgtgaaggttgtccttatcaaggtagtaagagctgttagcattatttcatcttctatgcaactctgctaaagcagtaaaaatatttttcttcaatgtaagcccacgactatggtggctcaaatttggtatatgaggataaacatgttattaaatgaaaccctttttacttccaaaagatttgattgcgggaacggatccatattatgggaaaaactaaggacatatttgtttttctccaaaatcaactcgtgattgaaattatgctggtattgatcgtattgttgttttcatgtcgttggttggcaaattcgcagaaaaattatctgcttttcttaattgatcatggctgcttcaaataaaattatgtcggctcatgtattttttttacatgaggtccaagtaaataatcctaaatataagccgatgctacaagtcaactaaaaagaatttgatgtgtaatattgtctgttgaatttgtgtttatacaataatttcttaaatatatcgggtattattaggatttagatgatttctaaatatacaaaagttggaatgttattttacacacatggctatgcaattattagttaagataactctatgtgttctttccatgtgaatcttaatataacattatatacttcattgtcaaaatataactaaatattaccgtagtgttagcgcgggcaaattaatagtaccctatactaatccaccaactgcgtcttacatcttattcctcattgattggttaggatcggatccaacgactcaggttgcttccaccttctccccctaatccatgatctctctccctaatctttcccctaacggcaccccgccgcattgcctgcctccgtcctctccgcatgtccctaaccctaatcgtcgcccaccgccgctgctcattctcgtccgctctgtcgcccgtgccgatctcgcccacccacatcgccagcgacgtctgcctcgccggtctcagcgcctccgccggaacacccatgctcgcgctgcgccaccaccgatcgaatccccgccgccaccgatctcgctcgttcccgttttccaattctccaggtctgttggtctctctcaaaaaatttccatggatacttttggaaaattgaatggagggttgccaaaaaaaaaatgaattgagtggtatctgtgttactactatctttcatctggattatttttacatggcattgtgcatataaaatacaaattgtttcttcaatgaggcactttcatgtcagcaaatttctaatggagatttctgtgatctgtaataatggtcgtcatctgaataaaattcatgtcgttcttttttttttttgacgcaacatgtcgttctttactaatttgcagtttatattcttggttatataagcagttacattgtgaatttttgtttgtgtagacctgggcatatttggcttactttcagcaacagaaatagagcagatcaatgatggaattgcattctactgctgtcccaaaaggtttttgatcaacatcttccagttcgatcagatactggcttttgttatgcctaaggggctataccatgcatggtgtcatcattatcatattttccaagttcttgacaaaaattgagcaaaatgagatgtgacaacgagaagacagaaagtgccattgcataccaggtgctcaagaaatatgatgatgcctcacaacaagatgatctttgaggcatgagaggtacaattttctaccttattttttctgcactaaaatgaatgttctgcttaatattgtcttctttgtttggtaacggaggtggcttatagctatgttagttttatgcatgttttggaatagttcacgatagcatttctgttagtaagatattctttgcataatattgatgcaaagtgagcactgcagtctgcaattcaacaaatgaatgattttgtaccttcatttgcatcggaacgaggttaaaagaacgaagtttgcctcattgtcaaattctccggaaataaagttcaggataaaaaactgaaatagaaggacatttgcctaattttcgcggatttaggtgcttaaaatattttactgtgtaatgtctgaaatttctattgatgaccagctgagctccattagatgtttcacatgggcatttatgttgaaattgctgttaagttcacctataaaccgtttagctaagtgcgatggtggcttacactgtattttccggttagaaattatagaggacagaaaaggcagttatgtttattatgcacctgtattttactaaaagttttgcagtctcaactgattgggacacttggagctactttagctgtttagcagtgttttaatttgggtacaagattacagattctaactggtcacgtgctcaattttctgttattaatgaactgcggttgacaatgagtgatagtctttcttagttttcatatctgaaattaaaatgagaaaacactgtacactccacatagttttttctgttgaaaaaagtcaattgtataatggtaagcatttaaaataacttgatactggtatattagcgaagtgtattaatttgtgttgctgccaattttaatacaattctcctttgcacacagtttaaatcatgttaagaatctgcagccagatgcttatggaactttttttaatgcagggtatttttggaactaaacattcccagtaatgcttttttttctctttcaagctttgatgcgataaaagatctccataaatatgctaagctaagtatgttttccttacgaaattgcatatcgttgcttctttaatctttactatgcccttaattcagatagcccttaattctttaatatgcccaaaattccttacagatagtgtattttgctctatactcttttgccttttcaatgattaaaaggtttatttttcacactctttcaaattcagaaattgctgggtgatcttgagggtacgtatatcttcctataagtggaagcctgaaattgggtgggcttataataactagaggtaatttctactctgatcttgaaatggactgcaagaacaaaacatgagcacctgctatggttggaggaaggacactgtatatatcagattgcttcataacatcacaagaagaaaatgtccatgtttaattttgagtaaatttcacaaaactacaggtattttgcacaatttatcacaaaactacagatttaagagcttatttcacaaaactacagatttagtgtcttcatttatcacaaaactacagttacattgttcaatctatcacaaaactacagatttaagaactgtttcacaaaaatataaatttagtgtattcgtttatcacagtgctacacatttagtgtcttcatttatcacaaaactacagatttagtgtctccattctca

SEQ ID NO: 63802 - DNA, 18252 bp, Oryza sativa
gtggcctcacctgtgacgggcgccaaccgtggagccgtcacaggtaagaccacctgtgacgggcccaacactctgggccgtcccaggtgaggtcacctgtgacggccctacagatagagcccgtcacaggtgagtttgcctagaacaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaaattcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatattttctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcaattcagttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacataaaattcgatggcctcttcggtggtgtaactctcgatgatactcccctcggggtgtgaacggttccgtacataacccttaaggatccctaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccaattgcatggaagaaggaacacaaccgctggatcgtgtgtcgcaccttaggaggcaaaatattccttattgcaacgggcaacagctgtgtgataagaacgtggcaatcatgcgacttcattccaatcaacttaagatcttgcagtgaaacgagtctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttttttttccacatgctcttctcttttgtcttttgtttttccacatgctcctttgttttttccttcgatgtgctcttctcttttcgctttccaactttcctcttttttccaaactcgttggttattcccatcactaagttgtgcacctctgtccctgttagctctgtcggggttccggctgtatctctgtgtccattgaaattctttctcatattcctatacgggtgataccttgggagaaatctcctgtgacccatgtagaccgtcttgtgtcaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcatcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgtacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctatgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatctatctacgatccatctgaaatcaacaacatacgaagaaaaataaatcatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtattttatagacccaacacacctcaaacgggttagataaaaaaaaacccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaagtgaggggatacctgtgacggtccgcggccggatggctcaccggtgacgttatcccgtctgacccgtcagaggtaatggtcactagtgaccaaatcgtttgcccgtcacaggtatcccgtcagaggtgtgaggatctggcgtagtgattacattgaaaattgttaaaaaatatatcaaaacatgaaatgtgcaacaaagttttattccaactgaaacatcaaatttcaacatttcaatcatattattttttcatcagaatatcatcatgtgaggtctttttctaaagatttaattggagtaaatacaatagtgcaactggatcctagatcatataagttttttatcagacaagtcatttaatattttccaaagcacttatgcatgcatggacaaaggcgtaggacaagcaataccaacattgagagaagctagcgaccactgcctgatcgatgcaccagcagaggattacgacacgatggtggtcatcacgtgctacacgaccgagatacagagtactattagagagcgtagaccagctcatcaaccgttggttacacaggttatattgggcctgattcaccactggtccgaccaacaccacaactctaggtcctcgaacctacacaacccaaatgagtaggtgataggtgcagaatgccctcatattttgagtcgtgctctcgtatcgtcggttacgactaaaattaacaatctcctccatcaccagcagccctaacaatctcctccgtcacatcaaaccatgtggcctcgaagacttatttcggtctaggcccaacaatctcttttgttgtatcatagcctatgcgacctaggcccttgacttttagcaacatagaactaaacccaatagagaggaaggattggagagttatggtaatggcatttctcctactctccgctcgaagactatggcaccaccgccaccaaatacctttcctgcctccgggcgcaaactttgctagttagatctgctgctgtcggctagccatcattgcatcgctaggtctggatttgcaatcatcatctagtccttatcaccgccctttgaactgatggcattgtggatgagatcggtagctcaagtcatggggcagggaacgaggtcgccggcgtcacattgccattggggaagcgtccaagtgcagaaatctcaatgacatcgggggattattgttgggaccctcagtggaagaaggcagcctaagcatgcctaggattgtgcagttgttggcacgtggcggtggtggccacagcggaggagacgaggataggtcttcgtcgttgatgggttgaggaggatagcttgatgtggaggcaaatgccctcagcctaatcaggcggagagggagagtggcgttgccattaaggatgctcctcccaagttgtcccaacaatgctgagagctccaatttagaaaagattggctaccggtgatctatggaggtggcagattcgaagccaggtatgtgcggggtaggacaatggaagtctccagtctctgggcggtgtagccaaccgtcttctctggcatgctcccttccacctcatggtttcttcctcaccatttgctcctcctatgcttatcgcaggtaaaggggaagctgaagggaaaatgaacggcctcttccctcggtcaatttctatccagtgcagcaagatccaaaaattactggagtggttttggcagaaagagttggtcagatacatagtataagatatgaacacgatagttgaagagagttacaatgggagaagtgtgaagaggatgggaaggggaaacatgaccttgggatgctagtgttgtgggatggtggaagggtgtgatgcacgtcgtttagttcaagtaactcgcaaagtgctagatagtccttgcccttttgacaatgtaagatatttcaaaaaaaatgaaaatatatcttttttcattggttttacataaatatacatgtactgaagaaatttgcagaagtataccactgtcgcagggcggtccggcgagatcgcaagagtcaccacggtctcgctctgcgagggcgtgagaccgacttcccatccatactctgtgattaataaattaactagcataattagaaattaattaattaatattattgtaattagcattattaataatcaattaacattaattaggataattaatcactaattaactattttttgaagcgctgtcgcttttttgcatgcgagatcgcatggtctcagctcagactcgcgttgtggttgtgtgagaccgcgcggtctcacgctcccaccccgcgagaccacccacatcgtcattctcacgcaatggttcagcgtgtcttatcgatctcgcactctcatatagcgatgacagtatatttgtgccaaaagaattacagcccgaatatttcttagaaaaaatgaacagtatatactctaagaaggataactacgtagatctccactgacgtggatttaatgaaatccgttataatgggtcctatgcctagaaggatgtatagatttattcactatttctggactaacatgaatgtttctcgggactgtccaacaattctacaatctacatatatatagacagacatatatacgcatatattgatagattggttggtacgctaacaaccgcagcaaccagcatatatacgcgaggcgacctgccctcggttggcctaagctcaaaattcacaacagagaactcgtcataatgtctctagtggatttttggaacaaatggggtgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcattgagagggcctgaacctgtctaaatcctttgtctccacatccatccacttttaggtctcgtgcgttaccccgttttattattgccgaattcatgtttcgacagttggcgcgccaggtaggggttcgccgagtttcctgtcaacaagtgtgatggaatcaatttcatgattcgtcggcttcgtctttgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgatatctcctgtatctccgcaaaaatctccgcttcgggagctacactttgtggttacaacaatgaccaggttcgccgttccaatctaccaattattagattggtctcagatttaactactaattaaatcaatctatgtcttgcatgcactgattgttggctgtgccctccgagtcccctgatcgtcacgagagacaaccacggctggctagttgcataagacagctgattggatcaatctcggactcggctgactcaacatggaaaatcaaaaacacggagcagtacatacaagcagcaattttcactttgtcagctcgagtattttttaatgaagacgtatggctgcgggcacacgcgagctatatcaatgctcaaacttatccagcaattactggtcatcgcatgcgtttgtacgtgcctggaacaactatgtacctgtatgcataaacacataccaacagaagatctgcacatgcatatgatttttgctacgagagtctgggccatatatgtcgccgacgactttgtcaagtttctcttcaactcggactggaacacgacagacaaccttcaatctaggatacaaaacgggctggactaccatgtcaatattggtggccatcatcatcaccggcttaccttcaccgccgccgactggtgtctctgcctacacagctggcctattatgccaccgttgttggacgtctacgacttcaccctgggcctgcctccgtcgccgccgactggtgccctcgcctatacggttggttggtcacaccaccgttcatgggcgtccacgtcttcactgatcggccggacttcgccaccgccgactgttgtccacgcctaagcggttggttggtcacaccaccgttcatgggcgtccacgtcttcaccgaccggctggactccgccgccgcctactggtgtttccgcctgcacggccggcctattatgccgccgttgtcgggcgtccacgacttcaccgccggcctgcctccgtcgccgccgactggtgtcctcgccttcacgattggtgtactccgtcgccgttgctgatgtcaaccatgtcttcactactggctgcagtcatcgccgccgaccggtgttttcattgctattgatggacgacttgttcccgcatcggctacttctgccatcaccaagggaatattgaaaagctaagtcatcatttattttattctttatatgatatttttccttttcctctacctcactacaccaattggtcttccattgagtagtgagtcgggggctacagatgttatatcatatttttcataatatttatcttgattgcttgcgacataatctgagtacaaaagtgcctatcgagttatggagttccatcttcctatgctttccgtttggtttgccaatggatagttgcctttaggccgattcgtagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcttgaatttttctcgagtattatatttacatcagatactactcatcctatatatttgttctgcaggatccaaatccagatatgcataaaagggattcatggctttgagcttatctcttacgctccaggaatggatcagtcagaacatcaccaccggctcgccgtcgtcgccgccgactggtgtcttcgcctatacggttggttggtcacaacaccgttgtcaggcgtctacattttcaccgccggtttgctttcgccgccgccgactggtgtcaccgcctacacggctggcctattatgccgctgttgttgggcgtctacctcttcaccgactggccgcctcgtccgccgccgactagtgtttccgcctgcacgctggcctattatgccaccgctgatgggcgtctacgtcttcaccgaccggcttgccttcgccgccgccgactggtgtctccgtctgcacggctggcctattatgccgtcgttgttgggcgtatacgactccaccatcggcctgcctccatcgccgccgactggtgtttccgcctgcacgctggcctattatgccaccgttgatgggcgtctacgtcttcaccgaccggcttgccttcgccgccgccgactggtgtctccgtctgcacggctggcctattatgccgtcgttgttgggcgtctacgactccaccaccggcctgcctccatcgccgccgactggtgtttccgtctgcacggctggcctattatgccgccgttgttgggcgtctacgtcttcaccgaccggccgcctcgtccgtcgccgactggtgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttctgtcgccgactgattatgccgccgccgactggtgcttttatcttcacaactgcgcgtcttcactaccggtttgcttctgttgccgccgacttgtgttcacttcattacggcaatacaactttgtcaccatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcgggggctacacaaatataaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagtgtcttcgtcattatcattggttgctacactgctattgactggatcaccgacatcgtcatctttatcaatatcctgccaagcctcttcaacatagcctattctactgctgtttgatgggcaacttcgtcctcatagtcgatcatctctgttgctgcttatcatcattactgtcggttgtgtttgtcgtcgccgactattttcttcatcttcatgattggtggatttcgtcatcgcctttgatgcgtgtctacatcttcactgtcggcttgctttcgtcaccaccgactggtatcctcgccttcacggatggcttattatgtcgccactaatgggcatctttatcttcttcaccagctgcctcgtctgtcaccgactgattatttcgttgccatggctacacaactttatcactgggcgccttcatattcattgctggctgacctgactgctaccgactggtttcttcgcttccacggctgtgcaacttcatcactttagattggtatcactatcttcactaccatcaatatttttgccacctctggtagacaatattatctctatattggtcgtcttgtctctatgccaactgcgccagctaccatcaatggacaattgtgactacgacagaaggacaagctatatgctcaggggcttactagctcaaacacaagtatcatacctccaatttggacttgttccggatacatgcaacatgaattcataatcatgggtctattttctatgctcaaagactggactatttattattccccgtaagggttatcaaccgaatacttgcgccagtcgggatttaattattatatttattttggaatatcctataagggataatcactcagatcagaagcgattgatatgagctacacttggtctatatcacccgttccaaatttattactcggaagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtagaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatattacttggatcatattattcagggattcacaccgcatatgctacatattaatattaagtcgcttggttgaatacaattatcgaaaccactcggtgcatctagtcgatgcacctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcattgagagggcctgaacctgtctaaatcctttgtctccacatccatccacttttaggtctcgtgcgttaccccgttttattattgccgaattcatgtttcgacatgggggatacaattctttgtactcctcagcctcgcgctgcaggtcattctcctcctcctggctggtactcgccggcgtaaagtactcgtgccaaagatcatcctgtggatagcttaccagctggccgactcgacggcgatatacgcccttgggaacctctccttcggcagcgtggcaattgaagagcaccgtctggcagcattttgggcaccattcttgttgctgcacctcggtggcccagacaacatcacggcctatgcactagaggacaacaaactctggttgcgccacgcactgaatcttattttccaggtaatcggagcttgctatgtggtctacaagcatattatcgttcgcagggaggccacaatccttagagtggccaccggattgatctccgccgtgggcgttgtcaagtattgtgagagaacatgggcgctctatcgcagcaattttagcagcatcgggagctctctcgaggagttacagggtaaccaactccattggtaccaagggtacctacacaatgaggatcataacaacactaacaatgaattccttctgcaacgtgctcactccctgtttcacatatgtaagcgtgggatagtagactccgtgatcaatgaggatactgagaatgctgaggcggaaaccaccaaggaaataatcaacaatcttagtgaagagccccagcggatgtataaggtaatggagatggaactgtccctgatgtacgatattctctataccaaggcagccgtagtccacacttggattggctactgcatccgagccttgtcaccctttgctattgccacctcctttctgctgttctatttctgcggcagcgaggtcaaggatggccagaatggagtcgacaccgctgttacctatgtcctgttaggcggtgccctcttgatggaaacaacgtccctcctcagcgctctggggtcaagctggacgctttccttcttgtgcgccaggaggtggagttggcttcaacatgtcgctctatgtgtcggaagatggtaccagctccgacgggcagtcctggctgttcgcaagcgcgtcgcagccttgacgggaggccttctcggtggatcaagaaactggtcgggcaccataggacagttcaatttgctctacttccgtgccacgcaggtcaacccaaccaacaagcaattcggtaggctcattaagaagctagggtatggtgacgagtgggacaccggttgttatttgtgggacatcacaattcccgagctggtgaagcagaaagcattgagaatggtctccaagtatgatctcaacaccatgggcttgctcaggcataattggggtgaactggcactgaaaaagcatactgaaccctcaaaaaaaaataaaaattgtactgaactgctggaagagctagagaaattgtggggtgacgacttccacgggagcatcatcatctgccacattgccacagaccttatcctcgctgagatagaaaagaacaaggccggcgaagacgacgcagcacaactccagtgtgtcggctcgatcagggcactatccaactacttgatgttcctccttgtggctcacccggatatgcttcgaggccttccccaaaaatggttgtaccagcggacctgtgagaacgttgatcaaaactgcaaagagcatcgtgaagaactcatttcttctggtggaaaggctaataatgtgatctttatggtgctcatgaagctgttcggtggccatagtaatagctcaacatctattgggctcaggcagacgaatgcactcgctaaaatcctatacaagagcctgcccagccaatttgaccccgcaattcctcgccttacttatgcaaggttggttgccaaggaaataataaattggaaagatgaagatggtcaattgaagaagccagatgcaatattgaaggtgctgcttaacctgtggacagattttctcctctatgctgccaacaggtgtaacagggagtctcatgccaagaagctcaacactggtggtgagtttattactattgtgtggctaatggttgaacacatatacaaaacaaaatcaaaaggaaaaaaagttgtacctgtcgggccatgataatatctattgttagtgttatatattctctctatattcaatcttaaaggatattactgtaacattcccaaaacgtgtaaacttcaaaccatctgttctcagcaatataattgtttccctttgcgtgctttttttttgttatgttgctggattttcttgcatggcatatatagttgcatctgatgtgcattatcaaattgtcttagaagaattcatacaacttatatgtgcataaaaaaatttgacattccaaaaaaaaactaaattttcgccaattttgtcaactcatttgatacgtcgattgaatcagtcaaagttgataaaacaggaattaaaccataaattttagggttgggaaatcaaaaaaatgccactctattcgctttattggctgggtgccactgaaattttgtaaaattagagatatgccactccgtcacagcaactgccaatacctccgttagctctgttatcgcagatccctttcttctccaactcaggcaaaaatctggcggcgctcaggctcgtcgacgacggggtagagagggcttctccggtgagggtggagggaagcgccgagcccgagccccgcgctggaggagaggggcggtgacggatcccgcgccaccgatggaagctggacgggagcagctcaacccccgcgctggaggaagacggcgtgcagaggatacgcgggtcgccggcgacggcggtggtgatgtcagcggcggagaggccgaggtcggcgaggaagacgacgacggcgtctggcctagacggcgatttgaggtgtgagatggtcttggaggcagcgcgaggcagcgcaggtcgttgacggtgtggaggaagcgctcgtcttcgtcgccgacgaaccggagaaagatgaggtgtgagatagccttggaggcggcgcgaggcagcgcaggtcgttgacggtgtggaggaagtgctcgtcttcgtcaccgtcaaaccggagcaagataaggtgtgagatggtcttggatgtgcgaggcagcgcaggttgtcgatggtgtggaggaagcgctcgtctttgtcgctgtcaatctccgaggtcgagccgcagcagcagcgccgcctcgtccgcctctccgtcgagctcagcatgccggatatgagaaaggtgggaggggatgaggatggaaacagagacggcatgagagaggagatgaaaaaatggtttggagtggcatggttctaattttagtaattcccagtggcatataaccgatatgatgaatagtagtggtatttttttaatttcacaaagttttagtggcatggatctaattaaccctaaatttcaaccctcttcagtcttcacaattttgccacattcaaaccatagcaaatatgtctaccaaacctctcacatatgttgtatacattagttactcggcttgctgtattaaacccagaatttttgggcaagctagctagccatgcaagaacttcccaacccaataactaggatgatgtttataagatgatgtttatagcattaaagaagctaccacctaggatgaataatgatgtggcaagtgaataaataaaaaaagagaaggaaaccatgtctcgcataagacatgatttctacacaatatctaagacatcatgtgagataagtagcattaaatttaagtatgaaatagtggtgtttgtattggaagaaaattactacctccgtcctatattacttgtcgctttgagtttttgtttgtaaaatttgattattcgtcttatttcaaaaaattttgaaattattatttattttatctgtgacttgcttaattatcaaaagtactttaagtattacttatccttttttatatttgcataaatttttcaaataaaatgaatggtcaaacgttgaaagaaaaaagttaaagcgacaactattacgggacagaggtagtatctagtactagtttcttgatgatgtagagtttataaaaactatagctatgtctagtgtattgggttaggaatggccttaaactatccgtttttaactcagtatgctaccgctttgtccatctccggtttccagcgaaagaggtcccgcaccgacactttgatctcctcctgtgattccacttgacctggatcaacttgttatgcgcatgaatgttggccatcatcttgcttagttccgaaagttgtttctccgcctcgtctgtcatgatctgtgctcctgaatgatagcgtggcttgccagaaaacctctaggtcgataggtcgactgctctgatacaggatgttatgtttcttgatacaaagaagacaagggaaatgcgaacagagaaacgacttgcattggaagaagaagcagttggaagcggtgtggaaaaaatctaattattgtattttgtttgttttctgatctattacatcgaacctttcatggggtatatataaaagtacacaggggatagagaatataagtaagagtagatttatctctaggactctatcttatctctaggattatatctctaggaaatatcttacctctatatttgtatttgactgttatctctaaccgacatagctatcttttcaacaagcggtaaaattttggattggggagatagagcccgtgtttagcttgtacaagttcagcgagattgctaaggggcgatcgatcgcccctagcgatcgcccatagcacgccccccctctccacctccacgtggtttcttttttagcactgcattatttttctattttagtaaa

SEQ ID NO: 63803 - DNA, 978 bp, Oryza sativa
ggtcactgagacccttctactgaagtatgaaccccatgtaaattaaaatgcagatatatatgtacaaacacaggtgcaatgaaaaaaggaagttgaattcctgccggtttatagtcaaatgaactccaacattaggcaaccgaccagatcgtatgtctgacagagagtaaacacatgaagcaacagtgcatgtatccctgttcttgaatcatccgtgcaaccccaagccccagctaggattctttggcctgcatagatgggatgtgttgcgtacatggaagcaatgtagcatgtcccaaccctccatctagaatggtgtctatagcattaactacattgccatgtaaaacttttagcttatgtggcactatattaattaagtgagagagtgaagagaggaagaaactgggtctcatgcaagacacagcttcaacacgagaacctatacactagacactatcaagttttgtattgggagagaataatgtcttcataatagatgaagaataaatatgattggtagagaagagagatgatgtatttattaatggcccactttaagaaaccatgggttgaagtgtagtttctatcgtgatgtcttattaagatggcttcatacacactacttatggatactataggttgggactgccctcatggtttctttgacatatatgcatcgatcaagtcatcaagaacaagaacaaaggcgtgttctcacaggctcgcagccggccgatgaaattcagatcagagaattcaatgctatgattcacgtacggttgcaaataacaacgtgatcgattttgcaagataaaagaaaaacaacagcgtgattttacaagtatgatcggtgtggtcagattatgagattatgactactatatgcatgttaacactgttaatttatcagcacgtgaaaaagtttacccttcccctcatttcaccccagaaagcacatacaattactttgtctaa

SEQ ID NO: 63804 - DNA, 996 bp, Oryza sativa
cccgtacagatcacttagtttagtagtaattccttttgcatcatttacgcaaatccatttgatgagatcctcttggtttgtggttgcacgggtcaggagtcggttctcagcggagtaattttactccatgaagctttttccgtgttgcatttggggattttttttctcccccgactccggttggttgcaatccttttcatttttacaaagtgcaaaacactgaaataggtttttgattgcttgattatttgttcttttatgagaaggggaaaaagaagggtgagtgcactgtgccgaatctgcttccctttaggcctttaggttggatgctccagtgatgactgaattcacatcatatatcgttccaattcctgaatgcagctcctatgggatgttgcacgtttgtggagatgaagagacatctgaggagttcagttccgttgttttttattgctcaatgtttgaacctttcgttttcagttttcttcgtttgtattttgttttatcctaaaagaactattccataaaccgtcggctgaacgactgcggttgcacgattcatatcacataaccacgagtatgttggtcctaaggtttcacaaaaccacaatgttaaccaatctatcttagtactattacaaaaataaaaaaataattaacttagattactacagcatttatacaatgaaattaaagaaactaatatatttcagatataagtttataactcatgtgcatgatacatcaaacaaaaaatagttaatggtgtggttttatgaaattataaagccataatacctgtggttacgtgtaacgcaccaaaacccctatggttttgtgcaacttggaccataatacctagggttttgtgaaatttattccttttttcctactccggtggtttgcattcctttgcttcctttcggtatgctccaatgatgactgaattgacatcatatatcgttccaattcgtgaatgcagcatcctataagatg

SEQ ID NO: 63805 - DNA, 710 bp, Oryza sativa
aaatattttctatatatagtatttctatacatctaatgtttatacacccaaagtttataagtcaaaagtttacatacccgattcaaatttgaatttaaattcaaatatccgattcaaatttgaatttgaattcaaatatttttaatatatagtatttctatacatctaaagtttatacacctaaagtttatatacccaaagtttgtaagtcaaaagtttacatacccgattcaaatttaaatttgaattcaaattttttatatatagtatttctttacataaatttttctaacttttatttttttaaaaaaatattgtggcttactgtagtagggaagagaaggggaggagagggacgtacttataggggagcgggtgcgggtgatcgcgcgcattatcagtccctgtgggcggcgagagggaggcgttcgcgggcaacgctagcaacagcaaggatgtcgttggagaccaggaacgggaggagcagtacatcgacgagcttgttggttatctcatacgctacacctgatcagcaaacaaaaaataattataacgaaaacgtatagtttaatatacttaacgatttaaaaactagcaattttaaaaaaataaattactactttctaggttctaaaatgttgctatctaagacggaatgtgacctattattggacaacgagtctgtacagatgctttgcccaatttcatcg

SEQ ID NO: 63806 - DNA, 706 bp, Oryza sativa
ggcctaggagatctgcttagttccagtgcaggtccaaatcttgataagatgcaggcgtgccagtcagtttgatcttacaactgacaagatatacaaatagcagatcaatgaaccaatcgactgacaagccgatagattaattccagctgatgccgataccagctgatagcgatagagttttgagctatcggttatatgtttgatgtagataacaatataaaggcaatcggctaatgatgatgtaacaacataacaataatataatccagtagaaaccaatcggctaacaatgacatgatagaataaacactgatccgaaggttaaagcatacatcggctgaaggtccgatgccataaaatccaaacgattagataaacagtaaaatctttgttgcgatcggctaaatccattatgtatgcaatcgttgtaagccgatgcaatgtccagataactcatcagctgaaaccccgatgaaacccttattagcaatcaagaaacaagctagagattatggttctaaacatgacttagtagatcaaacttaattgatgcagcactaagtatgaaaagaaacataatatctagacaatcaaacccttaactgattttcggggtggtagatatctaagtcaatctaatctagcaagacgatttagccgataccggcagaaaccctaaagcgagaagcagccgatagagctaaat

SEQ ID NO: 63807 - DNA, 503 bp, Oryza sativa
ttctcaacggcccgaacctgtataaaccgctattgtctcatctccctaggggggcccgaccccctcttattcacactccaccacagaatcctcgaataccaatcactacccccggccgaaccaaaaaaggggggcctcatggttccctggtggaggagttcacccgccgacatctattctcttaaatctttctctcgtcaccacttcaaattattttttcatctgtggagaaatggggggccagattggtataaagaatattctcaatggatcattaagcaagatcgtgagtggacttaagtgaaaccgaagtctaaggatctgagatcttcagtcgtagtatagcctagtatttcttttgcaaatgttgttcaatctgagcgttcagttccctcatctatgatccctgtctaaaaggtttttgattctttgaaaaagagtatactggataagaattctagatctgtcaaagatcagcttgatttcaatgtgccaaatcattc

SEQ ID NO: 63808 - DNA, 15155 bp, Oryza sativa
ctcctaccacgtgaggccgggcggcagcggcagggagacgggcagccgagcaggcggcaggcgaggccggcgaggcggcgggcggccggcgagacgagtctggcgaggcccgcgaggcggcgggcggccgggcgggcgaggccggcgaggcccgcgaggcggcgcgcggccgggcgggcgagtccggcgaggcccgcgaggcggcaggcggccgggcaggcgggcggtgagacccgcgtggcggcactccccaggcgggcggcgaggcggcgggtggtggtgctcccggtgcggcggcgctccccaggcggcagcggagcccgaggcggccggcgggaggccggtgaggcggtggacggccggcgcccgatctctgtgatatggttttttttctgatctgtgtgatatgtgcggccgatctatgcgatgtcgattttttttctgatctgtgtgatgtgtgatgtgtgaatgaatttgtggagatgttttttgaatgatttgtgatgtatttggggataaaaatgcagcttgatgtatttggggattttgtgattgatctgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaacattagtcccggttgttaattctaaccgggactaaatctttagtcccagtttttaacactaaccgggactaagatcctctttagtcccggttattttaaccggggctaaaaatatgtatctttagttccggattcgtagttccggttgtataaccgggactatagggacgttgtgaaccggtattaaaaagggtttgtccaccattgcgagcctccccaagtgcggcaccacgtggctcaaggccctcgctttcgcctccatggcgcgccgcgcgcacccgccgccgcccgccgtcggcgacggcgacgcgcagctgctgcaccacccgctcctccggctcaacccgcacgactgcgtcccgttcatggagaagctgttcgccgccgggttggggagcaagatcatggacgcgctgccgtcgccgaggctcatggccacgcacatgcaccactcgcttctccccacctccatcagcgacaaccttgactgcgaaatcatatacatatgcaggtgaatgatttttttgctacttcctccgtttttaggttataagatgtttttgactttcgttcaaagttaaactgtttcaagtttaactaagttttttaggttataagatgtttttgactttcgttcaaagttaaactgtttcaagtttaactaagtttatagccaagtatagtaataattaaattaccaaaatatttttaataagttaataattaaatatatttttataataaatttatcttgagtaaaaaacattaatatttttttctacaaacttagttaaatttgaagcagtttgactttgatcaaagttaaaacgtacatcttataacctaaaacggagggagtatataataataagaaccactatatactacaataacattatctagtactcatatacgacatgattgtatcatatcataggacaaaccttgggtttccgtatctaaatttgaccgtccgtcttatttgaaaaaattataaaaaaaattaaaaaggtaagtcaaagtattaatcatgttttatcatctaacaataatggaaatattaattataaaaaaaatttcatataagacgaacagttaaacgttagacacggaaaccacgatttgtctttttctgggaaggagggagtatgtggcagttcgccagaagaatactacctgagctccaattccatgacgtgtttgagctttgcttgtgagggtcgctgcttgagcggccctatttggaaccacatcgtcggttactggaacgcgagcaaggcgaggccggagacggtgttgttcttgaggtacgaagagatgctgcagtaccccatcgacaattttaggaagctggctcgattcgtcgggcaaccattctcgcccgacgaggaggaggctggtgtcgtgatggactcatggacatcgtgaggttgtgcagctttgagaagatgaaaaatctgaaggtcaacaaggcagactcatctcctgtacatgtgcctcgtaacaacacatttgcgaatgactctttctttagaagaggtggagcaggagactggacgaaccacatgacaccagagatggctcgacgtttggacgctatcatgaatgagaagctccatggaacaggcatctctttctcgtgatcaacacgttaattagttgaaactctcataaataaagattacaacatcgacgaagttcctgaagtgtatgtaaagaggtatgtaaagattattattgtaagatggcacgctctatcaccagagcgactctatgaaatatatatttagatcgagtgaataagttggaaattaaacatacacacgcgtgtgtgatagataactttatcaccacatcacttggtgtgtacttattagtgtcagcaaagaaataatttgagccatcaatttataagggtacgcaagtacctttttctaactatgttttgaatattcatgtctctagtttagatatttctttctcaatattataatatgaaaaagaatcaaagagactatatcttaattgtttcatgtggttcatagttggcagtctcgcctatcactcctgaaagctatgtcccaactgacccccaaaaataattcgcagatcgaaaagctcgaacgtacacaacaaattaattaaggaatgaaaaagcaaaaagaaaaaagaaaagaaaagaaaagttacccgtttgttatgctgtccaatcgatggccaattctctcagattcgatccaattccaagccgttcttttaagaaaactcatataccacatgagaaacatttatttattgggactacctatacattttgtcgataaattttctcctaaaaattttacagatataattatagtacaatcgtagtgtaattacactgtaacttgcatgtaactacagtgtaacttatatataagtttcacataattttgaatcgttagatctattacaagatttgttttggtgaggaagaaaacaaatcatagcacacacatataaaagaatttgttcccacgacctccaatttaccgaaataacatgttacggagagatttttgaaagttacatacaagttacactatagttacaatgtaattacatacaagttacagtgtaattacactacgattgtactataattacatctgtcaaatttttgaggaaaattttgtcgacaaatatatagcaaatcgttatttatttaaggaaaaagtacgaattaccccccgaactatcgtggtcgaccgaattaccccctgaaccacaaaaccggacattactcaccctgaactttcaatactggacgaattacccccctggacccaattcagagcggttttatcctacttggcgtacgcgtggcatccagtcaacattttcttttaaaaaaatagagggacccaagtgtcatacctacccttcccctcttcccctctctctctcttcactcactctctcggcgagatcgcgaggacacagagagcggcggttacagcagcgttgtcgtcgtgggacacagaggaatgcggaggccgcgacggcgctggacactgaggccgcggcggcgtgggaagagccggcggcgacgcgggatgcggaggccacgtgttacgatcgggctagagattttggggattttggaaggaagaggatgacagagaacagaacgagagagaaatacttgagcagaggaaagagcagtagagacagagtttggtttcaagtttacagctcaaatatttgatatcctttcctctctctacctgtgcttatatacatgcacggcatacagctggcctaagaccactccggcccagagactcggacattcggccttctctccctttgaggtcgtttcccagacttcacaggattattctcccttaccggttcagatacagtagcagcacccgtaacattccttcccccttcgaaagcggcttgcccccaagccggcgcatccggaaatcgaagacgcaaagccgcagcatcttcccaggtagcctcacttgatgattgacctgtccaacgaaccaagacttgttccacagctccagctcctttcttcgaaactcgccgggcgagaacttgaacaggaaccacctcctctggtgccatggtaggaagagcacgaacatcagtcgcagtggttggtgccacagcttgtcgaagttgggagacatgaacaacgggatgaatcgagcaatcatccggcaatcgtagtcgataagccactgctcccaccttattcagtacctgaaaaggtccgaaatagcgaaaagcaagtttgtgattggtatgcccggtaagagaactctgtgcataaggttgagccttcaaaaaacccaatctcccgtagcgaactcgcggtcagaacgcttcttgtcgacctgaaatttcattcgttgctgagctcgtaaaagatgctgacgcaacaaactggagattactgcccgttccttcagccacttgtcaagatctggaactgcacattcagctgtactcgacaccccaaaatgacgaggaggatgcccataaagtacctcaaatggagacctctcaagcgctgaatgataagcagtgttataccaaaattctgctaaagcccaccaacggaaccacttctttggacaggcatgcacaaaacagcggagaaatgtctccaaacactggttgacacgctccgtttgcccatccgtctgtaggtgataagcagtacttaacttcagacgagtatccgtcaactgaaataactctgtccacaaggcgctggtaaaaatacggactctgtccgaaatgatatgatgtggcaatccataaagtttataaacattgttcagataagccaaagcaacatcaaaagcggtgaatgggtgcactaaagccaggaaatgggcatacttactgaatttatcaacgaccaccagtatgcagtcaaaacctgctgaagaaggcaacccttcaataaaatcaagtgaaacagttacccaggcatgctccggcacaggtagaggttgcaaaagaccggggtaacgcacacgttcagcttttgcttgcttacagatcgaacagttggacacaaactggcgaacggcctgcttcaaacccggccatgcaaacaagcgccgcactctgctgtaagtaacttgtataccagaatgcccacccacggcagagcaatggaaagcagacagaattttaagttgcaattcagagtttgcacccagccaaatgagcctcatataatagagaataccattcttcagagaataagaaggaaattgactaggagagagcaacactttagcgagcaattgagaagtgcaaatatcagaatcataacccttctgaacttcctccaaccaagagggcacgcaagatgacacagtactcaattgatacacctcattggatctgcaacgagacaacacatcagctgccttattctcaagacctttcttgtataccagccggtaagataagccaagtaatttggttaatgctcgttgttgccaagatgtcaccaaacgctgatcatcaagatgaatcaagctgcgctgatccgtacgaatgataaactcaccaaactgcagataagagcgccaatgatcaacagccagcaatatagcgagacactctttttcgtaagttgacaggcctctgttgcgtggacccagggatttgctaaggaaagccaagggatgtccatcctgcattaacaccgcacccacccccaaatcagaagcttcagtctcaattacaaaggtcccagaaaaatcgggcaacgccaacactggggcagaaaccaaagcagccttaagagcttcaaatgcagcttgatgttctgaagtccaaacgaagaccacctacttttttaacaaatcagttaagggccgactgatgatcccaaaagacttgacaaacttgtgataatatccggcaagtcccaagaaactccggacttccttaacattctgcggcactgtccaagcttgaacagccctgacattcttcggatcagtagttacacccgcagcgctgatcacatgacccaaataagtaaggctggattgagcgaacgaacacttagatcgtttgacctttaactggtgagtcgtcaatagctagaacacttgacgcaacagcatgacatggtcctgcaaattacgactgtacaccaatatatcatcaatgaacaccaaaactcccttcctcaataacggtgcaaaaatcatgttcatcaacccttgaaaagtggccggggctcctgtaagtccataggacataacccgaaactcataatgaccattatgcgttttaaacgccgtcttatactcatcttcagctcgcattctaatctgatgataccccgcgcgcagatccaagctggtaaacagactagcacctgacaattcgtccaataattcatcaatgattggaaggggatagcgatttttaactgtaacagcattcaggtgacggcagtcaacacaaaactgccaagtgaggtcctttttctgcaccaacagcaccggagaagagaagggacttgaacttggttgaataactccctgctgcagcatatccttcacttgccgttcaatctcatccttctgggctgggttataacggtagggatgaagattgactcatgaaggagctgagaaatttcggctggtatttcaagagaggaatctgaatcttctagaggacataactcaacagtctacaaaaccgcatcatgattcattaagccctgcacctgaacaaccgaaagttcagagcatttctgagtattagcaaccacacccttcagacagacattctgttgttgatactgaaattgcaaaatcttgcttcgctagtcaatctgcattgggctatggtcaaccaaccaatccatgccgagaattatgtcataacttcccagaggcagcaccttgaaattggattgaaaggagaaaccctgcacccaccaaaggcaatttgtcaactcccttgagcagtgcagtatacccccatccgcaatcctgacttgaatagcaggaacaacacgcagcttacagttcaacttgccagccagcttttcagacataaaactatgcgtgctgccagagttcactaacatgagaatttcttactgctgaataagtccttgcaatcgaagcgtacagacagatttcgtaccaatcatagcatcacgagaaatctgacagacttcgccttgaggttcagactcagacccaatgtcagtagttggttcaataatctcaggcataccatcagcagcagaatcagctaacaattccaaaagctcttccacaatatgcaactgaacagtaggtccacacttgtgatcgcgactccaccgttccccacatgtatggcataatccctttgctttgcgataagctctcagggcagctaccttatcttccactggcagtgtccgttcatcagctcggccaccaccaaatgtcttggaagcaaacgacggtgtagcagaacgggccgtagctcggtaactcgtcatagcctcctatcgagcagattccagtacttcctcctacaggcaagcgagatccacagcagtatccatgtccgtgggacggtgtaaaagaatagcaccatgaatatttgcccgcaacccatctatgaattgagtaaaaaaaacatggaatcccaagaggaatgatgagcgtgaaactggtgcattaactcattaaacctctccgcataactaagctaagcaccgaacatgtctgcttgagcctgttaaattgacgcactaagccctggaactcatctctcccaaattttgcacacactagctcagaaaactcactccaatccataaattcaacatgagcatttgtggattgaagccaagtcaaagcccccccccccccccccggaaaattgcaaagaagcaacacctacccacacttcagagcaaattccactcacacggaaataggtttcgcacttcattttccaggctctagggttctccccatcaaactgtggacaatctacccgagcgtttcctccgtgaaaccccgcagtaaaaccccgattcgaaccctctccaaattccagagaaaaacggtggggcaactgattagagcacgtacccttggccgggagagacgatggagaggactccttcccacacgccttcccccgtggaatcgaagcaacgcggtggcctaacggcccgtgaccttcgccacccacacttggagagacctcctcctccttgggagcggtatcccgaggccgagtcggtgtaggaagcagcgccggcaactccgatggcttgacggagagcaccggattacgggctatccgctccacttgttggcgcagatcccccatctcctcatgcagctctgtcaccgccttgtccatcgccggcttccaactcgctaactccaccaccaggggcttgatctcctccagcgatccaaccgaagtttgaatcgccgaattctgcttctgaatcgcagacatgacctccacaagttccgccaattgttgctccatctcctgggatttgagttgagctcgcgaatgatagcgtggtttctctagatactccaagattggtggctctgatacctaatgttacgatcgggctagagattttggggattttggaaggaagaggatgaacagagagcagaacgagagagaaatacttggagcaggggaaagagcagtagagacagagtttggtttcaagtttacagctcaaatattcgatatcctttcctctctccgcctgtgcttatatacacgcacggcatacagctggcctaagcccactccggcccagagactcggacattcggccttctctccctttgaggtcgtttcccagacttcacaggattattctcccttgccggttcagatacagtagcagcacccgtaacaccgcggcggtgcgggatgcggtggaggcggctgcagcggcgacagcgtgggatgcgaaggcagcggcagcgtgggaagagccgacgatctcggcgcgcacacactctctcgtcgccgtcgtcgagccggaacgagccgtgtcttctcgacagagctctgttcacgccggccacctcgccgggcgccggcctcgggcacagttgccaggcaggcggcaccgtctctttggcctgtgctacagcatcgccgccttggggttgcttacttgctgttgcttggttgcttgctgtttgaatgcttgccattgatgtgctattgttgattaatttcagctgtggcccaatgcaagccgattctctcggagctgaacgggaggatgaattagtctagcaggagtttgttagagatgcaaataagtcgtgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcagagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggtggccggggtggccgtcgacccaagaagggacaagaaggcgaggtcccatctgttgcagtccctgccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgtggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacggtgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcggggggtgttctggcaatcgtccacccgaatcagctgtgccaatcttgcctggtgacgaaacaggccagggcgccgttcccggcggcggcgcacttcagggcggaggagccgctcgagctgctgcacatagatctgtgcggcccgattacaccgagtacgatgtctggtaatcgctatttttttcttatagttgatgattattcccggtggatgtgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaatgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaagagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagctgcaggacaggagccaacggatttcgcgatggaggaggagcctggtgagcagctgccgagcccggcaacagcggccggcgtagtaccgtcgtaccaggcaccgtctcctggcaggcgcaccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctgcgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcatggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacagccggaagggtttgctagatcaggaaaagagcatcttgtgctcaagctgcataaggcattgtatggactctggcaggcaccgcgagcctggaatatacgcctggacagaagcttgagggagctcggctttgatcggtgtacgcaggagcaggcagtatacacccgaggtagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcaacactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagagtgttgctagcagaagtggcgggagtggaggagaaagcagtgaagctcttcgtcgacaataggttagcaattgcattgatgaagaacccggtgtttcatgggagaagtaagcatattgacacccgttatcacttcatacgggagtgtgtggatggcgggcaaattgttgtggagttcgtccggactgaggagcagcgggcggatgcactgacgaaaggattgccggcggcgaagctggcgacggcgagacaccttcttggtgttcgttcactagggccacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacagctattgtgcttcattgcctgccaatcctcagcaacaatggatggcgtcgttgttcgagtagcgcattggggcggccctgggtagcatcccagtacggagggacgacgcgtcgtctaccgccaccgcgtcgcgcggctggaggagaacctgcgctgttgttgctgtacttgcacgacacaggcatcgcaatgtcgccgccacgctcacctcgcctcctcgacgccgccgggagtggaccgggttgtcccgcgtcccgtcctgccgccgcctccgcgtgccgcgccgccgtagccgcccgccgctcgacgacggagacgagagtgtgtgtgcgccgagatcgtcggctcttcccacgccgccgctgcatcccacgccgcagccgccgcctccaccgcatcccgcgccgccgcggcctcctcgtcccgcga

SEQ ID NO: 63809 - DNA, 14830 bp, Oryza sativa
tacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgaatagatgcacctgataggtgtaacccccgactatgtggttagctgaacaaaccaaacatatagtcaaggaataagttatccaattaaccgaatggtttttgataattatagtcaaccaagtgacttgataccaatatatagcatatgcggtgtgaatccccgaataatatgatccaagtgatataccgactgttttgtaaaatatgatgaatgtaacctaaagttggctacattatcgaaaattcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtgtaaaatctgagtaagtaaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgtgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcagttgataacccttacggggaataataaatagtccagtctttgagcatataaaatagacccatgatcatgaattcatgttgcatgtatccggagcaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccgacggtaatgatgattagcggcaacagagatagccgactatgatgacgaagtttcccatcaacgacagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgagaagacaaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcactagtcggcgacagcataaccagtcggcgacggaagacgatgatgttcatcagtagtggtagctgtataaaccagatgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagctgtgaagaagatagcatcagttggcgttataacaagccagccgtgcaggcggtgacaccagtcagcggcggatgcggcggccggtcggtgaagacgtagacgcccaacaacggcagcataataggccagccgtgcaggcagaaacaccagtcggcggcggtcgaggcggccggtcggtgaagacgtagacgcccaacaacggcggcataaaggccagccgtgcaggcgaggacatcagtcggcggcgacgaaggcaagccggtcggtgaagacgtaggcgcccaacaacggcggcataaaggccagccgtgcaagcggaaacaccagtcggcggcggcgaaggcaagcccgttggtgaagacgtagacgcccaacaacggcggcataaaggccagccgtgcaggcggggacaccagtcggcggcgacgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacatcgatcggcggcgacgaaggcaagccggtcggtgaagacgtaggcgcccaacaacggcggcataataggccagccgtgcaggcgaggacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttctccgagcagatgactcattacgtttaaacactctgcccgactagtcatagccaccaagcactgggagtcggcctaagcacttcccaaacatgcatatgagtgacatgagttcgtcattaatggaacaaggtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcaaaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccatgtaggcggaggcaccactcggcggcgacggaggcaggccggcggtgaagtcgtagacgcccaacagcggcggcataataggccagccgtgtaggcggaggaaccaatcggcggcgacggagtcaggccggcggtgaagacgtagacgcccaacagcagcggcataataggccagccgtgtaggcggaggcaccaatcggcggcgacggaggcaggccggcggtgaagacgtagacgcccaacggcggcggcataataggccagccgtgtaggcggaggcaccactcggcggcgacggaggcaggccggcggtgaagtcgtagacgcccaacagcagcggaataataggccagccgtgtaggcggaggcaccagtcggcggtgacagaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgacggaggcaggccggcggtgaagtcgtagacgcccaacggcggcggcataatagaccagccgtgcaggcggaaacaccagtcggcggcggcgaaggccagccggtcagtgaagacatggacgcccatgaacggtggtgtgaccgaccaaccgtataggcgatgacaccagtcggcggcgacggaggcaagccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccaagtgtgtattgatctgacgatcaggttgtctcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatgggatacccataatctccacaacatgtgtgcgtgctgccacgccgtgcgtgccgccgtcctcgtcgcggtgcgcgtctcggccacgtcgccgtcctcgccgccgcctccggccccattccgcgtgcgtgtgcaccgccgccgccacttcgtgtcccccgcctggcgccgtgcgcgtgagagagagaggggaagagtgagagagaagagagagaagagaggaagggagagagagggcaacagtggaagaggatatgataggtgggtcccatatttttttataaatagaatgctgactgcactgccacacgtacgtcacgtaaacgaaaaccacaaggattgaattgaggggggtaattcgtccggtttgcatagttggagatgaagaatgtccgattttgtgattcagaggataattcggatgaccgtgatagtttagggggtaatttgtacttttttttttcctagtatctttggtaatgtgctgaattttccctagcacgttaaccatgtgggcttgggaaagctggagagagtttttccagagtcctctccctctctcactctcgctctgtctcttttcccctccatgtttgcgagcacttgctgctagggtttggggagacaggggtgaggaggaaggcgggaggcgcgcaggctgcgacggcgctggatgggttccttgagtggaggaggcagatgcatgcgtggagatccgccggcggaggtgcctgacaagggggaagacgaatgagcaccaggaaaggaggcccagctggcctccaatttctcattttctcccctcatcgttggcttaaagcatcacaagagtttctctgaactattcctagaccctgtttggataagggaaatccatgtttggatactaattagaagtattaaacgtagactaattgtaaatctcattctataactctggactaatttgcgagacgaatcttttgaacctaattaatacatgattagcccgtgcgatgctacagtaaacatatgctaattatggattaattaggcttaaaaaaattatctcatgaattagctatcatttatgtaactaggaaggtagcccgcgtattcacgtgggcatgcatattattttattttggaaatagttccagttgaaattcaagtaaagtatttttcatttttaattgaattttcattgattactttttccttaagaggtctcaaagttttattgctcgtaaatttatttattttaccatcctgatagccctcctttttaattgatcaaatatatatctaatatagtgcctcttttaatatgtgagaccgtacggtattttaaagaaaagacatagtcaacatgaatcataaattaataattcattggaaaagttaacttttaatcatattattaaaagaaagaggctattgattttgtattgccaccttataggcttataaatgcaggttgtagagaaaaccatggagctactttaattcattgctttatcattgacctttgcctcttggtgtgtttaatatgacttatgcagagaaatataaaaattttgaaagaataaaatatcattatgaggttaaatgagctatgcttttccataacgaaaggagtatttattcaatactatcttacaggtttagtgcttcactaaagtagttttatgtgtaaaaacttcaacgctatattgcgggtgaagcattctagtaaaatagttctgtataaaaggattataaaagttattttcaaagatgatccatgagtttgagacaagaggctcactgcataggaggctgcacatttgagccatatgtgaaaagaaggcttgcaaaaatcatttgtgtagtggtgtgatgaaaataattatgcatacaattaaaaatttggaaatacctatatgaaaataatcgtacttgtgctcatattattgtttgccaacaatcaatagaacttgatagtgcgtgagacttcacatagcctacgaatataattacatagctgaaaataactctgcaagagtgaatattattgtattgtggacttttcatgagtgccatcatgatttaaaattttttactctaaaatttataattaaacatcaggaatttatatactccaaacaatcactctttgtaactttcttttagctaatgtgcattaggcatttagtattgcacttatatgtaaagtctgagctgcctaccctattttgtcttctttgtttgaaagaattaggcatttaaacaataatggtagtttattatgtccattactataagtaaaagttgtaatcacgatgtcctgggtaaatctcaagcttttattttttttatatcatgttatagttttctggtttgcaatatatgtggtttatactacctatttttccttctaattaaatcaccgtttatatgcatcgtgccgccatcggtcctggcggggcacacataaaatcagtttggcacacataaaatcaatttgcttgaactcgccaaaaaacaagttcaccccaagttgtttgttccttatatatagtagtatatatctatggcatgttttacgaatatgctctagtatatatcaattgttggtttgttctaggcaacgaacaatttagcacagtacaatatgaatggagatagatccatcgttataaagttgaagttgtgttgtatacaatataaaggtgtagctcatcagagaaacttgacacggtgatagcgatcgcctgcaatcaccagaggtgcatcgtagaattctttttcttttttttttagtcttgatgctctggttgagtagatcaacctattctaacggtggaggccctagttgttctctttcaataagataaatccaatagcctaaaataacatatcatcaatttaagtgaaaatcaaagatgatatgttttttatcatattttatatgaatttgtaatttatttgagcgtcatgtgatggtttaggagcatatgtaggatgcctcgtagtggtttagaagtgtttctagaaagtttaattgacttttatataaagtcatgcgtttgtgcaactatattatctcccctctattaaatttagaataataatgaacaatgtacatatgtgttcgtagaacatttttgcaccatatatatagcgttatcacatttatgtttttcttttctgtaattaaacaataatttgtcatatatgttggtgcggccttggtacatctgatcattctttgtcatgatatcacataggggcacggagtgaagttcagatgaatttttttttaaagaaagatagatctaacaacctaaaattgattaatttacaaatcgatggttgaatgtattattctttttggattttttctaatttaagagtgctatgtagttatttaaaaatatttgtatgatgtctagctacaataaacagattatacaggttgatgtctatctatggattttttaggcccataaagaaaaaatagtaattttaattatcatggaaataaaaaaaataaaggaacagagcaagggtaggttaggtatatgcgtaagaacgccgcacagaggcatggactgagggcaaatttttcttaagatagatctaacgatgtaaaataatgggttcactgatttaaatgaaaatcgacggtcgtatttctctgttttattagagtgccacttgatgacttgaaagtgtttatagggtgacgcatggaggattaggaatatttgtacgaagtttaatggactatcaattatgatcatcaaggtataaaaaacaatatgtattacatatataaatattgttaatataaatttaatggtagaaaataattgatcgactatgtttaagtggaaatcaatggttttttttgttttttccttcatataatttctatgattttctctaatttattggagtgttacttgatgacttaggagcttatttatttgtcggttattaaaacacaaatgaattaattattaagactatagtttcacgtgacaacttttgtaattaagatatactaatatggatgttatatttttttatagataaaatacatcatatgctttataaaattttaaatagtgaacaactgaagaaaataaagaggtaaggattgatcgcttcttttccaaccgtaggtgcaaaagtgcttacatatatactttttttatttttttttccaatgaatagttttttatttgtttttttagcaaatagtgcctagttatttttctcacgtacgtttttacgttagtatgtatgtgcacgatgcttggatgtgggggataggagagtgtagacccccgattttggaaatcggaaatcttctgtgtttatccgtaccaatccctggatcagtagttggtacacacatacatagttggatcacaacatatcacgaatgaattcaggctaaaagagttaaatacttacattagggccaggtaggccaacaactaccagaggacaacagcggaagacaaaataatataagggtccggttaacatgccacaggcagtcgactagggaacgagacctagaacaagactgcacttcgatcattttgttggatacgcaagcgtacgataagggcttctcttcaacactctcctaaaagatatataaatagcaagggtgagtaccaaccgtacccagcaagccacctcaacaacaatgcatatgatagagggtattttaaggaatggcttcaggttcttttgcataaagctagttttgtaattcttttcataagcctaagacctagcatagactgatcaaattttaataccaattttcacattaaacaacgacggttctgtccaccatccattatgatcccaaggatagcttcccaccattgaatcgtcatggttttctgaggacgtccaccttcccgcctctcaggaagtggctccaacaacataaaatcatcatgcaatatcccatcccacacaagttaagaactttgagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaatttaaatcctcatgcactctaggcgtctatatttatagcagtgagaggagttctggcgctcccgggaaagagaagtctcacacacatattaaattatggttcaagttaagttctctatcacacacactcatgacagtcctaccaatggcgacaccgatgtagggcacgcctctcggccctacctcaacggctgccccaccgtagcgcacttgccacactcaggggtgaaccatctatgcagggatactgcctccgctcggctatctaatccgctaggtctatacccattcgagaagtacggttgtacgggggtcgtttcatgcttaacttcatggctcggtccttaattgaccgaggacggtactagccttttccagataccacccaaatcctccgtccaccccagtcgaaaacagttgtttatttttatttctcctttcgcaaatcatgtcatcaatatcatggcaatgtggtgctcatgtctccacataccatatctcaattaccttcccaaaggtaattgcccaagcatatagcatttgataaatatgagcatgcatgattctagaatagcatttctaagcatttgtcatagttgactagggactcatacgtaaacatggttatgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgcctgctcaggatagtccttattctcgatataatcttgatcaaccttcacctcctagaagttgcagacgttgcctcacgactaaccgatacacaaagtctataatacgcgagaaaaaccaatattcaaacaacaatcaaatatgcacaacaaaatgtacttgttagggtcgtacctagggttgctcatactattattgcttgctaggggattccaatcatgctaagggctaaagtttcttaatctttctgttgtcatggtggtctatataggagctaaccaatgtagtatgaatgagatacgtatctggctactatgtggtttagtctagcaaatggctattcatgcatctatctaaatagaacggttatacactagaggttctgttgccggatggatttggatcggtcaaataattactgtgaatcatttgtattattattttattgatggaggctttattttaattatgtacatattttacttgtcaaaataaattataaaaggttaacaattacccatgctttgtatgttagaactgtttaggttaatcatattatggttacagactatcccatcacataattttataatgaataatcctaatttacaattatattaggtcaagatttataactagtattttatccactatagatgtttgtcatagactcattagtttactatacacaaaagggtaggtttttgatataccgtacatctaaattgggatgtacaatgtacgtgtacgcaacaatatttaatcattggatcatttactgaatggttgctatttactagaagctatacgatatatgtgattaagatggctctgttttgttaactaatggatgtcaaccgaactatatttattccacttcacatgacattataccgactaacttttaagcggtccaattacaactagctcagttattattctccttagacaagttgaaggttcatctaagtgtgtttatattttagttacaaagtatgaggctaaacttatgtaaataatttataagtcataggtttagttatatttggacatagactaattaatggcactaatatttcctatgctttaatcaatttgaaacaatgcacctagttagtttacataggttttatagtgagaaagcatgttaaagacaattatttgacatctactttacagtacaatatcaattttcttattagcacatttttaagttaactattatgcatcatcttgatattaattattaataattataaatatattttattaaatagtgaattatataccattggaaagcttgtgaatttagatgaatttaggttcaagtttcagtcaaatcggagctaaaatgaataagttatgctagtgtaaagattcaaatttgaattaattctaataattgcgaaatggtactgttcctaatccatttatttttaatacaaccttatccacaggctatagtgacttacaggtggggtcttcctattttctttccttttcttttatttttcttcctaaaggaatcatacgggcaaatgacgagtgggcccgattcctttgactagggtcaaactggccatttaacgcggtagggcccgcatgttgtagactcgagattataaaacctttataattagatttttaaccacccggacccacatgtaatagactcaactaataaagattaagaagggaattactattcactaaacacgtggggcccactctaatctctcctctcctttctcttttctctctctcttctctgttttctctcttctctccctcccagcttcttctccctcctctctctctcggctctttggcgatgacgaccgaccaaggggaggaggcggcggcttaccgacgatggcggcggcgacggcggcacgacgacggcgcacggcgcggcggcacgaaggcggcggtgcggcggcgcgagggcgacgcgacgacggcgcacggtgcggcggcacgaaggcggcggcgcggcgcggtggaggggaagggggaaaaaggaggggaaggaggggggaaatggcgtggggagggaagggaaaggggagggggtatttatagggctcgggggaggggtggccggctttaaacgatgacggaacggcgtggcgacgcggggctcgggcgatggcgacgcgcggcgatgggacggcgcggcgcgacggcgacagtgcgcggcgcgggcggggctcgaggcgctgatggcgacagcggtgacgcgatggcgcggtagcggcacggggctcggggcgcggcagcggctcatggcttggaggcgcggcagcggcgcaaggcgacggcgacgggatggcgggtgacgcaacggcgacggcgggtgacgcaacggcgacagcgcgcggcgtcttaaggcgctaggccgacggcgacggtcgagcggcgcggcatcgacagggcgcggggctcgaaggcgtggcaacgcg

SEQ ID NO: 63810 - DNA, 673 bp, Oryza sativa
ggttctggtcccatgtccaaattctttccgagtcatcgggaatcgaccgaacaaatggacgtccagaatctgtttcggtgctgcgtcgccgtattttgccctttgggccgtgcatcgtgttggagcccattaggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagcttaatcattcatatgcaatttggttgtattctttcttgttcttgtttgtgttcttcgactcgcaagcagtgattagccttctcgacgaggtcaaccgggtttcgacacagttgataacaggaggagacatggtgctgcgatcgcagggctcaagagcgtgtttgttcataagtcggatcgacttgtgtcgcgactccaccaaatcgaccgtttatcataacaaaagatagggaactcttatccacatcatatggtcgggttgataaggatgaaagaagatagaactaaagagaagatggtatcaacttacattaatcctgatcttttcgtccacaatggtaaggcagaagtttgatgacatggaaaaaaaggtgtttcttccattctacccaccattg

SEQ ID NO: 63811 - DNA, 779 bp, Oryza sativa
catcaatagactaacttatacatctacaaagggaaaggcgtcgtcacgtcagctatggatatagactaggctcaggaacggagtcttaaagtatttactgagagtatactaaggaagaagtcagtggaagtgagctcgtaactaagacttccataatagaaggcaaagaagtcgacgaacgagcagcttttctaaaacccagttgaataggagggtgaaggctctcagatttcctgttgtctgtaagagtttttaaccctaccaatattttggcagcgataagatttatcaggattgtttggcttggcgttaaatttttgctagtgctcttgtttatgtttcttaccaatacttttgcaataccatttcttctctagcaaacggaatgccatccaattctattggcattgccaatttttttggcatggattcaaatcaaacaggttcgaatcttcggctattgttccgagcgtggcatccaacacggctgccgtctcctctacccgatgaagacgagaacatcaacattggggtttcgtggtacaagtcaaacgcgtccagtagaactggccaactgggtctgtttagaaacattttgacaaaacaaccaaaatttataacttctatactactccctcatctacttttgactgtcatatttcatattggcacacagaccaataataagcaattctacttatcatggatttaaacaagttactagacattcctcgtaaacaagcaattcattaatatttacatttcttgatacccatgta

SEQ ID NO: 63812 - DNA, 1113 bp, Oryza sativa
acccatgaattcagaaaccccagaagtccgcacattcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaa

SEQ ID NO: 63813 - DNA, 1096 bp, Oryza sativa
agtgaacacgctatcaggcattgacggagctagcaccatgaggcttccggttacaatagccgacatacgtgttgtgggcttgtggcactcgtcgactccggctcgacgcacaggtggtgcatcacctcctccatcttgagccggtgtgctagggacttcgctttgtcatggccaatggtgatcgccttgtcagccgggcctgtgtcgcaacctcgcgctcaacatcgatggcgaggccttctcggtcgactgcttcgcccttgacttgtgtgctgtcgacatcatcctaggcatgcaatggttgcaaacgttggggccaatactgtgggatttcaagaacatgcgcatggccatatggcgcagcacacgcgaggtcatgttctacagcctcgctgatcagggcccgatgtgatgagtggcgatcgacatcgacgatattttgcagcatctcctggcggaattagaggacctcttcgccgaaccccaaggcttgctgtcggcacgggctatcgactaccgcatccacctcaagcctggggccacatcagtcgccgttcgtccctaccgctaccgctatccctcaaggcataccatggtacataatatggctcatggttgtgttcttcctattccggccaaggcaatatagggtcgtttggcttgcggtgttcctgaaacccttgttcagtgggaaggtaaggcaccggcagatgcaacttgggaaattgaatcggattttcgtcaccgtttccctgcattctggctcgaggatgagctgtttctgaaggatgggagagatgttagggtcggaattgtgttccaccgaaggggcaaacgcgcaaaagcgatgggagcgtgaagccggcaggcatgagttgagctacgcatcccggattgctgcaggtcttcggcttcatctcaattagttaggatttactctcaagtttgttagcaaatattatcccttttcttcagctaaattagttacaattgtaagctcttagggagaagaattcgagagtggacgaaccggactcctggagataccggaagatgaggaagttgagctcggccgaggtgattgcccccataggcg

SEQ ID NO: 63814 - DNA, 575 bp, Oryza sativa
tggaggacgtggaggggatcgtgcccacgtcgttggatgcgagctcgggtgcgggagggcgccggattttgcggcgacgtggacggcaatggcggttggggtcggccggcgagaggtaggaggaggagctgacgggtgggaccgtcggtcccacctgtcggcgaagggagagaaggagggacgcaaaacagacttttgcgagcgggccaagtgagaggggagcccgcccgagagagggagaaggcgcgcgggccgcgggagaagaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcggggcgttaca

SEQ ID NO: 63815 - DNA, 18627 bp, Oryza sativa
tggttagggaaccaaatcagacacctagagggctaatgaacagtgctagccaactatttttgattttatagggtattttgcaattaggaaaaatatactattgccactaattttgtcacaatgtaaaatacaccaagcctaacataatccatcgaaatttgtattcaaatttaatattgaacatatttttatttttattatatatttttctaagtattcctatttttagggctttggtttatttataaattgagaaaagttgccaattaaatttgtatttactcctaagcagttgagtgactatattaagtgctcaaatgtgaattttcccaaaatttaatattgtccaatatttaatatatatcctagatttttataatttcctatatttggggattttggtatttatctgtttccacacatattggttcatctttttggattggttttaccactacatggatttctataatttagcatttgtgattcagttcaaattatataatatctaattaatttttcccagtaaaactattctatagatagagttccatttatttgaatgattatcatttcctaagtgtttatatttcatagcacgcatcacatggttcaagtattcaatatttgatccataaattaaattagtaattaacctttcctttgtttggatttgctttctttgtgattatttacggtttggcaagcaatagtaatcataacaatcagcatggtgcaaaagttttaaaaagtttgaaattttagtgatttttattgtcgggaattttcaggatgttacacagagggaggtggaaaaaacaattctaatatagtaataattaaacatagtgggtctagttgtttatttaagtgacacatggtggtttaggagtatttgtaggacttccacatggtagtttaggagtgtttgtaggaaatttcatggacttctagtatataactaggaaggtagcacgcacatttgcgcagggaggcatcataagctacggttgacacttatgagtgcggaataccaatcaaagaatatctggcacgctttaaaagtataatttctccataaattttattctcagcattgcttaggtaaattttctaacctattagttaattatttcaattatctaacacaattgttatggcaatagccttttcaatctaagtgaaaagtaacaagcaaaattttctaactttttcctccaattggttagatttactctctaataatatttttctattttatttaatacaagtgcaaatataagttcaaaatttgtgatattatgaatagtgatagagcattacacctttcatctcaactttgagaaaatttcaatcacacttggtgatgtattaagtagttaagactgatgtgggtcctcattctttattaacaataaacatatgaattggatggtatggatttctagagttcaataagattccgtgctgtgaaacacatctatgaatgtatcatgtagagtgtgcgaggcttcatgcagccgattgtaaacacgatcttacaactaaatatatctaactgtgcatgcatcattattttggaatgtgatgtattacatgcttctatgatttgtttggttactattgatttagtttagctatatatgtttatatatatgtttatagagtgacttataatgatataatatatgctggcaatttttttctcgtatttcattgctatttggatgacatgcaaagtgcatgggtcaactgtagccaaataatatattatatagcaaaatataggcatgtggatcttaaatcgtcagttttgttataaatatatcaatagttagattagaagtaagacatgtatcttaaaaaaaatatcatcgtttcaatatacaattatcagttgtttcttctttagtttaatagttaaataattcaaaagggtagagaaatgaagaacgcagagttcgaggcatggagagggggtggattgtgatgtgcacatgtgaggggagaagattacacgcaccttccatgttttctttatcgccaacccaatttacttcaaaataaaatgaaggctccacacacacaagggccaagtacaatttagagaaagcagcatggcaagctatatggttggtacgccaaatcgaggtgctgataaagcagtgctgtccgacaggttggtggagaaatgttatgcaaactatatggcggaggaatgttaacgatgccgtctgataattagggggcttttaactatttgccactcttacgaatggtgcttaacgatttgccactaggcccacatgtcatagacacatgagggcccatgtgtcattgacagagcatggcaaaatcgttaattgccaagtcacaagagtggcaaatagttaaatttcccgataattagtggcccctactccccagcctgactgttgagcgcgcacgagaaaatgtatcaaggcttcacaatttacacatgctctcttcaaataatttcacaattcaagttcagactttcagtaccagaaaatggttctcaataatgcagctttatttattatgctagaacatcacaacaaacagagagaaaactccaagaaaggcaagtaaaccacacacaaacatagcacaaaccacgtcagcacacatatgtatatagttttggtaggaggataaatttaatttcctcagtggtaatattccagcctgggttgttagtgcgccctcctaccatcattctccaatgccatcacattaccgtggtgacgaacctcttgatgcatgtgaaattcatgcctgtgcacctccttatgcactctgtgatgcataccatgatgattatggtccacagattcgaaactgtccaacttagttgaagttgtagttatccatccctgcagttaaaacgcagaccaaaaatcagccgcacgattgccgaaaattatatcagggtttgaaattttggtaatttccgaatcccagcaagctaatatatggtccaagattttcaagtttctttcaaaattttaaataattccgtgcgaaacaccaccaagattcctgaaatccggtgaccaccgaaatttctaaccgatatacttctgtccatttcagtccaaatcaagtgtttagcaacagacaaaaaccttctgcatttcctgtagatccttgatttttcgctgcaatttcttgttttcctcatcgaggcgcttgttctcttccctctttgtctcaagttttgtgttgagatattccttctctctctttgtgattttgagttcttccttggcatctttggtctcctttgtctttttttcgagctttgagttgagattttctttgtctctcttccattttcgttgttcttgctggagaagcttgtatccttcctcttgtttgatttgctttgactcgacagcttccttctgtttcttcatgttctgaaggtcctttttgtatcgatccattttcgccattagatcatcctgaaataaatgatgaagttagcaaaggaaatataatcagaaagattgaggcattaatcttgcaattaattaaaatctctgcatttagcacataccggcacaactgattcaatcttgacactggatgacattttcttgaggcgctcatagagcttcccgacgtcgacagtccctggcacgtccaccttcaaactgctgccatctacttttactttgaaattatcctggtcgacagattctaaaagtaaaaaaccaagatgatgagtactattagttattttctgcataattcacccttccgaacatctctgtccatttgatttggactgaaatccaacagcaggcaggattattgatccacaatttgtgaaatttccatcacccggagacaagaaaatacgagatgttaaatggggagtatatctgctacgatcattacaacctttgaactcttgacgaagtacgctcttgacctctacgtcgtttgcaccccgaaccttgagcttcgtaagtttcttgtctccctgccaagagttcgatcgtacataagaagaaatccttcaaacgtttgttgatttgaaccagcaaaacaaacgagtgcagaaacaaaattcaagaacagcacataccatttgcttcagatatatatggtgaaaagagatggggaggaagtcagagactagagcaagatctagtactgctgctccaagaacaacatcgccatgggctaccaacttaaataccgtgattcctgaggaacagaatctggaaaacgtgttcgtcgttccatctgaatacgcgttctttcatgcagatgtcctcgtctccgtgtaagatgcaaatatggatttgattacattcatctcgaaaggtaagaaggatgatcatcgcatctgtatcttttcccttgacttatcgtagcttcattccgtcaatgaatataatatatactccttctctttctaaatatttaacgcaattgactttttaaaatatatttaatcattcgtcttatcttaactaattaaaagattcgtatttttcctttagtcacatcatccgtgcggtgtttttttcgtccgtctaggtttttttttgcgcgcgtggtttttttcgtacgtggtcttttactgagtccgtctgcttttttttccgcacgcagttttttataggcccgctcggtttttttgcgcttacggtttttttaagttgtccgtctccagttctcacatgatgttttttttgggcccacagcccaggaattacatacagagtctaacctatataggaattacatggagtccaaacatagaaattacatgacaagtagtatacaaacaacttctcaacctatatagaaaaactgaaagcacatagaagactaatatatgctcctagaatttgatgtggatactaagcaatctctcgctcgacgctactcatacatgcacccagatttttttaaaaaaactgagaaattcctgttcgccgtgagacttaatgttcttttactgcatttacgatgatagaaggtaattcttcagtccttaatgatgtacacattattaatggcatatagcgaacaattagcacaaatcaatcgatcttagagggaaaaaaatacatggaaataaaactaccaagctcagcaaggaataaatatcaaaaaccagattgattggatctcataccttatttaagtggcaaccatattttattagtaatttcgaagaaaaaaaaccagccatcttatattagtaaaaaaaaactttatcacacaaaactattaacccaaataataccactattacttcattatatttttatttgctacacttatttttgatttcagatgtataataagccccagtctgtcaatcaatttcccttaactaagggcgcgcaaaaaaaaaagacctacatatataattgtgcttgaggtcccctatttattcctagggccgtaacgtgaaatgtatttcatataacataagtaaagcattaaaaaaaaacttacagtatttatatatatagagtatataaaagagtattatggaacattagtaaaaaaacaagaacaaagatacttgcctagaaaattcagtggaacctctctcgcatattaggacaactaaagtttctaaacttcagatcaaataaaagcatcttgcataacaaactaagacttgaaagctcagacaagaactgtattttaaacaacaagattactgattactactatgcaagatgatcccaaaatttcacatggacagcatgatatattgtcttaaagcaaataaagcacctgggcagcaatggctggaactgacggcgagtcaaggacgtcggtcgttggtgagcacggcgtgggtaaactcttctcgaactctgccgtccgcagcccggcctcgaaagaagtttagtataatgtggacattgtttctctcataagctctcgcctatcagtacagctccagtaagccagatgatgtttatgaacagttgaagaatctagattaataccgactagaaggggatgcgcggcataatgctgtgctcagctgtgcatacaaaacaaatacggtttaagcaaaattttaattccaaatagtttttattgatcgagtgtttcccttcgttcatttgatttgaaaaggtaatatcaaatgtattaggtacataattagaagcttgtaattcgaaagatgacaaacttgaaatgcttggacactctgactacattaccaccataacaattttatttaagcagcatatctagcaaccaataaagagcttataaaacaaagcactatttctttttttttcatttttacagattgcatgctaaaaccagaaccttctccaatcacccgtcacatatgaatctgagcacttcagaatattagtttcttccactttctaggaaaaccgaaggttcttaacaatgacaacaggtgagtgataaatcatcctaagtacgacttcacaggtgagtgataaaccggcacctttgtttctctgcatcggtgccacctatggggttcccaaccggctcccatttatgagcaactaggtcccgatcttttgataggtattgataactctcgatatggtgaaaacttgacaaacacgatccggctttttgatcagcacgatccaaaccctacaatcgcagcaccacatcttatctggttatcaaccgtgcactacccagttaaccccgccgataaagctaatccttgcatgtgaatttgaagaacacaagaaagacacaaggtacactgcaattcaattaagctctcaaatttggggttacataaaccgaactagcatgaaactacaacaataaaaataatataagaaaacttcagtataagctatgacgactactggataaatatgattagggatattctagggttgccctagggcgccaaccccttgggcttagctcatgacccaattacaaggctcgaggcctaaattagattcggactggataaggtacgtagattgttttgcagatttctgatagcctaggaggaattttgatgtgggactaaaaccatatgaaagtagaatccataagctttccaataagtccttatgggccccaagttttcttctagcacgagatcaacggctagtctcgaatccgaatataaaacgtgcgaaatttcatctcttgctttctatggactaaaagtgacgtggtgagttaagactagacttggagaaagtcttggtttggcccccagtgaactttttttgatcatccattattcctttgcccaaataagtacctctacaaatggaacacataaaactcatggtgcagtatcgtctgtttaaatatataacatgtaaattgtacatagaaaacatgcacctttggttgctgaatgaataaggtatccatggtcatatccgatctagtgatatcctaatcatttagttttatgtagtagtgagagagtgcgcaacagaagaccgagccatggatctgccgagccagttcaccatctcctgtagggcagcctatatgttgcactgtatgtacaccgctgtctgtacaaggtgtgacaccaacacataagtcttattggattttataggagcagttatacccaagtacaacataaacgttagaggtgaacaacgtttgcagaattctttgccacattagccaaattatctttttcaacgcatatccaattttagatacggcaccattgtagcatacatttaacaaacttgtttcctaagcaatcctgattgccagagagggtagccacactttactgcttttcgtgaactttcaaggtgtggagattatggatatcccatatctacacggcgatggtatttggactgagtacaggataccaaatatagatagaatatcttatttgtgtctcgggtttgtttcttaacttgtacatcaaggaaataccttgagacttagtcggttacgactgtatttaatctgtatctgcatattccgttagggatatatattatcttttgtaacacggactccttcccatatataaggggggtccgggtgcctctaggggcatatgttgattttcccaaatcatacaatcaataatacactcggcggatccatccccggacaggagtagggtattacttcttgaataagaaggcctgaacctgtataaatccattgtctccaaacccatacacttctcaagcttgatagccacccccttttattattgccgaaatctagtttcgacagttggcgcgccaggtaggggttgcgtcaagcttttcgccgatcagtgcaatgggttccatctccggcatcgacgacctcgtcttcccacccgggcagatgtttcggttcggcagcctcgacttcgtcaccaacaacttcggcaagatctctctccttgactcggagtcataccagtcgggagagaaccggatttcagtcccgtttggactcccaaacgcggctgaaagttacttcaagaccatctcaatcgagtcggcttcaaaccactcgggagagatcgcatcttctccaacgtcaccagatcaagatgatggggcttacccaccgatcctgatggagctccctgacgatttggcgaccgtctccatcatgacagcgccttcatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtggaatacgacgagtttggctctcgctactacaacgacccggatctcgacgacttcgacggaagcctagaagacaactacacccctctctacttcggcgtcttcatggccgacaatgagacggaggagcaatgccaagcccgggaaaccgaagcacgtcgcgagattgagcgtcgccgactggagcaggagcgtcaagcacaagaacaagaacggctacggcgtgaccagcatgagcgtgagcgaaccgcgaaggaggctgaggaccgacggcagcgagccttggaagcagggcgccgagcgcgtgatttcattggccagcaagatgttgaagggataccggttttccgcacccctcagcagaatgcggttgccgcgatcaccctcctcgacaccctcctcaaggaaaacgagcacaatcaatctgatcacgtcgtcaacatcttgaaccagacaaagaccatgattgcggcttcggttccagttaactccgaaagcgtccacacgccgactggcagccgactcccccacttccgatctcatgattatcgtcatctgagcctcagcatcaccggcgcaggatccaaccgcaggagcaggggccacgacgagcggtccgtccactcgcctcccgaccaccatggggagcgccgagtggaatggcctcgctcaccacctcgtcgccgccccgtcgatcttcgtgacacaatcatacagcgccgagcagctcgaggccgtcatcattattcgccagaccgccacgacgacgaccttgatggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacgattggatcttgggccgaattacgcgaccgcttcatcgccaacttccaaggcaccttcgagcgtcctggcacacaatacgacctttacaacgttattcagaagtccggagaatcccttcgagagtatatccgacgattttctgaacaacgtaacaagatctccgatatcaccgacgatgtcattatcgccgcattcaccaaagggattcgccacgaagagttggtcggcaagttcggacgtaaacctcccagaacagtcaagcttatgtttgaaaaagccaacgagtatgccaaagccgaagacgccgtcaccgcatcaaagcagtcgggtcctagttggaagccaaaaaatacgccggctacgggaggaggtggaagtaacaatcataaggaccgcaagcgtaagcctgaggaacttgttgcaaccgccactcattcttctcgacagcgttcgcgcgtcaacacgttcgacaagatcatgaactcccaatgcccgcaccatcctaactccaaccacgtggccaaagattgtttcgtttacaagcagttcgcggagcaatacaccaagcctacacggaagaactccgacgaagaacaaagcacgtcgaggaagaaggacgacggcgacaccccggcaggatttcaagaccaccgcaaggagctcaaccatatcttcggcggccccctggcttatgagtctaaaaggaaacaaaagttgaccgaacgggaaatcaatgctgttcagcccgacacgcctcaatatcttcgatggtcagagattgcaatcaagtttgaccgctcggatcatcctgaccgagtggtccacccggggcggtatcccctggtactagacccagtggtccgtaatgtcaagcttcgcagaaccctcatcgatggtggcagtgcactcaatatcctcttcgccaagaccttagatgatatgcagatcccgcgctccgagttaaaaccaagcaatacgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggctgtcccgcactacacttacatgatgatgaagatgccgggtctccgaggagtcctaaccctacggagcgacatcaagcaagccgtcacatgcgacaaggagagttgcgacatggcccaaacccgcgagatagcgtctgcccgagaggatatccgactggctgcaaccacggtgagcgaaggagaagtgcccgctaccaagatttcaaaaagtggagaaagcgaagccaagactaagaagattcccctagatccttctgatcctactaaaactgctgtaataggcgccgagttagattgtaaataggaaagcgcgctcatcacctttcttcagaacaataaagatatctttgcgtggaaaccatctgatatgcctggtattcctagagaggtgattgagcactccttacaagttaaagaagatgccaagcgtattaaacaacgactccgccgattcgcacaagacaggaaggacgcgatcaaggaggaattgaccaagctgttagcggcaggcttcatcaaagaagtccatcatcccgactggctggtaaacccggttttagttcggaagaaaacggggcaatggcgcatgtgtgttgattatactgatctcaacaaatcttgccctaaagatccttttgggttgcctcgcattgaccaggtagttgactcaaccgccggctgtgagcttctcagttttttggattgctactcggggtatcatcagatctgactgaaggaatcagactgcttgaaggcttcattcatcacgccctttggagcatactgctatgtcaccatgccgttcggactaaaaaacgcaggagcaacttatcaacgtatgatccagagatgcttctcaacacagatcggccgcaacgttgaagcctatgtggatgacgtagttgtcaaaaccaagcaaaaggatgatttgatcttggatctagaagaaaccttcgcaagcatccgcgccttcaggatgaaattaaaccctgaaaagtgcaccttcggagtaccgtcaggaaagctgcttggttttatggtatctcataggggtatccaagccaacccggagaaagttactgccatcctcaacatgaaaccgccaagtacccagaaagatgttcagaagctgactggatgcatggcggcgctcagccgattcgtttcaagacttggcgagcgggggatgcccttctttaagctactgaagaaaacagatgatttccaatggggacccgaagcacagaaggcctttgaagattttaagaaactcctcaccaagccgccggtcttagcctcaccatacccgcaggagccgttgttgctgtatgtgtcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccacttggcgatatactgcacaaccgtgaagcaaacggacggattgctaagtgggctttggagttgatgtctttggacatatcattcaagcctcgaacttcaatcaagtctcaagcgttggctgactttgtcgctgaatggaccgagtgccaggaggatgcccccacggagaagatagagcactggaccatgcattttgatggatcaaaaagactttcgggcactggagctggagtggttttaatttccccaactggagaaagattaagctatgtgctttggatacatttttcggcgtcccataacgtcgccgagtatgaagcgctccttcatggactgcggattgcaatttccctagggataaagcgtctaatagttcgaggcgattcacagttggttgtcaaccaagttatgaaagagtggacctgccttgatgacaacatgatggcatatcgacaagaggtacgcaaattggaagacaagtttgatggactcgagctcaatcacgttcttcgacacaataatgaagccgccgacagacttgccaactttggatccaagcgctaggcggcgccctctgatgtctttgtcgaacacctttatacgccgacagtacctcacaaagatgctactcaagttgcgggcacccatgacgtagctatggttgaagccgactggcgagagcccctcatacgatttttgacttctcaagaactcccccaagacaaagatgaagccgagcggatttcaaggcggagcaaactttatgttatgcatgaagctgagttatacaagaaaaacccttcaggaatcctgcaacgctgcgtatctttagaggaagggagacagttgctgaaagacatacattctgggatatgcggaaatcatgctgccgcacgtaccattgtcggcaaagcttaccggcagggttttttctggcctactgccgtgtccgacgccgacaaaattgtgcgcacgtgcgaaggttgccaatttttcgccagacaaattcatctaccagctcaagagttacagaccatcccactgtcttggccgtttgcggtttgggggctcgacatggttggcccgttcaaaaaggcagtcggcggttacacacacctctttgtggccattgacaaattctccaagtggattgaagctaaaccggttgtcacaatcacagcagataacgctcgagacttcttcctcaacattgtacatagatttggagtgcccaatcggatcatcactgataatggcaggcaattcactggcggagtttttaaagacttttgtgaagactttggaattaagatttgctatgcctcagtagcacatcccatgagcaatggacaggtggagcgagccaatggcatgatacttcaagggattaaagcgcgagtttttgaccggctaaaaccttatgccggcaaatgggtggcacagctgccatcagtactttggtctttgcgtactacacccagtcgggccacaggccagtcaccttttttccttctctatggggcagaagcaatgttgccgagtgaagtcgaattcgaatctttgcgctttcgtaatttccgcgaagaacgctacgaagaggactgagtggatgacttgcatcgactggaagaagtccgcgaagcagctttgattcagtcggctcgatacttacaagggttgcgacgttatcataatcgcaatgttcgatctcgtgcctttctagtcggcgacctggttttgaggaaaattcaaactacacgagatcggcacaagttatctcctctatgggaagggccatttatcatctccgaagtcacccggccaggttcctatcgactcaagcgcgaagacggcactctcatcgacaactcttggaacattgaacatcttcgtcgcttctacgcttaagcttatcattgtacttatctatcttgactgtcaacatcaagttttcttcttgaagttgtcagtcgggggctatcatcataataatggagtgtgattttttttttatcaattcaatttgcttacttggtctatcattgccttgtttggtttttctacttagtctgcgaggactgaaagtttttaatagcttctttgggttttaggctcaacaaagctggacaaaagcttttaagaaatcaacgacttggctagaattatcaagcacagcataaatacaccagtaattgtacaagttgagcctccatttgttacatctatgctcagtcagaatcagtcctttcatcatcagagttattgttacttggctgaaggtcgttgttgcggaattgctctacaacgtcacttgcaattttgtcagccgcattttgagcattgctgataagatcaagagcagcctctacgcttgtcccgtctgcaaagccatcaatggcatcaatttcaatcctcgggtacaaggacttggtcatcgccaatgccgtgctagctcccatacttccagctttcttgatgttcttgaaatatacatccggagcaactctcagcttgtcgaagatttcggttgcgtcgagtgcactcggaccactgttattgaggaacatggcttggatgagtggagtagcgacattagcgacttcatctcttgctccttcaagcttcttgatcttaccaaccaggacgtcgaactgagcttgcgatttgattttgcggtctacagaacacatttatgataagaatctgctgcattaaaaagagagaagttcagattgtcagctggcagtaccttcaacctccttcaaggccgagtccctttgtgcagccagttctgccttgtctcttttcagggcttcaatttgtttttccatttgagccatcctggcggcttgcgctgtttgaaatccaaatgattgaggatacagttacgacaacataaattaatgggaccgatctagagattaccttttgacgaaccactcagctcgaagtttgaatcctggagctgagtaattcgctcccttaattccttctccgtctttttggcgagctccttggcctcgtgtagctggtccctaactgcttcaagagttcccaaatgaggaaccagcttttctaaagttacggtcttggcctcattgcgaagatggattctctgcataatggttcatggtttagttctgctaaagagaaaacaaagtcatcaaaggcagtcgcccggaagatttacatttacaatacgagtggcttctccaagcgccttcttcagctggcacacttcctcatcttctttttgacgatttatgacgatgccggcagcttgtgagttctcatcccaccatttgagtaagataggaggacgagagtcatcagccgcctttatgcggagaatttcttcttcgtcatcgcctggtggccctgatgtatttccaagatgttaagcgaataagcaggagttgttcaaatcggcatcacttggaaagatgagttacctgaggatgttcccagctgagcgtgaggtgatccttgttctttatttggagacccaatcatcgagtcgttaccagcttcaggtccttgagaagtcgtcgtctgtgcttcaacttcgggaatttcttgatctggacctacatccgactggtttccagtcgggggctcttgggttgttgtagtttcagttgctgccgactgatttccagtcgggggctggtcactcgaatcggccttatcacctgaagtatgggcgccagtcggctggctctcgccagtcggctggctctcggcagtcggctcagaatccttggaggaatttggctctgtcacagccggatcaggatcttttccagttggatctatgtcagatggtttcctgcaaggtgttctttcaatactcagtattattttcatgaaaaaaacatgccgaagtgaaattataccaagaggttttatacctggaagatgttctaatctttggcattgggcggttagctagttttttcctaagcattgtacgctttgggagtttattaggcgagcccttgtccccagatctgttgtcgtcatcgccttcatcgtcgtcaagcactagttttctcttgcgagaacttgtctgcccagtcggattggaagtttgaggttgtggatctgatctgattgtcgattctccacctccttgaacggtgtgctggcgaggagaccggcgctgagtgattgggggatcagatttcatcaatacatattcctgaatgagatgcatccacggttagctaaatcaacatgaagacaagattatgttttggtcataggttgaatatttcagatacatacctgcggaggcggattgaatgcgttatatggcacaactggcagctgatgtgagtagctgacgacaatagcatttgagaagattttatacattctctccttcatgattttgaaatccagagaatctggttcttcacgattaggatcatgcttgccgtcgaactcgaacgctgtgcgggatctttctttaattggcgccagtcggcatttaatgaaatgccgagtaatctgctctccttgtaagccttgttctttgagttttagcatgcgatccatcaactccaaggcttgggcagcttcatccccaatcggaagagagttccaagtctcttggtataccggaggaaggcaagagtattcaggaagagcaggctcaggattctgaacataaaaccagttcgcatgccattctttgtttgaagtcttgaaaggcatagagaagtatttctggctcagagtgcccctcagctgaaatccggcccccccgactacgcatggcttactcttgttcggttggggcttgagaaagaagattcagcgaaacagagcgaagtggggcttaatccccaagaaggcttcacaaacatggacgaaattggcgatgtgaactatggaatttgggttcaggtgatgcaagctgattccatagaagtttaaaatcccgcggaaaaatttcgaggtcggaagagcgaagccgccatagaagaaatgggagaagactacaacctcatgtgtatcgggggacggaaaagcctcaccgtgcgctggccgccacccgatgatctccttggcagggagaacgccgtgcgccaccatctccttcaggttctcctccgtcacgtcggatgtcgcccattggccttcaaagctttctttctcttccgccattgatttcactcgaatgcgctgatttgattcgagggatggctagggagaggcaaaggattaaggcggtggatcacgggagagattttgatgcacttttcgaaggtggatttgagcggaatggtgaaccctagttcgccggcgctgctttgcactgttgcaaggagtggggaaaatggcgagagttccggcggggaagacgaagcgtcgcttggatctcgggttttcttgttaagggtatcggaggtgcaaatgggcctaggcctgaacagtacctcagcccagtatttttaacagcgtggcccattgtgttccttagggacttaggcattttttgctttggcaatttatgcgcacaatagtattgcccaatgctgataaattcctttttatgcggtcatataattctttggaattaatgctatgcaaattaaaaggtgcccgacagaaaggtattatgctgtttttgtaagcttttttaggctacaaaagctgtcagggttaatttggaatgacttgtttttatcatagtcatttccttggtatgttatatacctgttttcattatggtaaatagtcatagcctaggctattggacttattcattaccataatttttataatacttggtgggtaatttttagagttttttattcggatgcctgtcaagtatgttcattcgtgaaccttttagagtgtaaaccactcggattccttttattacggctaaaaagcagtcggctagaatgcctctttaggcgccgcgtatgcttttgtcatatgatgcataactgtgctattattttgttctcaactatatgtttagtttattaactaatcacatagttgggggctacacctaattaggtgcatctattcgatgcaccatattctttattttttcgccgtttacagtctttgtcttcgctattcagcagatcttggcatgaa

SEQ ID NO: 63816 - DNA, 1159 bp, Oryza sativa
taagaagtaatttaatgaaatctaaaagtaatttagatataatatataagtaatttgaatttttttcataaaaatatagttatgtgagatctttttataaagatttaattgttatgaacacaatggtgtaatcggatcgtaaatcggatgagtaaatctaagagaaaatttcataacaagaaaaaaacatacacttttgagtatactagatataaaattgaggtagctagttatgaacatacagagaacggtttagttgtagacacgtccattaataaacaattaccttctaagtacggaaactcgacctaccatacacagccttagctaggtggataacgactattcgcgcatgcataataaccagcaagcatatatatatatatatatatatatatatatatatatatatatatatatatatatatatatatatatatcacacatgctggaggctgccattattatacttaaccatggctagtaccagcgttttaaatctcccgctatagctgccgctatctaccgctataactatttgagaagggttctagctatttgctctcatatacaatttaacagctatagcttcatttagcccgctatagctgccgctatagctgtttaagaagctaatcgctaaatggtttagcccgctatttaaaacattggctagtaccaccaaccaacctactcttttggggccagtgccattgccgttcaacgacgccatcgccgccggcgacacgccggcggtggatcccggcctgatggaagagtacgggtggctccctagcaaccccaagatgcacctgaattgctaccaaggtgcgtgggtgcagaggacgtgggtgcccgggatcatcgccatccagcgcggcggcgacatcgtcctcgcgacactggtggagaaaccatctttgcttggtcacccaaaattcacaatagtcccggttcgaatagaaaccgggactaaagatgatttttagtcccagttaaaaactttttgacctttagtcccggttggtaacattaaccaggactaaagatcatttttagtcccggttcaaaaagttgtcgggtcgagttaggtcccagctcatgtttagtctcggttggtataaacaaccgggactaaacatagatctttagtcccggt

SEQ ID NO: 63817 - DNA, 6663 bp, Oryza sativa
ggtgagctccgaatgggttcggtgaactcgcctcccgccgccgcgtgggttggcgaggagcgccggatgggagccgggggagtggtggtggtggacgctgtcgacggcgtggggcgagcggggccggcgggggaatgggcgagcgcgggctgcggccgacgacggcgcgggccgaagggaggtgggcggcgactggaggtagagaagaaggtgagaagaggggctgacgggtggggccctttccacgctggcacgcacggtggcacgccacgttggcaaaagtggcaaatagttaagaaattacctctctccagtggcaaattattttatgcaaacctaagaggggtatttggataattggcaaacctaaaagtggcaaatagttaaattccctcgttttttgggcacaagtcgttttttttctgggacaaccgctcggtctcatgaatcagtttagtctgggacggagggagtagctagctagctatctaggctcgtggctgatgactatatatcaatgttttaaatagcagactaaggcatttagcggttagcttctcaaacaactatagcggctaaattatacatgagactatgagaacaaatagctaaaacccttctcaaacaactatagcggaagacagcggcagtttaactagatatttaaaactctgctatatatacgtactcgccatagtcagcgcggacgatatatagcacagctagcctatcatgggtagcaccggcgacgaacccatcatcatggccgggccagtgccgttcgtcgacgtcgtcgtcgacaatgccggcggcgccgtcgccaacaaggccgatccgggcgtcgtactgccgcaggaagaagagtacgagagcttcgtgtcgtcgctgccgagcaaccccaagctgcagctgctgcgctaccaggggaagtggctgctgcagtcgtgggtgcccgggatcatcgccatccagcgcggcggcttcgcgccgcgccgcggcggcggcgacgtcgtcctcgcgagcctccccaagtgcggcaccacgtggctcaaggccctcgcgttcgccaccatggcgcgccgcgcgcacccgcccgccggggatgagcagcacccgctcctccggctcaacccgcacgactgcgtcccgtcgatggagaagctgttcgccgctgggttggggagcaagatcatggacgcgctgccgtcgccgaggctcatggcgacgcacgtgcaccactcgcttctccccgcctccatcaccgataaccctcactgtaaaatcatctatatatgcaggtgaatcatctttttattatgaacatccaatataagtatttgctttttatgtccttttaatctagtaaaaaatagtgattttttttaaatttttttaaaaaactaccattaacttgttattatcatacattaattgttgcatgtatttgttagtgacatgtggaccttttagtcctacactattattttttcttcctttaaaaataaagagttggtggaagtggttgacatgtgagttctctagccccacatctttaaaaggtacagagttggtggaaatggttgacatatgagttttctagccccacatgttattgttcctctaaaagaaagttaggagttggtagtggggttggtgggagaacaaccaccaccactactcccttttataaatagtatagataaattatgcttaaaatatttttaatgatcaaacaagttattaaaataaattatacgtagtatttttttaataaaataaaaggtcaaacaacccatgtccatatatctacaacgctacgtataaaactaaagttagtatttgtattcttataacaaccaccaccaagtaatacaacatcctctaaatatatatatatatatatatatatatatatatatatatatatatatatatatatggttctatgtatcaaattaaacgacagggatccaaaggacatgatagtttccctgtggcacttcgtgagaagaaggctaccggagatcccattcctcgaactgttcgagtctgcttgcgagggcagatgcttgagcagcccaatctgggaccatatcctcggctactggaatgcgagcaagacgaggccagagacggtgttgttcctgaggtacgaagagctgctacatgacccggctgatagcgtcaggaagctggctcggttcgtcgggcagccattctcgcccgaggaggaggaagccagcgacgtggaagacattgtgaggctctgcagtttcgagcagatgaagaacctggaggtgaacagggcagctggcctgtctcctgcgctccagcaaaacgcctacaccaatgggtccttcttcaggaaagggggcacaggagattgggcaaatcatatgacaccagagatggctgaacgcgcggctagacgccatcgtagaagagaagctccgttgatcaggcctctctttctcatgatctcggcatgctagtttatgactcgtaaataaagattatgccatctactaaggaatcatgtaaaaataaaatgcccgttgtgcagtcactagctatatttgttaatctcgtatgtactgtctaaatactccatgttatatatgttgtttatctagctatgttatgttgttctcagttattatccatgtggtcataaataatcgatgcatatctttatccaatagctacctttatctcacatgctagaaaaaaatattgacattaaatgtagtactaaaatattactccgtagactttttaagatacagttcaccattttatcttattaaaaaaaattatgtaattatcatttattttgttgtgacttgattatcgtcaaatattctttgaatatgacataaaatttgtttatatttgaaaaaaatgaataagacgaatagtcaattatttatcaaaaagtcaacggtgttatatattaaaacacagaggtaatactatcttttattggacaatgccttgattacataatgaaaatgtattattgcgccttaatttgtgatgaagtacgtgtgggactgctacacacataattaagtctatagcaccaacaagtgacgatcaactgatgggagatttcaatccttatcatatgccctacggtgtagccgtgggatagttgtgtacacacttacgaggtcaaaaagatgtgcatacagcccaaaaaagaaaagaaaatatgtgcatactaaagaaagagaatagatgaataaaaagaccatgttcagattatcagtcgcgtggcagtggggattactgctgaagtgctgatgcagtagcagtggctgacatgtggctgacatgtgaactgcgtagaatttgcatccattgtgtggtgtgcgcagtgcgtggcctccttttgtaccacaaaacagtgacacaggtggctacagcccacgtgaaagctctccggggacttttgccgaccagccgctgccactgcagaaacggagcctgggagggtgcacggtgagaggagcgaaaacggcgtgttgcgtagagaaagggatagagtagggagagatggaggaagaagatggagacttagtaggtccccatctttttttttcttgactacgataaaacgtaggcgccatgctggataaagacctagtctacatgtcacgcagtgacgtaggataaaaccgctgttcaaactacttgaggaggtaaactgattcggttttcatagtcgagggatccttcatgcctggtctgcaacagttgaggtaggaaaagtaaacttattctttgtcaaattggggtggtaagggctgttttttttttttggacccaggtgccttggaacccactccagcccattgggctccgccccaaatgggtagaaaacttacattgtccgatcagataaacataaaacgtgtgatgttttcacagaagaacttttaccatcatctacacactgctctcgacgccaataccacagccatcaccgaaggtgccacccgtggcgaggcttctgttctctacttgaaggacgctcaatctacaaaaatttctaagcgtctctaatataataatttatccagtgtcacaactaacttatccctgattctcatcttccggctcacctaatcattatagatttattgcatcttgaacgactggctactaaaaagcgatttttcatagcgttgctctagaaaatttcaaggcggagctcataagtgtccgcaagcgaaaatagtgttttcgatggcggtacgtaaaaaggaccgctgtacaaaattttttaggctaattaataaaatccaccgcgcgcccccacaccgtgcctctctccctcttctcccttggtctctccgcctatctcccaaaatccctcttcctctctctctccattcggtgggcggcggcacggggaggaggtggcttggcggcggcgcggggtggcagcgtggtggaggaagaggatgatgcgggcagcggatccagcgacgggccacacggcggcgttcggaggtggatttagcggcggatccgccgccgcctagtcccagctctctctccccctctcctctctcctccccttcccctgtcaccatcaccccctctccctctctcagatttagcgcgcggaccacggtgaaggctgtggcggggctttgtagcggcggtggcgaggcggaggccggcagggctcggtagcggcatcgtcgcggtggaggctgcggtggggctcgacaacggcggcgtcgaggaggaggcggtggttcttgttggccacttcaaggacgacgccgacaatctcgagtgcgacaacgccgacgacgatggttctcgtctattctgttgctgttaatgtgttgaattgttgatatttgtgatgctccgtatttagattgatgcttgaatgatgttcaattttttttaatatggatgcttgaatgctctattaatatccattttcaaatttttgttaacggaaaattgtgattgtgaatggaaattttttactggaaattattgatgtaaatttctgtggatttgtggatcgagcgttgacagagacggatggagcggtgtcgctccgtcattttttttaaccttggccaatattaacactggcagctggtatagtgcaccgcctgtgaaaataaattttcatgggtggctatcttaagaaaaccgcgagagaaaatgaattggcgctggcggccggctaccgccaacgaaaatactatattattattggcctttagacactgacagtgccgtaggccgccagcaaaaatagaaaattttttctagtagtgactattaatcaatgatttctttaatatttagttacgtattgattaattacttattatattaatagttacatgacctatcagccaatcaattgcttagttgtactattaatttcgtaattcttatcaattacttagttttggtagatgatctttaaattactgttaatatctttttactgttttgcccttcacactttgacgtggcaatgatgcaaataacctacttaaccttccactaaatctttaaattaataccctagctactccagcccacatatcaagtagtactaccttctaattggtactttgtgtttcaaatcgttagattgaccggaatcaatggatctcgttattttcaatcacaatagatcaagtctctagctatctataaatctcatatgtactgtctgatgattaattatgaccagtactgttattgtttatctgttgctttcagttatcatgcatgtggtcataaataaaacaatgcacatctttatccaatatagctacattttccaaatatcgcacgtgtcattaaaaaattattgacatttaatgtaatgctaaaatagacaagccttgcatatttcgagagatagaccgatttagaccaaattcttttcttcactttcctagctcaactatctcgttttctgcgtgcatgcttttcgaatcactaaatgcatggtacattttttttaaaaaaatttctattcgaaagttgttttaaaaaattatactaatatatttttaagttatttatagctaatacttaaattaattatacattaataaaggcaaaatctaattcgcgcgcgctctctgttttgccctatcgcgcgacatgttcatcggccgtccgatcccacgagcgctggtgcgtccgtacatggcctggtgatccacggacgtgagatgaatccaaattagaagccatgtgatgctctacactacgccggcttcaaaaataattttctcttaaactaatcatccgatatacgatccgattacaccgttgtattcgtaagaattgaatctttataataagatctcacatgattatattttgatgaaattataaattacttttataatatatctaaattacttttagatttcactaaattacttcttagacccataaaagtatattcaataaagtctaaaagtaatttacacacacacacacacacacacacacacatatatatatatatatatatatattatagaagtaacttagaaaaaaagaaagtaactttatcacgatattaaaagtaaatccgttacggaggtaaaaacatgagtctatatagaaattaatttaatcagcacaaaggggtgcagg

SEQ ID NO: 63818 - DNA, 25600 bp, Oryza sativa
cctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaataccatatgcacaccacttgccgcccaagtataaaatcacattttacacattttagttcgtaaatacccatcatattcattttattccagcaagggttcatgtataaaaattcacattttaattatagatggaatgagcatttgcatatttctaagcatggctgagcaagtagttgcacatagagcatatataaacccatttgagcacaaagagtgtactctaaccatttctaggggttcaaacagcaagaggatcaattattcaaggtggaatatgcagcaaataagtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatacttttgtaaagtgatttttactagattagacttcataggagtgtgaagttgtgttttctaagactaacacatttggtttcacaatttttggagttataatgattttcttatagattttacaagttacaacatgttttaggcatatagtgttttatatgttcatgacttttgagtgataggttcagaacatgctacttcctgtttaagttgaataaaaggaataatttggttaactaaaacatttttagttcacatgtttatgatctttactagtatggttcatattttataaactagagatgctctaatctaaactagcaatatattatattaacctagaaattgttatatgagctaagttcttctaattttagtggatgaggatggaactatggcttcactggtcaatcaagtttttatttacgtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagtttttacaaattaatggctgctctatgttagtaaatccttatatgaatatttagagacttttactacacagtaagtatataatattatttcataacttggaaatacatgttttaatgatcctacagaacttaagtttactcaaattgaagctaaattgggttctacatcaatttctaaagtttagcttatctaaaatttaatcattatagagattatagtttagaggccatttgatgcaaagtaagtattacttttatttcaccctaacaagagcctgtatgatgatgaatctgtagaatttgattttgttcaaaaatgagttgaaatgaattttctatgcattttataagtttggacatgttttatgtatgacttatcttagataaatcttagagacattatttgtacagtaagtgtcaagttttatattcctggaataaatttcataacttcaagaatctacagcaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgaggtttctaggaatcaacccgcagtcctaggcccatatgtcagttactaacatttttcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggagtctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcacgtgggttttgaggctcgatttaatcgtgcatgcgtatgataaggactctagggactactaggaggctcaccaagaatcaaacgcggctcggcgaagtcttagcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcgtcggcggccagagcgcgacggtgttccgagttgacgcggtcgcgttcccggagattggctgcactaaaagaggcgttcttggtggcgttagagacggcattgagagggaattacagaatgcttattgaacggaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtagcttcataacttaatgtgtggaccaaattatctagtgttgaatttactggaggtaaatgattacacctagattccattttctttggttgcactcaaaaataatgggtagactgctcacagaaattaaacaaagatgggctattagaaagctagattgaatttttaggaggcttaaacagaggaggaaaattctagaaaaattacatttattcatgataactaatctagtgtttgaataaatcatttcccatgttcacttatgtgcagttcaatgtacttttggatgaaatatggttttagccaattaaatttaatttgatttcttttagttgtctgcttcaaccgattaatttgagatatcaacttgagtgttaacatgttaccaaattacagaggataagtttgtgctaatcattgtccacataaatttttccatgattttatcttgcacaaaatattttagagaattaagttgacctttgtttgtatatgtgttcccacttcataattgcatctaatattattatagggattacattaaacttgttttagactgagaagatgatatttgagtttaatattaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatggcataatataggctcatttgcaaaaacagcatttagcaaagatttaagagtagtaaaataatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccgcttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaatcaattaacatcacacgattaaccatcgtgagctaccatttaatgtaaccataattaaaacaataaagtaacataatttataattaatccctttagttagctaatgtttctaaacatggctaagcaaacttacatatagcatttagctgaaccaatccaacatataaggttcatgctaatcaaattataacccataggaaaataagatcatcttcggccattaattaattgggaaaggttcaccacccgatgacattcgaaaataatgcatagttgaaattaaataatagctttaaacgggttcaacatgctcaaagggttgtttgggatctgtgtgacttgtcttgggcttccgcaaactcttcggaaccttcctcaacggaaacgctctcctccggaacgtcggaaactaaagcaattaaacaaaaaatcaacaaaacagtacaaaaacaagcataaacagtacatgtgaatatttttaacatgtagatcttgattttaaaaaaatttagcaacttgaaccacctgaaacggatctacggttatttagttacgattttctgaagatttaatctattagaaaaaaggaaaagaataagatgatgatgtcatgatgacgtcatcaatggtggccggctcggatggcaacctcgccggagctagggtggtcggccgggattttggaggacacctacgcgtagaggacgtcggcgcgaacccgatggtactcaccaatgcgtccaacaacgagggacggcggccggcgacaacgcaagaggcggcggcggctcggttgaacggcggtgatggcgctacgacggccggcgacggcggagagggggcggccgagcttcctcgctcccgtgcgcacctaacggcggcaacgagaggcggcaacgacggcggacgcggcggtgcggcgtggccggaggatggccggcggcggcggcgggttgggtggtgtggcgacggcgctacaaggcacgggaaagcacgggagagggggcaaacgaaagagaaggactagggggtcctatataaagccttggattgaagagatcggactcctcccgcaagaaatcgatccgagaaaaacaaaactcggttttggagataaactcgaaaacgagttcgattcgggcaagatactcaacgatttgctccgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgcttgggcggggagggggcatgttgggccaaactcagcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagtgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgctgccgttcgtccagccgtgcgccgccgtcgctacggtcgtcgtcgtcactcgggaaggccaccgtcgggatcgccaagtcgccgccgtccccgtccgccgcttcgccgccgccgaagaccgccggagcgccgtcgccgtcgtcgacccgaagagcttcgccgcttcctcctcgtcgctgccgccgtccgttggtcttccgccgttcctttggtcaccggtgagttcgccgcgtcgccctctacccattggtgccctccgttcgcgtcgtcgcgccgccgttcgccggcgagcatgtgagcccgagtcgccgagccgccgccgccggggtgacgtcatcgctgacgtcatcggggtcgtccgccgtgagccggtcgtggaccgatcaatctcggccgtccgttttggatagggttgatctcggtcgtccgttcgcgtgaaccgccgcccgtgcgcccggtccaccgaaaccctagccgctgacgcaataatccttcttttccttttcaaaaataattcattattgcgtcataattcgattaaaatccatataaaggttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttccttgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctagacgaggattttatgcacaaataagttcggaaattactagtgaatttccgggcgtgacaatctgtttgagggtgataagcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtgtaggttgttttgaccggtatgaagtgagcgacttttgtcaacctatcaactactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattatctgggacgcaaattctttctcctaaccacacagttccttgctcatctactacataaccgatggcttttcctcttctcatgttcttttttatttcttggatatcaggatcattcacttgagcttctctaacttgatcaaacagagtaggttgagcttctaaagtagccacaaaacctttgctgactatatccaagtttaacttctcaaattcttggcataactcccaaggtaaatgtcgaccttctgacatattacagtagcttttcctgctaagagcatcggctacaacatttgctttccctgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacaccggcgcagtcactagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctccagatgagatgacatgaccaagaaacttcacttcggacaaccaaaattcacatttactgaacttggcataaagctgatgctcacgtagtttctctaaagctagacgaagatgctcttcatgttcttctttcgtcttggagtaaataagaatgtcatcaataaacaccacgacaaacttatctagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccagttgatcaaacaggtcatcaattctgggtagagggtacttattcttgatagtaacctcattcaacgctcgataatccacgcacattctctgagtatgatctttcttctccacaaagatgactggtgctccccatggcgaggtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctagcaaatcctcgggaaacacgtctgggtagtcttgtactatggggatctcttgtagagcaacttggtttaaaaacacaccatgatatttaggagaggacacaaagaaagaaacggtttccccattgctactggttaaagtcaccttacggttagcacaatctataactcctctgtgacgagataaccagtccatccctaagataacatctagatctttggattctagcaagataagcgaggatgggaaaggaacttcttctatttctatagtagcggaaggacaatactgtgtcgaagatacttgattgcctggggtattaactagtaaaggtctcccaagactaataacttccatcccatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaggacacttatcagcataatgtcctggatcaccataattgaagcacacccctggcttgcttccctgttccttcctgacgggctggttctgagctggagttgctgcaggacgagcaaccatgttgcggttgtcattgccacgattaccagtattgttgtcgtagaactggcgttgggggcggacaactgatgaagatcctccttgagggtacgatggagcttgaggtcccgtaacgagacgcggcctctggttactgccctgttgtgccttgaattgggcagccctgcgcttcttctgctccatccggttatacttgtcttcctgacgaatcgccttgtccaccagctgctggaaatcccggaaatccgtagacatcaaggcataagacaactcatcatttagtccctctaagaacttctcctgacgctcttcatcggtgcgaatatcttccggagcataacgagctaaacggttgaaatcgtggaggtactcggtgaccgaacgagatccctggttgagtgctctaaattctctcttctttagagctacaacacccgttggtatgtgtgtcttcttgaaagcggccgtgaattcctgccaagtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacttccacttccggtgcgcgtgttcaccatctgacgataagcagagacaacaggaaagaacgacagagagacaccctcagaacggagttatttaattaatttaaattttatattgctcttaactgtgtatgcttacatttaagttgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgacctaactaagcgactaatcccgccttgcgtcggaacgaagcgatggatcttcttcctctggagtagctggctctctttcttcagggtcttcctcttcttcctcatcacttacgatgtcgatgacaggttcagcacgatcgggcacaacttcacccatcacgcgaatcttcgaagctaactagagacgaggtggcggacaggttctctttcttgcggtgaggcgaagcttgggggttggcggcggcgtttctcctttaagttcagctaattccttctggagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactagaaagctgatgaatccaactcttcttcaaaacgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatatttttttttaagttagctgcaccatctagacttaactgatttgaccaaagaggaagaaaaataaaagaaaagacacgtactaagccattatataaatatatttttagcatttaactttttggacagagacaaataattttttttttgacaaataactaaagtaaaactaaaatacttatgatctattataagcacggtacagtgtcaccataaaaaggatgagtagtactagtgctatcatgattgtatcaataccataatagatgtacagtgccgactaatcaacgaaatttaataaagtgaaataagaaacattttgaaaagaacaactttttgcttttaaaagaaaagaaaatgaattaaattaattttgtgcataaccttgcatgtgctgccaacttaattaatttataagagaatagagaagaacagttctatttttttcaaaatattttgaaggctacttaaggtttaccatttggcttatcctaaggtcaaggtggctctgataccaacttgtcacgcccggaatttctatccaaaattccaagcgcttacatgtgtgttaaaccctcgtccaggaatcaaccgaggcacacaataacaaattgataatagagtacaaataaataactatttaatatttgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagattgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagcgccaatcctccctcaaatccgcttgattcactcggttaattccaaaattaattagggggaattaatcccctttccctcctcttcaattcccccttaatttccccttgaatggtgcccccaatcgccgggaacggccgcgccaagtccggccgccttcctttgccgccggccgccattcccgtcgccgttcccgctcctcccgtggccggctctctcccccatcctataaaatgggatcctcatccttcgttctatcgttttagccccttcccgagcctccccgtggtcgtatcacctctccccgccttctccttctccctctccgacgccggccggcctccagccacctctccctcctcaccggagcatcgtccggccgtgccgtcgcctccctcggctctgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcgcccgcgccggcctcaccttcctcctcgtcgacatctcctccggctgccccggtcgccgcgccagagcgtcggccgacgtcgccgtctcctccctcggcgacgccgcatcgccctccaccccggcctgccctcggtttcgccggaacgtcgccgcgaacctctccgtccgcctcgccggagttgttcggccgcccgtccctcctcgccgtgtaccggtcggccacctccaccaccatcttcggcatcgcagtcgcgacgtcgtcctcggcctcgcctccccttcgaccgaaccccgccggtgttcgtcgtcatcatcccgttccctctcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtgttcgtcctcggctccgcgtcgtcaagcctcgtgccggccgcagctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacgggatccgcttccgtcgacccgtggaccgtctctgtgcactcggtctaccgcggtcctttaggttgacatgtggggtccgcatgtcaacggcgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagctttcgtcgttccggaggttcccgaagcgtggttcgtggtcgtcgccgaaggttcggaaagccgttctctctgagcaaggcaagtcacatcatccttgaacatattgaatcccagtttgtaaaattatgttgatttaaattattgcattaccgctttatttaaattcccgcgttatcactgttttatctagccatgcccaattacctttgttatgaccttattattgttattgttattattattaccttgttcaccctagaataaataaaaccctaactagtgggtactctattcatggttccactagtataaatttaggtagatgcttcgctgtttaattaggcaacattaggtggttttataattttagactttgggaattctcatatcatttggacactatggaattgttggattatggtggaattggacatacacctctctttctctttcaaaacccctaaaacctgttttcggtggggtttgggtgcatgccagttaggggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccagggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactcccttcttccttcttcggatttcaactagtactagatggtcaggtcagtgaagaagaggacatcgccagttgtttgccgaagctccggaagactgcaggatccgctagcgaagtggaggaagcagtgaagccagatgtgaagcaggagtgaagatcttcgagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagtgaaacaaacaacacatcattgaaaagagttagttcctttaaggtcttgtccctagttctggtctattctttccttgtatgcttcccctctcaacctctaccttgtgacagatggataatcctggtaaccaaggctatgggaatgatggatccgatgactcaagaacccaagccaatgggaatgagagaagcaccaacgcaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgagtggttgcgcaccatcgagaagaagctagggttgattcagtgcaccgaccaggagcgggttggcttcgcaactcatcagctggttggaccggcttcagagtggtgggataactacgaagcatcacagccagaaggacataccaccacctggaacgagttttcatctgtattcaggagatcacatgttccctcgggaatgatcacactaagaaaacgagagtttcgctacctgaagcaaggagatttgaccgtcgcagagtacctgcacgggttctatcgtttggctcactatgcaccagaagatgtggaaacgggcgaagacaaacaagagaagtttctccaggggttaaaagatgagctcgcagtgcaactacttctagaggattatgaagattttgagaaacttgtggacaaagccatgcaactcgaaagtgagcataatcggatgacgaattgcaagagaaggatggttaacaacccagtatttccaggtggtaaccaaagacagcgcactgagccacttcagatcaccggatcttctgttgtgtatccagagttcctgccccaagaagatgaacgcaatgcagacaacaacaatagcaatactaatgctgatgataccaccaacaaccatggttcttgccccattcatgaccacttagatcaagcgtacaatgtcaacatcattcaccaagatatcgacgatagtatcaatgaaggcacccagaatgacaaccttagcaatttcgacactgagaaagactccaatggtgatagcaataatggcaccactgatgccgatgttagcaaggatttccaaccaccaattccaactcctaatcagaacgatcgttcccagacggacaactcagcaaagaagacgttgatttgttacaactgcaaagaaccaggtcatttctctagagattgtccacagccgaagcgtaacctgcgccatcactccggccattatgcaagaagaagacaggtcactcgtcttgtggtcactggagcaaacgccgtacctgtgaggcctcatattaattctaacccatagaggaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtatcgcgccagaggaactatattctaacctcgagctaataaccaacctgaggatggaaaagaaaaatcaagtgattaaccaaagagacatttgtttggactaagggttacagatgagtccttttcggatcaaaggcaacgacagttagtatagctttcggcaaaacacttcaaggtttcactgaaaggcagcaagccaaaggacctcatcgtcaccagaagcatccacaactctcggagtgaagagtacctggtggacaaagtttaagaggtgattgatagaagataccagcaaaggtgtttattatcgaaccaagaagtaggtcgaaaggtgattgataagagaaatctaaaaagaatacgtcagggctgaatgtgtaaaggaatactttgaatgctaaatgatgacaagcatggtatcttagtaatgacgagctgatctcgacgcatgacatgaagtgggtaacttgtatgaggttgacgccaaagatatgaattatgagaagttctggaacgaaagtcccatcttcaagtgccataatccagtcgaagtcaactagaggtacaaccagggaaaagtcaggtgaagagaagattccatctgcaacaggagattgagccaagcagtccagagtggagaagttttgctaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagcgccaatcctccctcaaatccgcttgattcactcggttaattccaaaattaattagggggaattaatcccctttccctcctcttcaattcccccttaatttccccttgaatggtgcccccaatcgccgggaacggccgcgccaagtccggccgccttcctttgccgccggccgccattcccgtcgccgttcccgctcctcccgtggccggctctctcccccatcctataaaatgggatcctcatccttcgttctatcgttttagccccttcccgagcctccccgtggtcgtatcacctctccccgccttctccttctccctctccgacgccggccggcctccagccacctctccctcctcaccggagcatcgtccggccgtgccgtcgcctccctcggctctgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcggccgcgccggccttaccttccttctcgtcgacatcttctccggctggcccggtcgccgcgccagagcgtcggccgacgtcgccgtcttctccctcggcgacgccgcattggcctccaccccggactgccctcggtttcgccggaacgtcggccgcgaacctcttcgtccgcctcgccggagttgttcggccggccgtccctcctcgccgtgtaccggtcgggcaccttcaccaccatcttcggcatcgcagtcgcgacgtcgtcctcggcctccccttccctttgaacgaaccccgccggtgttcg

SEQ ID NO: 63819 - DNA, 558 bp, Oryza sativa
ccgccgaagtggggccccaacgtggggtggtgaaggggttaaccggcgccgattttcgcgggaagagtggggcaaatggtgaagtacgtgaaggggatcgtgcccacgtcgttgaatgcgagctcgggtcgggaagggcgccggatttttcggcgacgtggacgccaatggcggttggggtcggccggcgaaaggtaggagaagaagctgacgggtgggaccgtcggtcccacctgtcggcgaaggaagagaaggagggacgcaaaacagacttttgcgagcgggccaagtgagaggggagccggcccgagagagggaaaaggcgcgcgggccgcggaagagaaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaa

SEQ ID NO: 63820 - DNA, 1963 bp, Oryza sativa
caggaacagtgacatggactaaagttgagcttgagcgatcggtgatgcaagctaccgcatcatttgatttttcgtactacctccgattcgaaataaattcagtccatgtttatttggtgaaaagaaaattttttggtgtcacatccgatatttgaccggatatcggaaggggttttcggatatgaataaaaaactaatttcataactcgcctgtaaaccacgagacgaatttattaagcctaattaatccgtcattagcatacgttgtttttactgtagcacttatagctaattataagactaattaggctcaaaagattcgtctcgtgatttctatgcaaactgtgcaattagtttttctttttatctatatttaatgctttatgcatgtatccaaagattcgttatgatgtttctgggaaaaaaaatagaaactacacaaggcctgatacgaaatatgatatatatcatatcagccttttgctttattttaagattgttcgatttattttgacatggaggacttagctagtgtggtttgcctcttcatcttcaatgagccattgtgcaaaaatgttgtcttagttggctttattatctgcagccaaggcttaattttaaataattcagacataaaaaggttaaatattatttattatctgcaaacagattgcttcatcgtttgctcttcatcttatcaaccataacaaaattaaaatttaacttaattttagagttcatcatggtagtttatttttagcattggtttttaagatgctaagaacgctatgtcaaagttctagagaaattttaaaaaattgctttatcctaaacgctaataagtattactctcttcgtttcacaatgtaagttattctaatattttttacatttatattgatgttaatgaatctagatgtgagaaatgttagaatgatttatattgtgaccggataaagtactatcttctccagcctctagggtgacactggactgtatccagagtataatcgatcgtggacgatggggtgacactggagtgtacacagagtttcatacactattctactactaatattcaaatatatcctactactaatattcaaatattttaccaccgacatcttgttcatttactgagggagaaaatgactgaagattgtgtagatctctctttttcagttatctctcaagctttattagtccggaatttttgcaaaccaagataattaagtttagtttgaaatggcgataaacttttcaaccacacgagtacagaggagctgagctgagcaggtggcaggccagctgcaccgctgtattttcagagacagttcatgtaggagtatatccagcactgaaaatagtttttataacagaaaaagccacacacacaaacacttggaaagaatagaaaccatgcttcaatcgaaaactaaaaaaaaaaaataacctcacagagttctcaaaagcagcagtacatttcagagaaataaaaaactaatcttgcattgcctccacgcctacagtagaatctctctctctctcgagagagagacagctttacactgttcaaagctgccacttacccccaaaaaacctttcagttttggacagctcatccctgttttaaacctaaaaaagagagtgtgcatgcgcattagaagtgcagaagtgatctgttcaagattaatgcaaaatcctgcaaattactcagtcagttcaaacttgctatagccaattctgaaaaaaagtagtactatcatttcagaaaagagatttgctgtaccttgccaagtctgaagaaaaaaaaagaactaaaaaaacaaccttttctttttgcaaagggattcagaaaaagagaccgacctcattgtttgacttaatgcttatacttatataagtcaaaatttaaattttacagcttaatctgaatttgaccttttggtttgggctgcaggaa

SEQ ID NO: 63821 - DNA, 2460 bp, Oryza sativa
acataaaatactattaatgttttattatctaataataatattattattattaatcataaaaaaaatcaaataaggcggatcgtcaaacgttggatatagaaacccacaactacacttagaatgaacggggagtataatttacttatattataatgatataaatatatttagtaatagtgaattatgggccattttgacggtttcaagtcatgaacagtagtagtgacgttaggcaggagagggtgaggtgtgcaagaggccgggagagacagacacctcggcagccacacacgcggatgcgcccgggcccaccactcccaacgcgtgggccacatccgggccatccaatccaccccagcccatccatccgacggcccagatcacgcgcgctcctccgctttccttttccgaaacgaacccaaaagaaataaaaacaaaaaaaaataattcctctcctcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggtcagtaagcccgccttctccctctcgctttctgttctgctctgctctgctccttttgcttttctggagggaggaagtttgcgaggagaattcccgtttccccctccgaatccgtgaacccacactcgtttccccacggcggcaagaatttcgggtagaattcgacaaacaatatctatccctgtgttgtgcggttcttgtttgcgttggtgaggtttggaaggtgggaggtcaaagggctaagcaatcatcagataatcctgtcttgatatatccggtattcgttaatgattttcacacgagtctgaaaaaaatcttcgcctaccaattgtcgctgtacttttcacacctacaatgagacattaatgttaatgcagtctgaataattttgtcgaaattatagataatggtggaggttatgtgtcactcatcactgtgttgcctcaagtctcaagacctagatatgcatgcacgatccctgcctttcttaaaggactattttatcagctttgttgtagtttgaatggaagttttttttgtgtttaggatcaaatgatgcggtttatgttggttcttaggatcactgaagcttcaattcaactttgttcattggcaggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggtatgtctgtttcatccaccaatgtttgccttgtatatttactcatgtttaaatagtggggtagtgtctggttataaattgtaatcacaacaatgattgctcaactgtaaattccattgggagtgtattgagcacgcatgacggttatggatttttccaagcaaacagtggcatttgtattagcagacagtggcatttacgtggacaattagtaaccaggtatagaaggcaatttgaatttattaaggtatattattattccagatgcagcctgtcacactgaatttatagctggtgggattatggaaatattagttgttccattaagttggcatacactctgcagtgtttagatcaattactacatgtaaaaaggacgtgctgaagtgttgatggaacatccatcgatgcttgctaagtgctggcagatataatttcagttattcccctttttaaaaatggcaatactttaagccttttcatttttgttttctttcctatgtaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatggtacattacatgtattttttcccttttttagttatgagcaagtagtataacttctgttctttcagtttgagccctagtctaaggatatttagccaactgatcatagtgaaatatgggagaaacatggcaggcttgtagaatcactatggagattcaagtttgaatttggatttggattcttgggctgataaccacctcttcatactaaaactaacagatatacagagagaaaaactcttgcatagtggaggaccaatttacttccttttgaggtgaccctcttatgaaaaccatgcatcacaccttgattgtcaaacaggtgcacatgacttccatgacagttataccatatcccatttatactgctatgccacgtttccttgatacgtt

SEQ ID NO: 63822 - DNA, 8347 bp, Oryza sativa
taatagttagcaatgaacgcttctattaaacttgttgtgatatttccgagaaactcatgtatcctaggtactcctccattctcaagtacacttcactactaatcaaaacaatttttaactttgactattactcaattttaatgatccgtctattctaaaaataaaagattttaaccggatgtgacacatcataatattacaaatttaaactggttttatatcttgagatggagggaatatatgttccgggtgacacatttaatcaagtctcatctatccatgacttcagggtttggatgtaaatgtcgggtttaatttattttctgtgaaaaaagactccagggaaaacagaacttacggtttatagcagtccatcgagaaattttgattgcgattctatatatttaattacgggttcagtggacatttacttaaaatactggatttggatctgatctgtcgtagatccagagaaatagcattgtccatactggcaggtgagacaagggtagcatcgccaaccatgtgcctttgttattgccaacacggcctaccatggtcttcaccaaatggatctacttaagaattagtatgctttaagataggaattgcatcaagctttctgctttttcccatttctcaacaaaattttcaagtcttactgaaaataaacaaattattatgagggtttgaatcaaagggcctgtttagatcccctggcaaaattttgcaccatgtcacatcgaatgtttggacacatacatagagtattaaatataaataaaaaaaataactaattacacagattgcgtgtaaatcgcgagacgaatcttttaagcctaattacgccatgatttgacaatgtggtgctacagtaaacattgttgatgacggattaattaggttcaataaattcgtctcgcagtttacaggcagaatctgtaatttgttttgttattagactacgtttaatacttcaaatgtgtgtccgtatatccgatgtgacacgccaaaactttacacccctgtatctaagcacagccaaagacttgttttgaaacctttacagatacaggtagctctactgtaaatctgccacagtcaacattcaacaatattttgcatgggtggcttgagaagaaacagaaagggaagcagagaaaggcaacagaacacctgaaacctgctggaagatctgtttcccagctgcacagcctttacagatcatggagaccaggagatgcagttgcatcagatgaaacaacagcaaaagggaaaagtgacaaaaaggcagcaagttggatggagcagttagccagttactagctgggagacagcagcaaatgctttgggagagaatgcaagatatggagtataaacatgaatgcataaatcaagcagaaatcatgcaagatattgagactaccattttccttctgtaacaatgctgacttctgaattcagctggggagatgaaattggctgggctaacattcagcagaatattgtacattttgatggatgctatgatgcattagcaatccttcccgttcttttttatttgtacgtttagaatccatgctgccaatactgactataacagaaaaaaaatattgttatactgtaattctgtcagcacatactagcataaaaatttagaagacaattggtcagagttatttctcttaaataccaataacataaagtgaaaggagaagacgagagaaacaaacagtaagaaagtcccactacttcacatttttatcatgcatgatgcccatgaaaagctggtatgatttcacaatactaagtcaaaattagcatatgcttcattttattcaccatgtcaagcagaagcttatgaataagattgacaattttacaatgcaacgagaatcatcgctttttactgttttatgtttcaactcgctgcaaaacaatcacaaaatcacagcccgtgctttttagtaacttagtaaacctccacgtgccattgtttgttctttttgagctgcgacagcttctgctcccaactctcacctctttgctcagctactctcttgagtgtgtcctggatccctggcatcatacccttcaaaccacaaaagtagatatgtgcaccgccatccaaaagtttaaaaatttcatcgctgtactcttcaatcttgtcctgcacatacatctttccaccattcttattcttctgttccctacttagtgctttatcatacctgcaaagtcaatgaaattcaggttagttcacaaaagaatcagtcagctactcaccttttaacttcagtcaggcatcaaatacaaccagatcaatcaacgcaaagctagactacatctttctcaaccatgtcactgaaatactggatagaccaagacaagatgttaagcaaaaagcataaaagggtccacgaacctgaaattgtctggatactgctgaaggtagtttgtgaactcttcatcatacagaaggctatcagtgttagcaacacctagaaatagccaagccagaccaccaaacttgaaacttgggacatcctccatgaacatacgacgtagatagccacggtagggagcaacaccagtgccagtagcaatcatgatatgggttgcatttggatcatcctcaggtagaagcatgattttgcctgaggggcctgcatgtgaagagtaacttcagtgataagcttgaggctggaataccacatgcaagccataagttacaaaacaagtcataataatattgaaagacatctcttcttcagattgttttctccaacaaccacatctttcagaaagcttataagctaatattttctccagccacatctttcagaaagcttataagctaatatgccctctatacatacccatccaaaagatttcagaaaaaaacattgcatcacagatgtgaacttcagataagaaaaaaaggttaaaagcctaaattttcagttaggggctattgtttatcgttggaacatataagaatgatatttatatgccatctgaaaggagcacgatacctgttatctgaactttgtcgcctggtttagagtcgcataggaaattactgcagatacctttctttgtggggtcttcttttccagtttcaggatcataataaacagcacgacgaacacacaaactggcagtctttccatcaaaagaatcaccgtacctagtagatgcaatagaatagagccggacagtatttggggaaccaggtttcttcgggttctctccctggtggaaaattaacatgaagattaaaagggaaaaggagaattcaggatgaatggatgcagcatgatacaggaaagcaagcttggtacttggtattgttaaggaatataggtgccaattaaatttgggtcgttcttttagaactgtttaagaagaaaggtatacagtacatatttcatatctcttgctaagagaaaatgagtaggattaccatcagtttttacagtgcctacatatttcatacctctatcttttatctacagcaatgatggacccaatggcaaattatttgataataagcaagaggttgaaattccaggaaagcgtataataaactttcacttctagacaagatgatgacaaacctaaacaaaaccaaaacttaaaaaatattgcattatgttgagcaagaacaagtccaaattacttactggaggaatgacaccataactttgtccttcccagtatggaacattgccaccatgatcaataacaatatggcatgtttcaccaggagctttagggcctacaagcctttcgactgagacaattgtggctgtgtaaggctcctttggtttgtataagttaaggggtggctccttcgcattatccaattccagaggttttacagcaactttgcttttgcttgcttgttgaacggacatggaaaagatcttgttcatatgccttgattttagggccttgctttcccatgctaatgtggttccaatccatgatttgttgcagaagttaacagtattgctaccctgaacataacaagtcttttgttaaatacaggattaccagtataaccacattgcaacaactataaaaattctcatggaagcaaaataagagagtccacactcaaccaagaacaatgcaactatatgtgttgctacaatgtcctcatcctccatttctcacatgataaatcctatactttcctaggcaggttttggaaaaggaagagtgcatgccagacaacaatttgtttgttgtagcaattctcaaaataaattcgtgcacatagcacatggttcccattcaaggactgatgtaccagtttttggcagtaactgacccaacaccaggtaggagatattgatgccaaactccaagcaggcaggaaggtggcagcttagctaatctaagacaggccaagtgcccatatagccagtcttcagggcgacataaaactcatctagaattgatatttcaccacataaatcatcacaatacaattaatttatttatacttgcagagtatactgtgaatgtgccatttcaagagccactgctgctggacagaatctgtgcgagactgatttccacatgctagaaagtactacacgcgaaacaaaaactagctgcaaaccccccaaatttataggagcacaatttgaaacttatcccttccagcaactaattttctacagtgccagaccagatcgaaccacgagattcctcaacgagagcccctaaaacgcaatctctagaggcagaaatcagtcacaagattcacccccacgcaccttgctcgaggaactcctcccgtagccgcccgcaccgatgggcgccgcgacagacgcctgcaggacaccacagaaagcgaaagttagcgccacaggatgcaggaaaagccgggaatcgtgcggcgggagcggcagcgtacctgagccccgagggcggaggccatcgccggtggatcgcgaggaagaggaggaggaggaggggttggctagggttttgatctctggaattgacgcgaagctgaggagagggaaagggacggatatgtttggcacctcggagaagagaagagagcaagcgaagatgagacggattccaattttccttttccaaattagtaggagtatcaaattaaagaaaacgattatccaacttgctttgagcatgtgacaaaaaaactttctttttttttccttcctaaagaatgtctaatgcatgctgctaataattttgcaaatagaaattaagaggtactaagtaaatatatactatttcatactaacaagtattctctccgtcccaaatacgtcgctattcatagtgttagaaagaaataactatgttttggaatggaatggtagacaaaacatgtgataggctgatagcttacatatgcatacatcatagtcgagttcaatggtcttcattcttaaacatgtgctgaaacttttttccaagcaaacaaacatgtgcgaagcaaatggaagcaagagtgcaagactcgaagcaaacatttgcaaatcaaatgggagggaagtaacccctgtaagaatttcaaagcacatgaccatgacctctggaaaaattcagtcaaatatagttatacaagtacaaccatcatcacaccttcaagcaatggtttcttactgggccttggtgtgggctgtttgatgctgggcaatgggcatagtttgctaggctttgcaaattatatatcctttgtgaggccactcaattgatggctgacatatgcttcagtttggaatgaaatcatctcaaatcttacatgaacgttctgctcattgcttctcggataatcaatttataaaattaactctaggcaacggatcacacattcacacatccttaatgctgatcttttaattgttttactggagaggaggttagcgattgtcccttctaaaacattttttttatcaaaaatcacatgagctaatggcatcttcgtaattattttcagaattagaggtatggccaaaccaagatcccttccattaaaggacggagagaacaaaataaaatatatcacttttgtaggcctgtaacaataatatagaacaaaagtctcagcatgtgaatatcacttaaggcttttcaaccttataacattactattaattatagagagctctacagtctatatatattaagggtaagtcaagatgtataagggaattaagaagctaacaaaacaagccacctcttcatcatagtatgcttgaacacaacgttggttcatctgaatttcatctaatttgaattttgccgggtccacctaatttgaatttgaatcaccacattggtttttgcttgaacatatggagcattttgaactgcctgaacttttgtggttgctctttgtttcgtttgaccaaagtgccatgcacaatgtataatcgagctaggagtaaaaggaaaaagaaatgtcagggtttatcagtacttaaaatgaaataaataaacaatacttacgttttaatgtgcaatatattaataagtatatatgttaaatattataaaataatagattgatttgttaaaatattatgaaagtgatgtgagaaataatgattgaatatacttgtatgttgatttgtagaattaaaaaaaatataaatgatgttacatgcttgtatgaggttaattatgtaattattgctagtagatgataatgtgctatggttgtatgttgagctttaaagttagtgattataactttataggaagcataaatactctgcacagaggttgcgccacagctgcagtagagtagccaaacatgtttgtcctggtatataataatctatcaaaataaatggtcttcatttgcagtaatataacttttttatcgaggttgcaatagtgtaatcgtctattcccttgtaggatttttttaaagttctactccatccgtttcaggttataagattttatagcattgtccacattcatatagatattaatgaatatatgtctagattcattaacatatatatgaaagtggactatgaaacggaggaagtatcataataagggtgtgtttagctcgcgaaaagaaaatttttgggtgtcacatcggaagtttgacaggatgtcggaaggagttttcgaacacgaatgaaaaaactaatttcataacacgccttaaaaccatgagacgaatttattaagcctaattaatccgtcattagcacatatatgttactgtagcacttatggctaatcatggactaattaggcttaaaagattcgtctcgtgatttccatgcaaactgtgtaattagttttcttttatctatattaaatgctccatacatatgcctaaagattagatgtgacgtttttggaaaaaaaattgagaactaaacaaggcctaagtcaaaacatttttaactttaaccgaatctatggcattcaaatatttaccgtaacaaacatatccattgtcgatacatattctatggaggatttaacgaaaccaagtttaatattgttataagttagtagatagttttgatttctaatgaaattaaagcgattggatatactgcaatggaggggtaattttaacttgtaataaaattaaagtgatttacaatatatagaatgaattaaggggagtagttaaatacctcggtggcacgggacacgagggtacgtgatgttgttaactggacgaggaaggcgatggggaaagatgggaggccagtttactaaacgcgaagcgctcggccatgttgccgttcgatcgatcgacctgtggtgaatttggatggaaaggggcagcttggctcttcttatgaaggaagggatcgatcacctattgaaccacacgaaatatattgaagctgaatacggaaccatattaggataaagatatgtatttgtgatccgttttctgagcagaaagcgtcccaattcccaaatctgcatgcctaaacaaccctttgctatcagataatcaaaactgattaagagaaaaccacctttcaccattgggtcctaatattctttctaactttgtaaggtactccctcctcggttattttttttactagaaaaaaagcacgtgcgttacaacgggtgaagtctattttaatcttattattgttgtattgtttagttaagatgaaattcactatgggagttcgtttggatacggagtatttagaaaatcatgagttgcagttaggagtccgatcgtctcaagttagcatgcgagttttcttaaatatatttcttatatgattccttctgtattatcaaaagtgaatgaccttaaaaaccgattcaaatacggatacatattttgaaaagc

SEQ ID NO: 63823 - DNA, 2504 bp, Oryza sativa
agttaacccctacgtgaggatccctctcctctctcaaaccaccctttagtaaccctgtattcctctggtagttcaagctgcaccacacggctaggtggagtagaacccttctggtgtctacccattctcttctggtgtctacccattctctgtattgacatctccttggtggttcctgtgagaaacgaatagatgtaaagcgaacaaagttagaaaatattgtgagaaaataaggattcatgataatcaaaatattcttaccatgaaattgtcgtcaagaatatttggacaaacaaagaaccttcaacccaaagtcgtaggctttatggaacgaagaacctgacaacgatcactgcatctgcatcttgtacgggcttcccatggagcgagtgccgtagttagcacccgccagttgcactgttgttcacgacattgtcgttcgtaagccgcttgtaacacacctaagatgacatgcgcatacatacatctcagatgcaacaaatgcacaatgtaatgttcatgtggtatttctgaacaccagttagaaaacatgtatgcttggtaaccactgacactgtccagtaatccttccaattttcccttataaacgtgcactctccagggacacccatctttttccttaacacacctaacttcatattgcgaccagttgaacttggcaacccaaaactctctatgtagtgacactgcaaaatgctttaccgcctccttcatatcttctgctctagtataaatcgcttcctgaataacctcattttctttgtgggatccacgcttcttaagttttgaatccaattcctttttagcgtggatgtgaacaattaatcttgaggctacaataaaatctttgtattgcttcgagtatttgttgtccgctaaccttttgcaggaaataaaaagacaatcaaggaggagtgtacaataacttcgaacacttatatcacgctccttatctatgagaaaagatatgcatagggaaccaagtagaacaaatgcaaaacttgttgtattcttgcattcggttcaaaccttggtaagacatatctggtaagaatctcatacaccatgtgcatcctcatctcatgtctccatcctgccagggtatccagcatatccattgttgccataaaaaaagataaaaaaaggaaaagaaaaggaaaaaaataaaacaaaacaaaataaatgtggctccttggtcttccaaccaagtgagtcctttttccttcactcttgtttttgtttttttttgtgtccaataaagcctagcagatacaaagacaagtgtgggggggtgatcttgcacattaacggcataacaaaagcaagatcaccccagaagtgatgagccatgatgaaccacacatggaaaattgatgcagtcagacctaatgaggggtctgccaaacctcctgttcggctgaaccacctctaccatgaatcgtcctctgttttatacagagtgcaggtttgcacaaattttcctttggacatccattctatcttgagtttaatttgattatcagttctaaaatatcaaagataattaaactcaagctagggatggtacaattagagttcatgatctccctgaaaataacatgcatgcctattattcttagctcattacttgttgcttgtggtgatatatccaatagggaccctatgttatccagacaattgatgaatgagatatagtctgatgatagaaatcctgctcttcatgttgcacacttgggaattttataaaaagaaaaaaatatataacgatgctaaactcctcattgatatttttattcccactagagccataggttgatcagtcatgattagcttgctacatacgttgcttgtcattacattgagcgttgtcaagttttgtgaccctagtgaaatgtttttcgtactctcatggtcaagatcatatacactccacatacacgcacttatgcttgacttctacattggaagttagcatttctcatttaccattcatttcatccatagtccacaaaataaatactccatgtcgtttatgcctcttcctccaaagttctttaaaaaaaagtgagagagaggcatggctatgcaaaaagaaaggaaaaaagtgttcatacaagtgtggagcatgatgatgaaaaaaaatggaagaaaaagaaaaaaaagaaaaaaaatagccatgcactctcccaaatatgaaaagagaaaataaatggaggatgataaaaggagttatagtattttcttccacccacaaatttaccatagacatacacatgcgcattcttgaccagaaagtatgacttgtatttccatagatcctttatttgactttgcaatatatgtgatgcaagtaatgctctactcttttccataccccttgagctccacataagccttattagatggtaggaaaagaaaaggcccaatcatatgcctttgtgaggaatcataccctttgagagatcaagagaatccattaagga

SEQ ID NO: 63824 - DNA, 540 bp, Oryza sativa
tgcacgggctctccctctccggcgagctccggaggcggcacaggtacaccgtcccgatgtcgccgccgccgatgcgccgcacgagcttgaagtcccgcgggcctagcggcgccgcggaggtcgtcgaagccgcgcggatggccgcccacgcgacgtcgccggacctgtgcggccgcaacagcaccgacgcccgcggcggcgagcacgacgtcgccgccgccgccacggcggccgacggcgagcagtcgaacgacaggcgcgacaggctcgagcaccgcgcgaggctccccgtgctgctcgccgccgagctaaggctcgagttcggcgccgtcgtgtcggcgtcggaggagtacctctccatcgccgccggcgagagctccaccatcttcggctttaccggggcgcgcaccgccgcaccatgaacgtgagcacgtgacactgtcgtcggccgtcgtcgtctacctcttcggcgaaagctcttcgcggcgagctcgctgtgccgtggtgaagtggcaggagcggtttcccgggcgatttata

SEQ ID NO: 63825 - DNA, 56793 bp, Oryza sativa
  unsure (1)..(56793): unsure at all n locations
actttcatcacacatggaactcaacagtgtgatgcactcaccgatgctcacgaccctactcaaccgccaaaaacgtaatgattttcatttaggttcgaacccattcaacatcaatgatccaatttatggagggtttttcataagatttgaatcctatggaaagattttgtatttgaccctttggaacaaattgaggcttttagaatggtgtgaaatatctttcgaatggctccccaaaactagggattttggagaaccccaacctgatggggtttttttttctgagtttaatatctcctcatttttattgtgtttttttctatggtttgtctatacgcggctatccctgtattcttgtgtttcgtagtcctccattttacacattatttcctatcaaagcgcaatgatttccctgcatataatttaccattgatgtgtttaaaaggagttcctgtatatcttgtactagctttaaatttattagctgcgcaagatagggttaacttattgaaaattgttactccaactattaaatccagaaaattagagtttagttgttattgcaatatctgtaatgttaggaaacagcttgagaaattgtatataaggtttaggttctatatagttcatcaccacgcaggtttttatggcatctaaccgccaggaagattaaatttccacatccacatattatcactatgattccttgttttttcgcacttccctatatgattttgacccatcatgaagtgttaaagcacaccaatgtgacaagccacgtgtttatctgtatgtaataagtgtgagagcatttgacgaaagttatatcatgacacgtgctacggagctaattaatcaagaaactacaataaagtttacgagtgtagcaaaataccaaacgcacgaaagctttaccgtagtttcttgattagctctgtagctcgtgtcatactgtcatgacacgattttttgtcaaacgtcttcacacttatcacatacagagaccaacgcatggcttgccacgctggtacataaattatgttgcaattaataagtggctcttattaaacggttataaaaacatgttcttttggacatgtctttcaagttgaattttcaatactatgtatttctactaaaatatttagattgcatgtataaatatcaaacaagttgatcatgtgttacagcaagtactttcataacatagtattattagttttttttaagtaatacaaatcaatatgtatttggtgggactgccaatgtccaaatgtgaacgaaggaactgtccctttgattttagctctggtaccacaattggtggaatagcccaccctagaatgggtgcagttaaccaaacgaaaagaaaagcaactagctagtatattatatatatatatatatatatatatatatatatctcagaatctaggtactacatggtatatatatttcatcaggacttccataaatataattaaaaccgatgcctgatgatcctttgaccatcaatgttattgtactagatctgtagtgaaatcaatacatttttgctaacaactagggctgacttcccttcttcccaacctggccaccctcttaatatttcttgtcttgttccattgtttatataatccccacacacaaccattcactagtcagctaggtctctgctcatgcatgcacagagttttttttaattaattaaactcccctagcatgtgtatgtacgtgcaagctgtgattaatctaggattaatgcatgcaaaccaaggtcttttggtgtacttgcaatcaagaggagggctaaattaatcaaaagcaattgtccccatcctaagccatgagagcccctttactagatgtatgtgcctattttttttttccttttttgatgctagatgtacggtgtaggtgcctgttttctttttcatttttgatgcaaaatgtaggtgcctcgtttgaccagacattatagtggtattgtccatatgcatgctaagctctatcagattttcagagctcaggtcagaaagaagtagaaggccagtgtaacagtgttatagcagctagcagcactgcggcagtatcacccaatcaattttctgtggccaatttggccattgctgccattatgaattgccaatctgtattgtatagcattgcatgggagagggaacaaattgctacaccgaattgcttgctgcccagcccggacatgtaacgaggcagtaataacttgtgcaccagccctgaatttatacacctgtttgtctgtacatagtagtacatactactagtacaaaatacaacgaataatgctacacgcaccatggcgctgctaaaattacccccggtaaacggtggccgacatatgagccccctggtcccatgtgtcggccgccgaacgtcggggaggcgtagcgatttgtgaatttggagggatgactgtttggtaagtacatggtgcaaaattgaatgcagaggcagatgggatgggatggaggtggcgcagctgtatagaggtagagaggagtatctaacaattgccaatggtaggggaccggagacctctgaacaatttagtcccttgttgttgtagttgttgttcctaggatcggtttggagttattgccacggccatccagttcaccaaaggcactgggaattgtcttgctttcctcctccattgtctccttgcaatttcaggcctctctgcaaattgcaagagatacagcctacatttaaccacaataatacacgctgttggtgagcatagaacatttaagtgcttttcatttcatcatgtgttgttggagtaatctaaaaggacaagcgaagattttttttttttggttcatcctggattgatctccaattctccattttctccttgcaatttgaggcctctctgcaaaactgcgaaagatacacctacatttacccacaacacatgctgttggtgagcaaagaacatttaagtgcttttcatttcaatcatgtgttgttggactaatccaaaaggacaagtgaagatgactttttggttcatcctggattggtctctcttttttttccctgttaggtattgcattgtggtcttagaccaggccggccaatgataggagaagaaacggagcagaatgagttcaagagcgatcctgatagatagcttgtgttgtgtgcactgctgcaattcaaagcagtgttgttttgtcatcttggacgcatattgcctcaaaagactagaaaaaacgtcagtagcaaagatttgcagatgctaccatatcgagaggacggcagatgatctcatcttgatcatatcatgcaatggtccaaaattccaggccagaaaaggagttcagatggtcggtcactgtggcactgcctggccatgaaactggagcaaacagctcgagaacgcagcccattaaattccaagaaagggttaaatatgaaaagttttgcccgtacaggacaaaaaatacatgcacacatgattcagtgacaccatgcatgaaattgctggtcttatgatctttccactccagttcatgcattcagtattcagtacatgggacacgctggtgatgatcatgagtcatgacaacaactcagtaggaatggttaacaataagaatggggcatggtatgtttaaagttcgacattatcagctcggcgtgtcaatacacccaggccacaaccaagaatcgacaaaatgtcttgtgtatgttaaactgagaaagctggtgttattttgtgacattacagccaagattggtcctgaacatgataacttgtttgaacctattaccacattgggacttggcaaacagctaccaaatgcaagcacatagggagatgaagttactgggctgctgtaccaactcgggtacattgtcaccaagctccaaaaatttgcatggattcctctactcaactggtttcgaggccaagatcttgcagacaggcatggtctcgtttttactcagtaacctcaacgacggatggacggggatgtcattcattgataccctatctccaatgtcaagatttgccaggtccacctcaatttttggagggatgtgctcagcagggcagagatacaccaagctggtccttattttctgcaaaaagccgcctgtttttttcaattgaattaaatagtcaggtcaagcatagaaagacaacaattcagcaattagacacaaattacttcaaagaatagcaaagcaagagttagataatccacataaagaggtaaacactgccacagatattgaaaatgtgacatgccatagtatatactgcatccgtcccaaaatataacctaggaccggatgggacatttcctagtattacgaatcttccggtcctaggttcttatattttgagatgaaggcagtacttcagtatgactagttatatatattatccacatgtttgtgtggtgccataggcacaaaatcatggtatctagttaaaagaaaatgacgaagcaaagagcagatgtcctagttccacatgtaaaggcagaatcacaccagcaaatcagatacatcacgattgtgtcttgagaaaactagactgagagagcaccaaatatgactaagtaaagcaggtagatgagttgtcactcccatctaaagtgcaacgtgtgcactcttatcaggcagtcattaaaatgtgtcactgctcagcgtgaaatcaaatagtacaattatgatcaagaatatattagcaactcttcagattggccatatgaaattgatatatgtatgtttcacatgaaaacaaatatcaaaatcttaaataaacaggtttcaggaatgtataatttatagcaaatggtatatgtcacattgcaaagactgcgaaatgaaaacgactccttttcgtgactggtagcagtaaagatcatgatttgccaggtgtacacgaaaacactggtaaagcctttaccaatatcataaaccccagaattagatgcataacatagcatagcaccataaccataactcagataccaacaaatatgtaaatgcaaggacaggggtacatgttaaattttgaactcctgtgccaaccacttgtcctcccttggctaagagtgactacttgtgctttctcacatgttctcttcagctaccgtcagtttggcgctaacttgattacctgaaaactactcaaacaatttagggcattcttggaagatcccccaactcccaagcataatcttaaacctgctacaagcttaagatatcatgctccacaaacgaggagcgccattgtaacagagtttttgaaagattaaactacattttgttgaagttttaaattccatttccatttttgtttttgagaggctagcttaggtggcccagaagagatgataagctcattgaagccggcattgaggccagtggaaattgaatgtcggaagttgtccccctcataaatcgacccggccttacaaatggtaagcatattcgggacctattgattgcgatttatcattgcagaagtaccaaagtcacggctcgttccttacacgaggacttcgatataaacaatgggaggtggcagaaaaggaccacaaacccagtcgatgcggtagtaaataatagagaagatgtgtgccacctgcccacttgcattaaacaaactaacttccagaatgcagcagacttggtgtacagatacttagaatgcgtataggatagtaatacatcataatggaaatttcgtactgttcatcatttattttgccaaatcatggagctatccagaattattaaggcaagagtcctatatcttaaataagaaaattgatgcccctctgcaaaacttaggccagcaatacagtacaaataatatttgccaatttcactggaaagggtaattaattttccacttgatagaattatattttttttttatagaacagttactaggaacgtgcattcgagacaaaataaatatcttaaaagaaatctacctacacacaacaccaagagtaatttggtccctacaagtccaacatcttaacagaacttcagattaggaaacaaaaagaaataaagtaaattgcaccatgttattcactaatctgaattgaggaattcacaatagaatgcacatcttcagacaataagaaagtcatttttttattctgttaaatagaggaatctgagctttgcctggtaatggagggctcaacaaagcccattaaactcctgatttggatattggctttcaaaaatgttagctacttttgtggtactaaaccttgatataagacaaatagatgtgggaatctcactgcttacgcttagaacctccaacaaacaagctattttccaagtgaccacttacacaaggtcagcaactcagcacatctgcttggcaaaaatcccatgtttgctaccactcaattatgggctcatgtgcaagagcacctcattatttttttgtccccatccaggctccaatatcaactttgagcacaatgtgcttacatgcatccaaccaatgcgcccatactacaaacttgccaatcccatgggttgacacgataagcaaaccatgccgacaaccaagggcaggcccaggcctcaggcctcctgggccatggcccgaggcctaggattcaatgttcatcatgatgtgcatttttcaccatgcgagacacacagaacaaggtataatgggtcggctcagttcttgggccaatcctgggtccagcactggcaacaactccgttcttcatttttcttcataaatatcgataagcaagctaacacatttttcaatctgtggtataacttttcatgtcactgttgagttctgacacaatttcaaacaaatgtgcatacatagactcgtagaataaagctattcaaattcgatagtttacatggaatcacaaaaaatagggtaacctggatctattgatccttagccgtggcatttgggtatctactatctggcctgtacttttcagcttattcactggattattgaaacagattatttgttccacgcttcaaaaaatatgttttctttaaaaaaaaactttcttcaactgcattgcttagagccttagaccgcttactttaaactatttgttaagtttatttcgtaaaatatttaaattatccctataatcaaggagataatccgtggcaataatccactcaatgatctaaataaaactgggcctagttacagaagggcagagttttgtgccaagtgttaagcatcatgcaatgcacatttctatgttgagattccataaaaacataagctatcatcttgtatatagcacagggattttgccaaataaaaagaaaacctatacctttcttcaacccagggcagacgtcctcccccttgaactctacaggcaagttcaccttcagcattgttccttcatctgcctccaccagcaccaagttcaatatatttcctgttgtttcgtctctatgcacctgcaaaacacaagagcatccacatcaaccacaatccattttatgcaagatagtgcagacccggtcctgacgcacaacatatctgaccaatttcttctagcactctcgcatatatagttgcgaaaccacaccagtggttcccccagctttctcaggataaaactgctcaagaacagtaaacaatcatataaaaagaaggattggttctctgcactcctaaactataaggactgctacgtatctgagcaatttctccaaagtaagcactacaaaatactaggaagtcgctaacactagtaacaaataacctaacagccagcaatttgccaggagaaactacactaataatgcgcatttcgtacacagggtgagcaaacgaatcgacacggccaacgccaactgagctgaaatacgaaaagatttcctcgatgcgcaagaacgaatgaacgagatattttttggtgggtggaaaggacaggaatggagaggggcgaagaccttgatagggaggacagtgccggagtgcacgacggcggtggatcgctcgccggcgcggacctggaggcggacgggggtggagaggaagtatggggactgcttcagaatctccccgagctgcttcctgtcggcggtgaggagcttccggtgggccaccccctccccggggccggcgccggcgagggcgagtagcacggccgggacgcggccgttgcggcgctcccgcgccgccgcgcgcgggccggccgtctcccgcggcaacgcctggatcgtgtggtggtacgacgccgaggccgcccgcctccacggcgccgtcgaagcgccgcggcggagcgcctctccgacggcggcggcggcggcgcggcggaggcaaagcgccatgtgtgggggtttagggggacgaagagagttgggcttggctgctggttgctacttgctgggccgtcttttgtatcctacagaaaatgggttgggaaatcttatcccaccttctaaaaggataacttttaatcttagccattcattcttcatatctcatttcatctcaaccctccactcatatctttgtcccaatcccatccctcctaacccattatctaaaccgagccttagggctttcttgatttgggaggctattttatcccattagacggcagacgcacacgcccacacaccactacacaacatataagaccattctcaacccaatgactagaattgtgtccatagtattaaataaactatcatctacgatgaaaaatgatgtggcaagtgaataaatgagaaaagagaaggaaaccatgtcttccacgagacttggtttctacccaacatccaagacatcatgtaagataagtagcattaaatttaagtatggagtagtggtgtttgcattggaagagtagtgtctagtactagtttcttgacgatgtggagtttatgaaaactatgtgcagtgtcttaggttggtaatggcctaacaccacactctcacatatccgtaaatgcccccccccctccaaccaacacatgtctagtggcatattcctgatttcactaaaattttattgaaaatttacgaatgtgtgcataatattagtggatgttaagatttgaaccatgtcactaatgaaaaaaattggaagtatcaaattggtactaaattgtttgggctaggctagtgctaaccttaatgaagccactgaaaaatttggcatttgccaaatttgtagctacaaaatcaaatgagcgacaataaatttggatgtgtcaattattaataggattaaaaatggtataaaactaaataaccgcttgaggagaattgttagatggaacgtgagtttgaggggtggattgttaagtaagatatttggatggtctacgtagaagttttaggagagattggaaagaggagtttaagagcaaacatccatcttttcaaaataatggcctacatatatttatctgatagtttaagatggactttccataagaatggcttgttctcggtgaggtctatgtacctagctttaattaataatggctatattgagagaaataaatgtatttggaagcttaagttgccacttaagattaaaattttcatgtggtacttgtttaaaaggggttgtgttaactaaggataatttggcaaggctgttggcgggtgttaaatgtcgattctataccgccaacatccgcataaagatagataataaaacatccaacatagtgataggtgcttaatctcatatattccacaagtgttggtgtatatttgtatgcagatgataaaccccggtgttgggaggaaaatcagactaaagtgaggagaattatgcatccatacaaggaggggttgtgaacttcatcaaaacatcagtgaatcaacccaaaactccgagaaatagacagaggagagcccaaggagtccaccgactgaaggccaggccaggagggcccagcccaggttcggccgaacccccccgatcaccgttgatcctggggtttggcgtggatgctctagatgctcttccaatgacggttgcggggcagttcggacatttccccttcgccaaccatcatacctacccctatataaggacatcatctcactcacttcaacacacacttccaagcttgagctaaactataagaggctctattttactatattgtatactagaataggaagagagtagagtagaaagagttggaagaattccggagttgtcggtaatcttctcctatttcttttattctgtttattactctgaattcaatataatatttttcttgagtaatttagatttatcttgtgagaattatctcttggttagttcgtaaatagcatacgggattattgttcactataatcaactaaaatatagtgattgatttggtgagttataaacattaaagtagatagtatttgcttagacgtggtgtttaggtaattgttatccagtaattgctgcgtgtcccacagtacgttgaggtgggtgtagaggtggtgacaaccctcgatatcactgaagtcctccctgtccgggtacgtagtagagcgacatctgggaacaacgggttgccagtgcctgaagtactgtgttaggattaaagttaagctttccctagacactgtttctcactagtaaatcctctctatcctggcctatcatttgcttggtgtccttggatgaaccggaggaagcgctgatcacacacgttcccttggattcgatacccttggaatactccataggggaagtgctacatcagtatatccgtgcgcttgcggattttatctgtaaccgtatcaaataccaacaagcatttctagcgtcgttgccggggaacggttactaatcatttccgaacccagttcatcctcgtatcctttttcatttttttattctaccttcacccctgctatcttagagaagtattcctgtcaactcttctcgaccatggagcaacctttgtttgagctgtctgctcctcggggtgaattctatgagccacctccttcatcggagcccatttatacaactggctatgaaattcgtcccgagctaattagtatggttagggaaaatcctttttctggccttgatctagaaaatccctaccatcatatgcgagactttgaacaagtctgctcatgccttaagattcgtggcatgagacaagaaactgtgcggtggaaattgttcccgttctctcttcaagagagagcaaagcaatggtacacctctaccgttggatatgtaaacggtagatgggaaaagcttcaagacagattctatcttgacttcttcccagttacccatattactgcccttcgagtagaaattctcagtttcaagcagatcgaaaatgaatcaattggtgcagcttggtccagattcactaatttagtgcagtccggaccaaccctgtccttacccgagtatgtgcttctccaacatttccatacggatttgggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccaggagttgacatccataatgagagacgaatggctaagggaggcagagctttcatccgaagtaattcggataaataccgctcccgaatcattccttgccatctggaagggaacgatgtcggtattctctacagtccaactgtcggggccaacctcgtctctgagtcttttgcattcgcttatttaagtgataaggcagtgacctcgacaaacaaattcttcaagcatccgaatggaaatatgatcgaaggatttgggattgtgcaagatgtgcttgtctgctttgaagacagggaggcgatcttggatttccacgtctttgaagtccaagactttgatatcctaatcgggctgtccattgagaaacttctcatcaacacaccccgattaggtagcctcaaaataacactgggagagaatgaattctcaattctattttcgcgggcaaggatcaccttgaccgaccctctcccagaaattgagtcagcggaagaggttactgcagttcctcctcatgagtctcccgaggcccttctggaagatgatgtccccgacttcatcaaggaagaagcagatcccggtgagactctcgacctgccaatcatggaaccgtcacctcgacctccgcttgagcttaaacctctacctccaggcctacgatatgccttcctacacaatgacagagaagcccctatcataataagtgacaagatctctgaagacgagactcaacatcttctcaccgtgttagagaagcatcgttctgttcttggctactcgcttcaggaccttagggggattaatcccgcactttgcacccatcatattcctattgaccccgagagtactccctctagggaacctcaatgatggctcaataatgcaatgcgagaggttgtaaagaaagaggtcttgaaactcctgcatgctgggattatctatcccgtaccatacagtgagtgggttagcccagtccaggttgtgccgaagaagggaggaatgacggtcgttgcaaatgctcaaaatgaactaattccgcaacgaaccgtaaccggatggaggatgtgtatcgattacaggaaactcaacaaggctacaaaagaggatcatttcccgctacccttcattgatgaaatgttggaacggatggcaaatcattccttcttctgtttccttgatgggtattccggatatcatcaaattcccatccatccggaggaccagagtaagactacgttcacatgtccatatggcacctatgcgtatcgtaggatgtccttcggactgtgcaacgctcctgcatctttccaacggtgtatgatgtctattttctcggacatgatcgaagatatcatggaagtcttcatggatgacttctcagtttatggaaagactttcggtcattgtctgtagaatctagacaaagtcttacaacgatgccaagaaaatgacctagtgtttaattgggaaaagtgccattttatggtccgtgaagggatagttcttgggcatcgagtatccgaatgaggaatcgaagttgatcgtgctaaaatcgatgttatagatcaaattcgtcctcctgtgaatatcaaaggaatccgcagcttcttgggacatgccggcttttatagaaggttcatcaaggacttctctacaatcgccagacccctgaccaatctgctagccaaggatgcgccctttgagtctgatgacgcatgcctaaaatcttttgaagttctcaaaaaggcactcgtctccgctccaatcattcaacctcctgattggactttgtccttcgagattatgtgtgatgcaagcgatttcgctgttggtgcggtcttgggccaaaccaaggataaaaagcatcatgcaatttgttacgctagcaaaactctaaccggagcctagttgaattatgcaactactgaaaaagagctgctcgcggttgtttttgctatcgacaagtttagatcttacttagtaagagccaaggtgataatttatactgatcatgctgctttgaaatacccgctcactaagaaagatgctaaacctcgtctcttaagatggattttgctgctccaagaatttgacttagaaattaaagataaaaagggagtagaaaattctgtagcagatcatttgtccaggctgcagatcactaacatgccggaacaaccgatcaatgatttcttaagagatgatatgctgatgacggttcgcgactccaacccgtggtatgccaacatagtgaactacatggtattcaagtacataccaccagggaaaaatcaacgaaatctgaagtatgaaagtcgtcgtcacatatgggatgagccatacctatatcgggtctgctccgatggcctactacgaagatgtgtgccaactgaagaaggactgaagatcatagaacgatgccatgcctcaccttatggtggtcattacggtgtattccgcacccaggccaagatttggcaaagtggtttcttctggccaacaatgtacgaagactcaaaagaattcgtcagaagatgcaccagctgccagaggcaaggaggaatcactgctcgcgatgcaatgcccctcacatacaatttgcaagtcgagatattcgatgtttggggtatagacttcatgggacctttccctaagtctcgcaactgcgagtacattctggtggcagtcgactatgtctccaagtgggttaaggctatgccgtgcagcgctacggatgcgaggcatgccaagaagatgttcatagaaatcatcttccctaaatttgatacccccagaatggtcataagtgacggaggttctcacttcattgacaaaaccttccgagacctcctacgagaaatgggagccaaacacaatgtggccactccttaccatccacagaccagtggacaagcagaaacatcaaacaaacaaatcaagaatattctgcaaaagacggtcaataaaatgggaacaggatggaaggatagattgccggacgcattgtgtgcatactggatagcatacaagacacccattagaatgtccccatatcagatagtttacaggaagccatgccgactacccgtagaacttgagcacagagcatactgggccatcaggaattggaacatggattttgagggagctggagaatggagaaaaatgcagatcgctgaacttgaggaatggagagaaaaggcttaccacaacgcaaagatatacaaagaaagaacgaagcgctggcatgacaaaaggaaaaagatcaagaaattcaagccaggagacaaggtactaatgttcaactccagggttaagcttttcggccatggaaaactgcgcagcaaatgggaaggaccgtttgacgtcatcgacacctcttcgcacggggcaatcacactccgcgacgaattaggtaacatatttaaggtaaacggtcaacgcctaaagattttccttgagccaaatgaaactttagatgaagaagtggatgttattgaattaattgattatgaaccatgttgatctcatctattgcatgcttaaaaccctgtatagttgtcatttttgtgattaaaataggttttagtgggcctaggaaaaatttggtggcctgccggacccaccagggttcggccgatctagggcggcgcccgatcggccccaattttgaaccttagtctcccccgctcgtccctagtctgtttagatgcgcgtttggaggtagaacgttcggatcacaccagaacactccttcttcctcctttcctccacctttgcacactctcctctccaattcctcgaatttccactcatatccaccaatggctggcaaatccctaatcccattcatcggctcttcctccaattccacttacaacctcaccggagaactgacaccggcgaatcaattgatcccggtggaagaatacaccatggaaggggtaaatgcactatgggcgcagcccctcgcagcagtgccgggctcccctgcgaatctggagcccgtcggcgagctccctggttcggccgaaccttgcttaatgggcccccaataacctgcactatgttttgacccaattctaaatggttttcattgacttatggggcctccaatccgtgcaaacgtgtcctgaatgtgcagaggtgcattttgtcacatgacggatgtgttttctcctcaaattacctgcatacacatatttcaccaacactagtggaaatgattagtaataatccctaccactaagttggataccatgttttatttcattatatgcaagtattgactgtcaaaatattatgatttaaggaccgtcaacaatatgcatgtcgattgtctttagatttcaacacgcaatatgtataatttcattatcctcatcacaccttttgtagttgtgactggaactggagccagtatgttaccccctacatataagatttcattggggatttgtcaaaaatcatatcatatctactaagccataaagctcaacatatggcagatgcttttactagaatatgtttctttgttttcgagtcaatgcccacaagccgattcccaaaaaacggggaagtactatttaaaggtttcaaaccgaaagaaatatgaactgatgttcaaaggaatctagcaaaatggcactaaaaaataaatgatgtataatttcatttttcataaaaaagaacatctactatttgtcatttcaattccttcttgctaaattatccttagttaacattactcctttaaacaaatacctcataaaaatcttttttaagaggcatttttaatttttttttaaattttattcctttcaagatggctgttatttattagagctaagtacatagaacaatccaagaattgaccatttctgaaaattccatctaaataagtcacactcatcattcaactgaatatacacaatagagaccactaaattatgccaatttgccaagttctaacctaaccttacaaaactattctaagggaaacattttgaagagacggatatctctatgaaggaagtattttccaaccatttatcctcctcaaatcctacctttactttagaaaaattagttattttttttgtaacattgctataacaacaatatttttcaaagaaactcttaatgctattttcgctttcaatgtaacccctatcctagaatattgtagagagaagaagagaggccaatggacatgcaaaaccaacaaaggcatctaggatgggcaccgtaattagatgcaagaaatgcaaacaagttggtaagaacaaaacttcctgtgataggcaccatgcagctataggaggtagtaccaacacagccccacaggaagataacaacttggtgctattgaacactccacggagttttgtgcagagcaaaaaaaggaaggcaccaactactgctacaacaagttctgttagccaaacacacaacaacagttcaactaagcagaaggttagatgttttccaattgttcttactttaatttgcatttcccaattctgaacctatatgcttattcacactgtatgcataattttttcaggggcaacatgatcaaattgttaggatgaatgctaaggcaaaggttgcaacacagccaggtggttctgcaacagtcaacctgcaggcaattgtgccatattcctagggttgtacatcagcttcaattcagatcacatctaggaatgcatctgtttcagtctcagctcaagaaccagcaaagaagaaaacatctgctgggcctgctccatccaagaaggccaagactccaggatcaattctcatgctgccaccatgggaatctgacaaactttgaatcaatctatgtgtactgctaagtattgacatgccttagctaattatcctatttgtgatgtaatgtcgttcatgccatatgtcatgtaatggttagaatgctgctatgccagacttgtaaggctcatgtgtgctgctatgcctgactatttcttcttttgctgaaatatctatgaaatgcctaaattgatttggcttatgtcatattgagctgaaatttgctgagttttgttgatttggcctatgtcattgagctgaaatttgctaagttttgttcaactgaattggcacctgctatgttggtctgaaaatattgccttacaatgatgccagactaattggttcattctgcaatttgactacaattttatcatatgtggcctactacacaactgatttgctcaaatttgtatcaaactaatcatttccttattacctacccattttcataatattccattttagagttcaaataacacacatctttcaaactctaacctactattcgtatccttcaacacccctactatagcttccttctcaccaacagccttcctcgatgtggccaactcattcctagctaataccagctctgattgcgcaaatcttccttcttcaacagcagccggaaaatctcccttctccctcctcagcttccacacttcatcgcgcaaatcgttcagcacttctctaaggaaactgctcaacggaccatcaacccaagcaaaataatcgcaacctccactctgcaacagtgaaccaatttaaccctagaactcagctcaacaaaatcatggaccccttgaaccctagaacttagctcaaaaaactcacccttgcattcacacatttgaagtaccagcgcccgggattgtccgagatccgcgaaatccacctcaccgccttgttgccgcacttgcatgccaccgccggctcatactccaaagggccaacccgatacaggatgggggaagcagatgtgtgcctagaagacaccgacgagccctcactcctcgagctcgccattcaccgccactcatcgtgctagcagcttcaccaccgtcaaccgtgccgtcgccgtaaccccccgcgccgtaccgctctccgccgccgccacaacccactcacaacaacaatggagaacaaacgagcgacaaagataacactagaagagcccccgctatttattcccaactaccgtcgctgagtcagcgatgttgaccgagtcaagcggccacgtcagcgaaaaccgcccgcaaaacagccatgggagtcggtttgcccgggatttcaacgtttaggggtcaagatatctggttttgcggtttagggtcacgttttagattcggatcacttttgagggtcacgaagtgaacttattcctactagaaaatctatgtgcctattaacgcacccactatatagcatgtttatttgtttatcaatgtgcctattagtttattgaatatactttactttacaaaaattagttaatttttttgtaacattgctataacaacaatatttttcaaagaaactcttaatgctattttcgctttcaatgtaacccctatcctggaatattgtagttaattgtgttgttttgtttttaagaaaacatataaaacatgttcttctaattttcctaatgttcacacttctttactccatattttttttgttttctttacttttcctcttctgttttttcttttcttaatgaccaaactaataaatatgtttgacagattttctgtcagatccctaagatcgtctatagtatcactactaaatgatgggacccgtgagggtttctgtcacgatctttcgatgagaggcggaagatgacaacctggccacgagggcacttgtcctgcaagcaatcgaaaaacaagtagtaacaagtagaacaagcactgaattgctagatgaagatgatgtttcattattaaaaacacaatatggcggagttccgattgcaagcaggcaggcggtttagccaacacgcgtgttgcgagcaggtagcaagtagctaactctaataatcaaaaaccgattgttcttagcggcagctaagggtataagagagggggagaacgaccacagaggtgttagggtcgtgctctatataaactaggtgaaaccccgcgcattgctgcgggaatttagtataaagatatacatcgaaacattatgtgaattatgttggatgataatttaacaagtttgtgtttgaaaagctcttaaattataaaaactataaagatatagcatgtttgcatgatgtttaaatgtgatgattgttagtggatgatgatgtggcatcttgttaattagtggatgatgatgtgacatctttgcatgaagatatacattgaaacattatgtgaattatgttggatgataatttaacatgtttgtatttgaaaagctcttaaattataaaaactataaagatatagcatgtttgcatgatgtttaaatgtgatgattattaatggatgatgatgtgacatcttgttaattagtggatgatgatgtggcatcttgttagtggatgatgatgtggcatctttgcatgttaaacttaaggaattagtgggggataactttatagtaagataggatgagggggagaacgaccaatctagcttgatataactatatagggagatatgtctatataagtggcaaatataaataaaactttagtaaaggagcatgtatattaggtaagatcggctgaaaccccgatactatccttactaacaatcaagaagcaggctagagattatggttcgaaacacgacttagtacatcgaatgtattgatgcaacacttagtatgaaaagaaacatgatatctagacaatcaagccattgactgaatttttagggtggtagatgtctaagctaatctaatctagcaatacgatttagcagataccggcagaaaccctaaagcgagaagcagccaatagagctaaattgatatgctaagactagattagcggagacatataataaagatggtcacgatataaggactaaaatatctaaaacgacatagtagccccgatagcacaagccatcgagatgggttacctcttgcgaagcgaactcgtcgaaaagtaaaagcgaaaagggtggcgatgcgctgaagttgtattggattgtctcctgtattacaatgttatgaggttcatatttatacccgagtacaaacttagtccattatggacacgactcgaacctttctaaagataaaatacaaacaagactataactatcctaatcaatagatacaattaccttaattgagctctatctctgtttgggaattgtttgggaatgatggttatcttaatataggcccatgtcgaccccaagttatctctatcggctgtttgccatatcggccaaatcaagcctttgtccagtttttagccgatacgatactcagctgatgcacagtccgacttggagataaactcgaatccacaccaaatctgcctcgatctccttccttctctgaatctgatgcaaaattccagtgttaacacacatccatcatagaatctgaagaaccaatctttgaagccctcaattgattaattttctctaggatacacaatggcagcttccccaaaggacatgcaccttcttgtgctgacatcttcatcatcagtataagttgttgggaaagctgacaaagctaatgatggccttgtgtacatgttaatccacagctgcatgaaccaccaaggacctccataattgattactttatcttctaaatattgcaagcaacagagtgaagcattcgataaactgagccaagcagatatttccttagaggaatatgcttcttctaaaccaaaaattgagcaaagtgctgatagtttgcagttggcccataggttgaaccacataatacatctctttctaaccacatggccaggaatgcaacatgttcccttaaggaaacagatcatgtgccttgatattctgctatgtatcctttccaacctccatggatctgttttacacttaatgtccagtttgaaggggttgatggaagtcgtgacattcagacttgttagcatcttgacatgtaacaacgatggagtcatggggccttgccagaataagaaacaattgagtgtatttgaccagaagtaggccgcagcagatagcatcggctcattcttcttgacgtgtaataccccagaaatatccacaagcctaggatgccactaaagaaacctataaaagtgccaaaacaaagaaatttcggcaacacctctttatacacacacacaccatggtgccccatatgagtgtcatatatatatatatatatataggtatccactaacccaccgtggcagaaaatcaaatattgatttttcttattttgcaaaaatatgttcactgcgcggttttcgtggcgctatgttctgcatgcaaggccatttgaaagttctgcatgcaaggccgtttgatcagggaagtgttgaggttgttaccgggatatctatttaaaacggcggcgaggtaggtcagaagaggaggaatttgtgagcagaagcagatcagttctgcagaaatttgatggagcagaatcttttggggtagagggcagaaactcgtcggcgagttctgttgcttcgccttccgcggcgacagaaggcggaacctcgtcgacacatgatgtcgcatgcagaaggcggcagtagccgttggtgcgtcctcgccggcgagttcaggcgagcaccacaagccgacggtggaagaatgtggaaccgcgtcggcatctcggcgagtggtgacatgcagcagaagccggcggtggcgaaaggctgatccttgccaacgagttcttttgctcagcacaagcgggcggtgccggaggacggaggtctgttgaatggacacgaatgtgtgcagaactcatcaactgattggtacatatcgaagattcgaattggttgatgtgctctttataattttcctcttgtttgtgtgtttggttctgactgtgtgttgcgttatttggtcaggaatggttttgtgcaactgtgcattgcatggctactggtgacaggagtgaagtgatgaatcgctctctccagagatatgacatccatttccagaaatagtcacgcagcttgcaacatgaatttcagaagttgcggagcacccccggcgccgcagaagttgttccgatcgaacatgtaaccaaggagaacatttagccggttgtttaatgagcagatcatatggaataatggattgctttctgcatgatcgttgattagtcgtacgaactatctatactcttttatgatattttctatgagagaaacgcgactaatatttgagttgagttttctgtaacttctgcttgaaataaaaataagaagttttcctttgtttttttttgggctattttagcttattgtgttatccaaattctctgttgtcatctttgtccgctatgccccatcctttttttcgtagttgctgactgtcgtgtgaactaagagcagaatatgcctcgagtctgtggtgtagttttttgtcggacaaatccgtgaattggagcagtacaagttcttctgcttcttctgcggatgtagcagaacatggatcatagtttctgcttgtgtttgtatttgggtttagagatgtagcagatcatggcacagaactgggagcagaacatcacttctttttttggtttagagatggacatgcactgctttggagcatagcatgatctgctctctgatttctgaggagcagaacatgtggcagatttggtagtttctgtttgtgtttgtatttgggtttagagatgtagcagaacatggcgaacggcagaactgggagcagaacatgacttcttatcgtccagcgtgatcgtttctggtaaaaacataaacgagagccaccaccacctgatacattcgcacatgctgcaggactgccaatgcaaaatactccctccgtttcgttttatttgacgtttccgacatctttgtcaaaattaaggaagctgtgaaattacatatttgcccctgtgtcttctcctcatcggcgcaggaggaatccccaaaaatcgaccggcctccgacatgccgccgcggtgggcggcctcctctccgacctccgtgcccgtgtctcccaggtgcgggcgtgcacgccgccacccgccgggatcccctccctctcgtttttgccatcccatcccgccgggcctgcttgaccccgacgcctccttcctcgagctctcccaggtcggaaacgccggccgccgcgccaaccaccggggctcaccccaagacgccggcgaggccctcctgctccaagcaccgtgctcctgtgccttctcctcgtcaagccgcaacatcaagccgccgccgcggaaagaaagaggcggaaacgccggccgccgtgccagccgccggggctcacccccaagacgctgccgccacccatactcgtcggagccgtcgccgccacccctccttgccggagccgccggcagcaccattctcctgagccaccgaaaggtacttctttttttttagagtaaagtccatcaccggtccctaaacttgtaccgctgtgttatcccggtccctaaactcgcaaatcaaccattcaggtcctcaaacttgttcgactatgtcatccaggtctctaaacttgcagatcactcgtttagatccttcaacttgttcagttgtgtcaccacggtctccaaacttggatttgaatatcatctgggtcaaataggacggtctaaagactttatatttaaaaataattcataattttttcatgtgaaatctaatgaaaacaaactttatatcaaacttgtagccctcaacgcgatctacaactttgtagttgaattttttttattgtaagtcatttttttgtcccaaaatgtaattttaaaattataatttcaaaatctataaacatgcaacaatattttgggaccctatacagttttaattcaaaaacttttcaactacaaagttgtaggtcgcgtcgaggattacaattttgatataaagtttgtcttcattagagtttacatgaaaatgttatgaattattttttatataaagtttttagaccgtcctgtttagggaccggggtgacacaactgaacaagttggagaacctaaacgagtgatctgcaagtttagggaccgggatgacacagtcgaacaagtttgaggacctgaacagtcgatttgcgagtttatggactgggatgacacaacggtacaagtttagggaccggtaatggactttactcttttttttatgcagagttttctgtgctccgtggcttgctcattaatgccatctttgttcatttattcagtgtgtattatgaagttcataggactagtattatttggttgctgtttgttcatatgccttgcttcaaagtttcagagcttgtattttggactgtgttcttgtgatcaggaaggtacagaatgcggcaaatttgagttctctctgctatttggagttccctaaatccacctgctgtaacaatcctgagcatatgaaatcagcaatgttacactttatgctccctagcattgtttgttaaaacttagactgtaaagtcttctgaccaaatgcttgatgtgtattgatcacatattatcggtgtcttttctctacaggcaaggagagggagaatcagtgggagaagaatgatagaggaaaaataaacatgtgttcaagtctccttcatgtgtaatttattctaagattaatttattcttggattatacctaagtattctagcttaacatattgtgctactctacattgtactccctggtactcagtgaatgttgagctcagtgactacccaattttactcatgtgctgatcatttattcgttgccaaaattgtgcttcagattgctttttggtaattgaaattgctaatctgaaacactatccagattagcaattgctggtgctgttgttgatatgaacatgtcactgtctcttgttcactactgtctcttgttctgcatgattctccactgtctcttgttccatatactcctgcttgctgtgtgagctgggattcttgattcttgattccggatcggtgactactgatgcttatttctgaccttgttatatttggagaaaaaaagttggattgtgtaaaaaatcttagttcatttgcattcaacattcagtattccaatttgtaatttgtaactgacaatacagacagactacagatacagtatatgatttcttccaattgacattattcagccattcatattgccattattccaattgatattacagacacaattccaaattgtcttacttacacaatacaaaattttcaagctcacaggattctattgaaaactactccaaaatttctaccaaacaatttggcactacacaaatgctcaaataggcatgctcacatctcaaatttctaccaaaagttctgtgttaggtgaggtatcaccatctgtgtgttacatttagcaccaagagttccagattccattgtccaacattgtccaacgcattgacaacagcatccaggctctcccaaaaggcatcgttgaacacattttcagtctcaggacttgctctgttctgaagggaggttgggattattgtgacttcatagcactgaattgcagttgcagttatccaggtaacccaaaatgaactgcaatcagaaatcaagaacatgttcctggaaaaagaagagaaaaaatcgtctgaaaaggatttaggtgaagttgataatttgtcgacgaacaacaaacaaagaacagaaaccacaccagggcaccaggagcgtatgttctcctcctcgccggttgcgggcaaagacacatcggatgagctcgtgcatggcgtgccgcgagaatcgctgcaggagctcgcccttggcgccggcgtggtggacgacacggatgcacgtgttgacggcagtgcagacgtgctggttcccgagggcggtggcggcgggtgcgcgcaggcaggcgagcagcgactgcagcatccgcatcagcacggcctcctcggcggcggcatcagccccggcctcgaaccggcagctggcgacaggcccattcacgcagcgcggcgctcgtgagggacggacccatgagcgccatcacctcgtggagagcggccagcgacgccgaggtgaccgcggcgccggcgtcctcggagcggaccgcgtagaggaagggccgcagcacggcggcgggggagaagacgaggcggcgcagcgccttgagggaggagacgagcgggtggtccgccgcggcgtcgtcggctacggcgcgcgggtggcggaggctgcggcgcatgacggccagcacggcgctggcctcagcggatatcgcgcaggcgaggccggcatccctcgcggcggcggcggcggccggatttgaggaatcagggcgaggaggagggcaaagatggaaaccagcagtatgactgaactacagcgtcaaataaaaagaatgatttcggattgacttagcgacgtcaaataaaacgaaacggagggagtataaagaaaacgaattaggaatagaaacgatcaagaaaagaatccaaaggatggaaaataagcagcaaatcttagaactggaattctccatatgctagagctttcatcgttatctacaacacagccaccggtgaggctactaatctgagctcagttcagttatgaaccatccaaacgcagagaacgattttagatagataatgttctgctcttccttcatgatgggagaaatatcctgctttctcgctgtggataaacaaacataagtgcgaaaaaaccacccggatatatctcttgttagctcgtctccgatcaaatctcatatatacaacaaactagggaggctacgttcaatttttgaatctgctgtagaagataagttaaccaccgagaaaaataaaaacgggtgggagtattcaattcattagacccgttaacggtcattagcattatctagtgctagcgatcgaattgagggaggatagggagggagtagctactcctggtagtagtttctaattttcctactccctccgtttcaaaatgtttgacaccgttgactttttagcacatatttgaccgttcgtcttattcaaaaaaaattgtgaaatatgtaaaactatatgtgtacatgaaagtatatttaacaatgaatcaaatgatatgaaaagaataaataattacttaaatttttttaataagacgaatggtcaaacacgtactaaaaagtcaacggtgtcaaacatttcgaaacggagggagtatatatatagcccatttggggcaccatggtgtatgggctccaattctaatcaccgttagatttgatcctgatcaaactagttgatgtgggtatgatattaacgggtctgcccattagtagcttatgatatatggaatcagatatacttagatgaaaaggtaccggattcataggcgtaattaattatggatggtaatgatgtttaatcacatgcacacgattgagtatgtcatttatttccgtatatagtgtgaaaaggttataaatgaaacttttttatagtatttttttttaatgaaaggaaggtaaatatactcaggcaattcgtgtgaacgtatctgaaataataattttcttcgtgactttgggtacacgacatacgcatgtattccagagtataatcgtgtcaacatatctaaaacaaatcggttgtgtttggtgaacaaattaattttacgtgacatatattccaggaatcatgtacctatattttaggtacacccatgtgttttccaaaaaaaaaaatgtttgtttaaattctataccgtaccttatttcttttgctatatatgcacgtcgagtatgtgggaccatctccataatattatactggtatagagtatgtgtgacgcaccatgactcttattattgggtatataacccatttaaagacttgtgtatatatacttctcatcagggtatatacccaaatattttgtatatatccaattttacgtgtatgtatccaaatattgaacatatacccaaatattgaatatatatacccaaatattgggtacgtacccaatttgcacgtaaacatgtacatatacccaaatattgggtatgaaccaaaaaaaaatcccggagcatgaaaaataattctggaagtacacatacccaaatattgggtatgagaacacagaaataaataccgtagcatgaaaaataattttggaagtgcattagatcctaaaattcgaaccaaaatttgaaacagtatatatacccaaatattggatttggaaaaaaaaaatccttatccatgaacaaaaccaacgacgtattgggccgacgaacgagcttgcggacgaaaggcgcggacaaccagtggctgcggcaaagctcgcagacgaccagcggcggcaacgaagaagctcacggatatctggcagcgtaacagcttgacaacgaagattgtggaggcctggttgggaagaagaagctcgcggacgtacgatgtcaacgacaaatctcgcggacgacgatcagcagcctgcgacgaagaagctattgcatatccggtggtgcaatagcttcgcgacgaatgttgccgaggactagttgcaacgacgaaggtcacggtcgaacgtcgtcagcaacgatgctcgtggacaaccaacggttgcatcgaagaagattgtcgacgtccggcggtgtaacggcgtggagatatgaaattggagtgtgtaaaagatggaatgacatctctgcccgtatatatatatacactagaaatagaaaagtattaatagtatggatgaaaataaagcaattacatcgaaattagtgggtttgattatgtacatataatttggaaataaattgtgttcatgcaatcacgatcatattcatttggaaagttgacgcatgcaagcttatatggaaacagctagctgtgcgcgaaccatgcacgtatagtacaaatggaaagctggatcttaacccgctaatatatctataatatgctgttttgagtagcacggatcctaaagcagataaatggtggatacaattggagcccatacttcatggagcaccacataatttacctatatatgtgaaccaaggttcacttcaccttaaatctggaacgttggtgtgctttaagatgtgtgctacctaaatattcattgctctgtacttgtgaaggctttgctgtgtacttgctcttgacctcactttctaatcttccaactttacccctgagctaaattatagctctctttcatgctaaacacagttaatattacttttttttcttagtgttgttttaagttcttcatcccacggtgtgtaactgtgcatggtacattttttttttggaaataagtacccatacttttttctataactacataattaacatttacctaataaattgatcttttaccaaatgaaatttgtaaataatacctctgctaagatccaccgaaggaaggatattatggcagttggcaggagaaaatttgcagctatatcatttttgaataaaaatctaacgtgcatatataagataatatgaattataagattatgccacgtgtacattactccaataaagaggtccgggacaactcacatgatacttttgtggtgcattttaaattttatacacatttcaaattcacatgaaatgtcatacatattcgaaataatgacatatagctagatttacattaaatgatgtacctgtaatatagaaataatacatgtcaatttaccataataacattttacaaaaagaaagtttgatctatatatctacatacaaaaaaaattcaacatatctatatatctacatttacaagaacagtatatctccattcaccaaaaaatgacagttacaaaatgaaatgttgatttgttatatacacgggttgacattttttttgttaaacaaattgatgtatcgcaaaacattatgagaactcatgagaaatcaaaatcaccaaaagaaattatttgaggtgaaatgccgaaacataaacagatacttagccaattaagtgctaacaacggttattaatgatatgacttaatcaagtgatttgtaccttatagcactaccatgcgcatgggtcaacagagaattgtgagtgagtgatgagtcatcattgtccaatatgagtggagtactacttcaagtgcattttggtcttggcaattagatcatgtaccaacccctgctcacactataaggatacaaagctagatatgtacatcttacagtgattataatgtgtacacatgtcacacaaatgagtgaggtgcatatgaaccaaggttcatattttatatatatatatatatatatatatatatatatatatatatatatatatatatatatatatatatatatatatggcgccgtaggcgccacgtattagatggcgcctgacacaacacctccctaccctaccccacattcctcacatcccgcctacgccaaccatttatgagtcatttgataacttatgagaataccgcgtccaccccacacccaccactgcaccacattatctcacatcccacccgcgcccaactttcatgagtcatttgttaacttatgaccatgcccgcgcccacataacgccatgtgttattttttaactaaaaagcgggcatgcatgcgcaagtgagattaagaagccagttatttttcaactcatcagtacatggcacgtatcgacggtgtcacacgacttacctgtttttttggtttatattttaactcatgtggtgcgacaaggtgtgcgtgggggggcattcgtcgtgctcgttccggtgaggtattcgttaactccgtctgaacacacgcaactccattgcgtgttggcacgagggcagttttttttaactcgtttgcgcgtcactgcgcggtgggggcacatggcattggtcgttaaattgagttactttttaactcaagtgatcggcggtcattaaatgcatgcccgtattttttaaatttttttgtcagttacaggcagcgaatcttcagagattagtcacatcaaaaccgccgtagttatcgccgcccactcctcttccggacagttcttttctcttccccgttcttgagttcttagagatcgctcctcttctcgccgattcagttctgtggacccccgtttttataacaggaatcaatcgtgtaaacagtaccatttccctggatcaagtagtctggtacacacaagttcatagctgaaataccaaatacacatacatgagagtctagtgcgaattattacatcataagcccgcaggcatagtcttagatcatcggaccgagcggtccggaatacattccaaaagcagaagtggataaggtagcagagttaaggcagcggcacgacattgccacaggcaacaatcgtaactaagacctactgagcgccatcgtcttcatcaccctcctggtagtatgcgtagggatcctccgaagcttcatctccggcctctgattaagtttatatattgcaagggtgagtaccaaccgtactcagcaagccatcatagcaacaatacacatgataggggtattcaaaggatggctatggttctttgcgcaaagccagttttgtaattcttttcacaagcctaagacctagcattgactgatcaaattttagtaccagtgttcacatttaaacaacgacggttctgtccaccatccattgtgatcccaaggatagcttcccgctattgagtcgtcatggttttctgaggacgtccaccttcccgcctctcaggaagtggctccaacagcataaaaaacatcatgcaatatcccatcccacacaagttaagaatttagagtctagccaagtgtaatacacgtcccggtgctcaataaccgcgagcacggctatttgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggtttaagttaagttctctctctcacacactcatggcagtcctatcaatggcgacaccgatgtagggcacgactctcggccctacctcaacagctgtcccactgtagagcacctgcctcactcaatgagaaaccactatgcatggatagtgcctccgctcggctatctaatccgctaggtctatacccattcgagaagtacggttgtacgggggtcgtttcatgcttaacttcatggctcggtccttaattgaccagggacggcactagcccttttcggataccactcaaatcctccatccgccccagtcgaaaacatttgtttagttttattttcctttcacaaatcatgtcatcaatatcatggcaatgtggcgctcatgtctccacatgccgcatctcaattaccttcccaaaggtaattgcccaagcatatagtatttgataaatatgtgtatgcgtaaatctagagtaacatttctaagtatttgtcatagttgactagggacttatacgtaaatcatggttacaaggatttaagggtaaacaataatcaaggcatggcataatggcgacgcgatggcggcgcacggggctcgggacgacggcgcggggcgcgaggcggcgaggggatgggtgcgcggcgacgggacgggcgacgcgacggcaacgggcgacgcgacagcgacggcggagcggggctcgaggcgacggcgacgcgtggcgacggtagagcggggctcgaggcgactaggggacaggcgcgcggtgacgggatggcgacggcgacagtgacagcgacggcgatgggacagcggcgcggcgcggcagcagcgagtgcgcggcagggcacggggcgcgaggcggtaggcacgcgacgcggcgacgggatggcggcgcggcgacaggcgacgcgacggcgacggtggcgcggggctcggggtggccaggcgcgtgcggcagaggaggggacaggactagggaacctcatcgaacacctatgcctgaatgaataatgttttttcctatttatccctatttcagcctatttcctatataaattttattctataaatcctaatttttgcataaatgaagtttacttaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatcattattttaaattatattctaattgtttattttgccaatttaattttagggtttattcctaattaattattctttattcgcgatctaagaactccgaaatcaaaatccaatgaaataggcgaataatatcggcatgatgcaatttatttaaaaagtttttgaaggcccataattttagggtttgatttcgttggtcgaattttcagggtgttacaaacctacccaccttaaataaatgagtaaattccctgtgtacccctgaaaactcactcaatccctttcatacccctaaaatttacccgaccccttctatacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaattcttatttgaaattttaataggacaatggatttttttatcaggagcattcataaaaatgttgtgaacattggtatacctatctttatatgaatgctcctcatttttatgatctttttttaaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacgggaggggtatgcaagggatcaaaatcaaattttgggggtatataaggaagtaagcaaaattcaggggtatagaagggattaggaaaaatttcaggggtatataagggattttctctaaataaatctcgtcccgagatttcttaccggttttcgaatagatgcgggtattccgtcttcaagaattcttcgctttcccaagtggcttcatcctcagtgtgattactccattgtaccttgtacatacgccacactttggtcctagtcctcttttcagcttcatccaatatccggactgggtgttctggatacgtgagatcattgctaatattaatttcttccaacggagcttgttcctctggcactcgtaagcacttctttaactgagacacgtggaagactgggtgcacatcggcgatattttctggtagctgtaactgatatgcgacttctcctcgtctagccatgatttgaaaaggtcccacatatcttggtgttaatttccctttgaccttaagcctttttgtgcctctcatcggagaaaccttcagataaacataatctccttccttaaattctaggtttcttcttcgggtgtcagcgtaacttttttgtcgtgattgtgccacttttagacgttcacggatcaggcgaaccttttcttcggcctctttgataatgtcaggtccaaataccgcccgttctctagtctcggaccacatcagtggagtacgacatcgtcgaccaaacaatgcctcattgggcgacatctttaggcttgcttgaaaactgttgttgtaggagaattcggcgtagggcaaacatttctcccaatctttgctaaaatccaaggcacaagctctcaacatgtcctccaagacctgatttgttctctctgtctagccatctgtctgtggatgataagctgtgctaaaagcaaggtaacttcctagggcttcatgtactttctcccagaaatgcgaggtaaactgtgtgccttgatcggatataattctcttaggcacaccatgaagacacactatcctagtcatgtacaactcggcgagtttggcaccgctatagtctgtcttgacggggatgaatcttgccgtcnnnnnnnnnnnnnnnnnnnnnnnnnaaatggaatcataccctgttgcggtcttgggcaatccaacaataaaatccatacctatctcatcccatttccactcgggaatcctaaggggttgcagcaaacccgctggtcgctggtgctcagccttcaccttctggcatacgtcacagagtgctacgtattctgccacatctctcttcatgttgggccaccagtatccttccttcagatcctggtacattttcgtacttccggggtgcaatgaatatgctgattcgtgagcttcctttaggattaatcctttcagtccaccctgttcgggtacatagatcctctttttataccataagacatctttctcatcggtcgaaaattcctttgcaaaccctgcagctaggcgttccttcacctcttggatttcttcgttgtccttctgagcttcttctatttgggttctcaaaagaggttgaatatccagggtgtttatctgtccacggggtactatatgtaggtttagctgggctatttcctctttaagctcaggagccatcccttccattctcaaatgattgcaatggctcttacgactcaaagcgtcggccacaacgtttgctttgcctgggtgatagtgaacctctagatcatagtccttgattaattccaaccatcgcctttgcctcaagttgagatctgactgggtgaaaatatacttcagactcttgtggtcagtgtagatatcgcaatggtttccaatcaaatagtgtcttcaaatctttagtgcatgaaccacggctgctagctctaggtcatgggtagggtaattttcctcatgtggtcgcagttgtcgcgatgcataggccacaacctttccatcctgcatcagtactcctcctagtccttgccttgatgcatcacaatatataacaaagtctttcctattgtcgggaagaactagaataggcgcagaggtcaacttttctttgagctgttcaaagctttcctggcactgttctgaccacacaaacttcttttccttcttgagtagttgtgtcattggtcgggctatcttagagaatccttcaatgaacattcgatagtatcaggccaaacctagaaaactccgaatctcagtcacagatttgggtgccttccattccgtgacggcctcaactttagcaggatccactgccaatccaccggctgagattacctggcctagaaaagtgacttcttttaaccagaactcacatttactaaactttgcatataatttatgcttccgaagtttctcgagtaccaatcgcaagtgcttcacatgctcttcctcgtctttggagtagattaaaatatcatcgatgaatactaccacaaatttgtccaagtaatccgtgaacactttattcataagattcataaagtacaccggggcgttggttaaaccaaatgacattactgtgaactcatacaatccatagcgcgttgagaacgtggtcttgggtatatccccgatcctaatcttcaattggttatatcctgatcgaaggtcaatcttagagaacactttcgctcctttaagttgatcgaaaagatcatcaatccgtggtagtggatacttgttcttgatagttacttcgttcagtgagcggtagtctacacacattctcatgctaccattcttcttcttgacgaataacactggggctccccaaggtgacgaactgggacgtacaaatcccttctcttgcaactctctgatttgctttttaagttcctacaactcattgaccggcatctgatatggtctcttggatatgggggcagttccgggtatcaggtcaataatgaactctatgtcacgatctggtggcattccaggtaaatcttctgggaacacatcagggaatcgctgcactacgggcattcctttcaggggtagcatggtaaatatgcctccggcacgttcggttagtctaggatcttgatccatggttgctctcatatccgatccccagggtgtggccagggtaacttctctacgtctacagtcgattactcccctattctttgttaaccaatctatacccaatatgacatcaagggtctgaggcatcagcaccataaggttggagggaaacaccatatccctaaggcgaataggtacgtcaatacaagctgtatccacggttatttcacccccaggtgaatgcactaacattggttgccttaatttaactctggtcaaattgtgttgttggcttgctttcaaagatataaatgaatgcgatgctcctgaatcaaagagaagtttaactggaatggagttgatagaaaacatacccatcagtacgccctggtcttcctgggcctcttcagctcgaacgtggtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaatatttaagagaagtaaaacagtggagtaattaatcagaaattttaatcaacactgaacaacacacccatgctgcacggcccaaccatcctgaacaaccatacccggctgtacagatctaactccaaaccaggagctaagcaaattattaccaggtataacatccataattattgtgagaggtgtgagactaatcacgaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcgaaagtaaatgcacagttgaaataaatagagaatttaaatataggatcaacatgctcaaaggattgtgtttaagatctgtgtgacttgccttgcaataatcggtcttcaattaatcttctgaacactcccgacgcactcacgaaccttcgtaacgacggaaacgacaagctaacacgcaaaacgaagaaaaagactaataaaaaccaaataaacagtacatataaagtaaacaaacatgtagatctcgattttagatgaatttagcaacttgaaccactcaaaaccgagttacgatgatttagttatgaatttccgaagatttaatctattagaaaaacagtaaaaagaaaaacgatgatgacgtcatgatgacctcatcaatagccggaccaagatggcgacctcgccggagattggatggtcggctgcgactttggaggacatgtacacgtagaggacgacgagaggaacccaacggtactcaccctcgaaccaaacgacgaacgacgacggccggcgacgaggtctagcggcggcgcggcttcggtcgacggcggcgacggggctccggtgaccggtgacagcggggagagagcggccgagcttgcccacacctcggcgcaccttacggcggtgacggcgaccggcggcgacgacggaggcggcggcgcgacgcggatggagctcggccggcgacgacggcggggtggagcacgtggcggcggcgctacgaggcacgggagatcacgggagagggggcaaacgaaagaggaggactagggggtcctatatatagccatgggaggccgggatcgagcccacaacgacgggaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcatggctcggctctggctctggctctgtccagagctggaagatgaacagtagcgcagggaaggaaagtagacttcttgccgggcttttcttttcacagcctgattagaagagggagcaaaaccggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgcgcaaataatttcaagaaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaactatggagaatttaataaaaaattaaatccatccatgctttatatttaggaaattttatttcccacatttaacttcacttgtaaattaatgaacatttaatataaattctaataatcatttattaaataatttataaatcctgaaacaaaaatcaggatgtgacaaatctacccccttacaaagaatctcgtcccgagattcggaacggctagaaagaaaagggcataggtaaactgcagtctaccttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttggcttcggacactctcttgcaaagtggcctggcttgtaacagttgaaacatacctgctgctcccttccactactgttattctcttgagtctgatcctgctgaactagcaccggctgattagcttgctcgatgttaactttattgctttcattagtctctgatttgatctcaccaccgatgttcaactgttgcgactgtccttgacctgcagaagaaggttcaccaatttggagtggcttgatacgctgcctctggctactaccttgtgcctcctggaatacagtcattttccttttacggttatctatcctgttcttcttgtcttcaagtcgaattgctttgtcaaccagctgctgaaaatcaacatagtcatgagagatcaatgtaactgacagttcatccttcaagccttccaagaacttctcctgcctttcctcgtcagtacgcacatcttctggagcataacgtgccagacgattgaactcatgaagatactctgccacggtacgatccttttgcttcagtgtcctgaactcacgcttcttcaaagcaacaactcctgcaggtatatgtgtcttattgaatccttttgtaaactcttcccaagtgattggttgtccttctgctctgttcatccggaaatgatcccaccattctgaagcaggtccttgcaactgatgtgaagcgaaaacaactttctcctgatccgtgcactggaggagttccaacttctcaacaacgtgcagccaatcacctgcttccactggcgcgagtgttcaccatctgttgcagattagagaagataggaggataagggttacactaaagacaagatcttaaccagtttaacactgatctgatgtgtgtagaccattatattgttcaagttgattaagcaagcaacctagtatagttacacgctcatcattgaaccccaccaatgacgggaatgcaaccatacctacacacaagcaagcaacaaacgttctaccctactaactattcttcaaggatagtttggcggcataggttctaaggtaggattcaaacttcattccatcttgaccacttggcacttcggtccttcctcgatccacttgactgacctccataagttgaccacatcaacatcttctagtttcaacaactagtttcagaactactcaagttgaaagcaggaggggagaggatgataaaatgatttatagagaattctagagaaggaagaaaggaaaattttcacaaatcatgttttcggaaaatttgtccttaaggttattttcacaaatcatgttttcggaaaatttgtccttaaggtttgaccatttggcttatcctacagtcgagatggctctgataccaacttgtaacgtcccgccttcccccaggccgggcccacttacatctgatagctttcataggtcatagactgccctcacagaccaacacatgtcttttctgcacactttgtcctcactcgtgtgcagcacgcttaaccctggagttctttggagattggcttccggaaaagaagttgcaacttgttgatatgagtattctattaatcctattaagccctagaccgggatgttacaccctcacccccttaagagagatcgactcccccgtcgatcaaccctaggccaggaacgtcctctcttggccacgtccatgtgtccagtgccagcgcatgtgccatgctgtgtaaccactcccggtctacaccagacgtgcgcaccatgcctgcgcaactgcgacacacgcgcccgtgaaaccgcgagagtcggctctgataccattttgtaacgtcccgccttcccccaggccgggcccacttacatctgatagctttcataggtcatagactgccctcacagaccaacacatgtctttatcctcactcgtgtgcacccgggaagaatttcccggtcggtcacccatcccaaattgctccaggccaagcacgcttaaccctggagttctttagagattggcttccagaaaagaagttgcaacttgttgatatgagtattctattaatcctattaagccctaggccgggatgttacacgtggttcacttgcccgcgtccaaatccggtagaggtcctgttagtctgcggagtcctgaataaacctcgtccagtagcaggggtagcagtcccgtgaatagccattgcgttagctccggtgcgaatgggtgtcttgtttggatgggggcacttgttggcgaaatgcccgtactctccacagttgaaacagcttcctggcctcactgatccagtagcggcctgatttggtgtaggagcttgggtctgagtggtaaccagcctgtggaagttgctaggtgcggtaggacgattggttgttaccaccgttggtctccatcctgatgaggtagttcctttaggacactggggtgcgacctgaggcgggcggttcatggcaagcctcctcttacgattgtgctccacaaccttccggtcgttttccagtctaacgaccttattgattaaactctggaaactatcgtggtcctgtccaatcatgggcccacgcaactcgtcgttcaggccttcgatgaacttgtcgatcttttcctcctcgtcggcaagatctccagttgcgtaacgcgccagttgagtgaaacggtttaggtactcttgtatagtggtatttccttgtcgtactctcctgaactcattcttcttcattcgcatcacagcggcaggcatgaagttgtcacggaaggctgtagtgaattcctcccagcttggttctccagcatcttcttctcgagcttctttgtaggtgtcccaccagtctccggctggtccttccagttggttcaccgcaaagatcactttatcggcttcacgtactcgaacaagggtcagcttcttctcaatgatccttaaccaatccttagcatccataggttcttcagctgtggcgaatgtgggtggcttagtcctcatgaattctccaaagcttgatcctccacggttgccttgattatttgcgatggcttgcagaagttgggtttgagtagccatgactccggccagggtgtttaggtcgggtgtttgagtttcttcattgctggttgacgcccgatgtcggcttgccatctgtgtaggccgatgaggtaagtatcctaatttcctaactagcccttatggttttatcccgttaagggagttgttttgatgtgaactttgttttgcaagcatggtggaataaactcattcataacccaacagtaataatatcataaataacatcacagagttccacagataatacataagtcatgatgcaatcgactgcacatatacgtagtccaaataaagtttatctaaaagatacatcgaactaatcatcaagctacccgtcaatctaggtagggggggtgtgtctcgcatgctatccaaaaaccatctgaagcgagatcgaagctgcaatagtcctccagtctagtcatccaaccatccgcaggatcctggggcaggtagagggtggttgctggctcgtgcaaacctgagtccccatggctcggaagtagtggcctctggatctggcttgggcttcttgcccgggggtcgtgtgctcttgcgagcagtgctgagggtgcgagggcctctgataaaggtgatgcggtggacaggagtctcgtcctctgaaggatcagtgatgtccggctctatctctggctcagtgtcggtcccctctgtctcggagtcaacctggatcggagtctccaaactggaacccagctgcggtgacgaagtagggatcagtggagtgtgcacaatctctggggcaggtggctgtgtcactgtcgggtccaccaggtaaggtgctgactcagtaactagcatatcaacctctcccaaaagagcgtggagcgctggtgggtatggcggagtaaggaagaagtagcggtcacgccctattgctgaggaagtagaagctcctgtggtgctgactatagctgctcgaagctgctcctcaagctggctgacgtgctcctgactctttctcagctgctcctcgagtgtatccatcatcccgcggcgatcattgtactgatcagatagctgctggaactggtcgccatggacctagagctctaccttcagtgagtctatctcactgccccaagcctggtgctcctcctctagctgaagctgctgcactgtgaggtcagtcacctcggtctccaactctcccaaacgcctctgctggtcgtcgatctctaatagcgcctcctcgtagaagtcgtctactgcctcagcccatcgggacagtcgagtcaccatcgggttgtagcagcaaggtgtatcctagactttgtagacatagttgctctcctcccgaaacggatggtaagcaaagtcggtacttgccaactcagctcggtgaatagagctacgtcggaggaaggcctcccgggctgcgtcctgcatcgcggtctctgtaagtcgcgacggtggcgtgtcggaaagctgtagtctgactctgaaggaactcgtgtatgaacctcaatccgagcctcccaaacgggtccacactgtctcactcggtagatcggaaatctggggtaccgtaggcgcctcatcaaccgatgtagctcaatgacatatccctctgagcggggtacgcccatctcccagatagtgagtgaatcctgatctcccatctaattttaagaaaaacccaaagtcagctaagagtaaaactcgttttgggaagaaaatagttaagagtaagatgaaaatcgtatatagttttgtaaacatagcgtctttatttttgaaaatattactaaatgggaatttctcccttggccaactaggaaaggggtggggcgccttttggtcttttcctacagttgtatggctctgataccagctctgtggacccccgtttttataacaggaatcaatcgtgtaaacagtaccatttccctggatcaagtagtctggtacacacgagttcatagctgaaataccaaatgcacatacacgagaatctagtgtgaattattacatcataagcccgcaggcatagtcttagatcatcggaccgagcggtccggaatacattccaaaagcagaagtggataaggcagcagagttaaggcagcggcacgccattgccacaggcaacgaccgtaactaagacctactgagcgccatcgtcttcatcaccctcctggtagtacgcgtagggatcctccgaagcttcatctccggcctctgattaagtttatatattgcaagggtgagtaccaaccgtactcagcaagccatcacagcaacaatgcacatgataggggtattcaaaggatggctatggttctttgcgcaaagccagtttcgtaattcttttcacaagcctaagacctagcattgattgatcaaactttagtaccagtgttcacatttaaacaacgatggttctgtccaccatccattgtgatcccaaggatagcttctcgccattgagtcgtcatggttttctgatgtcacgaccagaaataacccaacgggcgttccttacgtgcgtgcattattccttgtcccaggaggcaaggtacaccaaaagttgatacaattcagagtttaacaagcggaagcgtaattaatttattacatgggcagtgaagacccagcacacaagaagacaaacgaaaaacagcggaagactagggtgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccaaactggcaacccgaccctgggtcccagctcgtcccaagccaacccaggccaaccattccacattttagttgttaagccggttttaggaattaaaaacactaacttgggtacattgctcgacttgcccataaccgagggcgcggctattcgaataggttatactctgatcagaggtgtacatctttacccacaagacacatcatcctcacgtgtaaccacgtgccacataccaccatggtatacggacggaagacatgacatagtttccaacccatcctagccataaacaagagtaccgacccaaccccacctacggccgaaacccccgggacaggcaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatatggaagtacggtagtgctttgcaacagaggcccgaagaccggtccttatatggccgaggtgctactatcaaaaccatgcaccctgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacaaagagcggatcttccgaagctgcagcgtctacacgaccaacggaaaagaaaaggcttttacgctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaaatttaatttaaaaagggtttattgcgtcagccgaggggagggggcgcgcggaccgggtccacgggagtagggcccacgtggcagcctcacggtccacggtggaccgggcgcacccgggctcgcaccggccggcgccgtgggccccacgcgtggtcgccggcgacggccataggcacggcggagcggcggccgagagaggggaagggaagggggaaaagaggcggcggtccacggctcaccctaggtcgacggcgacgatgaaaaaggcggccggagcggaggaaggcggcgcggctcgggtcgacggcgttccggcggtcggcgaccgaaacggagaggtggacgaggtcggcgaggatgcggtgaagccgaaggaggcggcaccgaggtgggaggtggtccggggcgacgacggcggcggaccggagctcggcggcaacggcggagagagagagcgacgtcgcgagctcgaattcggcgaggaggaagggtggcgagaggcggaaacggacggaggaggtgcggggagggtttaaatagggccggggcgagagagggcggccggagaaggaaggaaaccggtgcggcattctcgggctccatcaatggcgccagcgggattaggggaggggtttccaaacgaatccaagggagagagggagggaaaaatggggggaaagggagaggggatcacggggagtgattccccccactttattgcacgcggggacggcgggaggcggcgggatttgcggcggtggcggcgctagggcgcgggggaggcggcgggagcggcgggaggtcggggatgacgggtgggccccacccgtcagcaagggtggcgggcgggcccgcccgtcagcggcgcccgcgtggggagaggccgagtgggccgcggggagaggagagagagggggagggagatgggccgaattcggcccattagagagaaggagggattttagggtttttctttttataaaatcattttaactttgtttatttcttaataattattatttatgctctgaaaatttcactaaaatttatttacacattttaggcttttaggagatatacaaaaatcgtctaagccttaattgacttttagctttgcacattttaattgttggaggctttcacacggtttttaattattctaggcataatttagaggatgtattttagagtcgttttgggacgtgacatctgaggacgtccaccttcccgcctctcaggaagtggttccaacagcataaaaatcatcatgcaatatcccaacccacacaagttaagaatttagagtctagccaagtgtaatacacgtcccggtgctcaataaccgcgagcacggctattcgaatagatttggtttactcacactgcagtggatgtacactttacccgcactccgcaactgcccaacacatgagcctcgtcccaacgcatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacatatattaaattatggttcaagttaagttctctctctgacatactcatggcagtcctaccaatggcgacaccgatgtagggcacgactctcggctctacctcaacggctgtcccaccatagcgcacctgcctcactcaatgagaaaccactatgcatggatactgcctccgctcggctatctaatccgctaggtctatacccattcgagaagtacggttgtacgggggtcgtttcatgcttaacttcatggctcggtccttaattgaccagggacggcactagccctttccggatactacccaaatcctccatccgcccccgtcgaaaacatttgtttagttttattttcctttcacaaatcatgtcattaatatcatggcaatgtggcgctcatgtctccacatgccgcatctcaattaccttcccaaaggtaattgcccaagcatatagcatttgataaatatgtgtatgcataaatctagagtagcatttctaagcatttgtcatagttgactagggacttatacgtaaatcatggttacaaggatttaagggtaaacaataatcaaggcatggcataatcacaagtaggatgttcatcattgcatgcaattttattagtaaacaaaataattttgtaaatgggatcaacgtgttcaaagaatagtgatgacttgccttgctcgtagtcctgcgggtcttgaccctcgctcggatccgcaactccctcgggctctagaattacgtgcgaagaacgatttgaattcaattagaattcaaataaaatccaaataaacttcaaataacagtcgaacgcgaatcgatctttctatattgattacaaagtttgcaaaaccacgctattccaattttaaggtcatttaatcctaagtcattttgtgatttagaagtgtctccattaaaaattcaacgaagaatacaattcttagtaactaaatccgattatctccgcgagtgagttacttatagagattactgaaaataatctattttcatattaaactttgcaattctatgactataaataatctataattaatttctaattattctaaattttctaatcctccttaatctccatctaatttctatttatttatacttttttttattctatttctctcctcttctctttcttttcttttcctctctttctttctcttctttttctctcttttctttcttttctttttctctcctctttcttttctttttctctcttttctttcttttctttttctctcctcccccaggcttctttcttcccccctctctctcggctcatgctaccggggcggtgacggcggcggaacggggaagggcggcggcgacggcgaggcgacgctcggcgtggcacacggcgcggcgcggtggcactgagggcggcggcgcagcggcacgaaggcggcggcgcagtggcacgagagcgacggcgcggtggagagggaagaggagagaaggagggaaatggagtggggagaatggagaggggtggggtttttataggggagagggggaaagagagagaggaaagaggtggccggcttaatggcgacgcgacggcggcgcacggggctcgggacgatggcgacgcgcggcgacgcgacagcgcggggcgcgaggcggcgaggggatgggcgcacggcgacgggacgggcgacgcgacggcaacgggcgacgcgacggcgacggcggagcggggctcgaggcgacggcgacgcgcggcaacggcggagcggggctcgaggcgacgaggggacgggcgcgcggcgacggcgacagtgacaacgacggcgacaggacgacggtgcggcgcggcagcagcgagcgtgcggcaggcagcggggcgcgaggcggcaggcacgcgacgcggcgacgggatggcggcgctgcgacaggtgacgcgacggcgatggtggcgcggggctcggggtggcaggcgcgcgcggcagaggagggggcagggctagggaacctcatcgaacacctatgcctgaatgaatagtgtcttttcctatttatccctattttagcctatttcctatataaattttattctataaatcctgcataaatgaagtttactcaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatctttattttaaattatattctaattgtttattttgccaatttaattttagggtttattcctaattaattatttcttattcacgatctaagaactccgaaatcaaaatccaatgaaataggcgaataaaatcggcatgatgcaatttatttaaaaagtttttgaaggcccaaaattttagggtttgatttcgttggtcgaattttcagggtgttactagttctcggggatcgtcagcgccgtcgaagtttctcccaagtgattcccttcccacaatgttggccggcaggtaccagcaatatcaccctccacacattcctcttcctcatcccatatctttatcccccgccgcatgagtttgcctcctcacccccattgccgggctaaccttttttgttgttgatctagagccatgtccaatggagatgactgggaaaatgccggctagggtcaagcggattaggtttgccgattcgcaaaacgagtgcgaggtcgtcctgccccaaacacttgctagcggcggagcgtcttcgtcgagggaggtcggtgaagcagcacagagcaagccaaaaaggagacggcgtgctatgtcggccggcgagggcccatgaggcgacgaggtgagcaccacattacttttctttcccttataggttttttcctcatccctttttccaccaatactatcaggaactagattgtaatgtttgtttttggcattatagtgcaaccattggtcatgctcacatatcatgggttgcctacggggtcacttgtaaaaagtttactgggttggtgcggtttatcagacaattaaatgcatatgtcaaagcatactatagttgtccaaatcgttttagttaaaaaattgctgctatgtgtatagcctgacgcgttcagcgctctggtttgtcatttatgagctatattttgaccttgtacacctgcttggtgggtggagcccataatttattgagttaaaagtttattgtttttttggagtgggtatagtcagactggtgatcaaggtatagtttgattcgcacacacaccagttgcccaaatattatgtcagtaaaaacaattgctgctctgatatatcatgatcacctcatgtaactctgtatccttaagagctaccatttggtactgacaaccctcccacggttttgctgctcgtcatatctattcacttgttgtttactttcctctttttatgtttgcagccacctgagacaaagggtcataacctcacatgctgtagcgccgctctagcggcgcaggcttgtagagcgctattagccgtacaccatgagaaattggaggagattggacttgaagcggtagcgtgcatgtctcttgaaagccttgagcagccagacctaatacgatggctcatggacaggactaatcccgtgtcgcgcccggaaaaataccttctccagaacgctagtgtattaatccccgtcctaggaaaagccagggtacaccaaacaaacatgataaaaaaggcacatctttattatatcgataatatttacattattacaaaggcatttcaggcctgacaaacaaaaataaatagcagcggactagtgggcctacggctctatcttcataggcgctcaactggggtataagcgaggactccacccaggacttcttcttcagagcttctcttattgaaggggggggggaagatagagcaagaatgagtacaaccacagtactcagcaagtcacacaaggagatgcatgattaatgcaagggagtacaaggggtaataatataggggttaagttttgcagtaaacagcatttaaaagtcacttagttgcccaaagctattttataaagacgattctagagctacacaatgttattattcaaggccgtgaactcacacgaacctgtcttaacccaagacctacgatgattcagaccgaactggcaaccagacccaggtcccagctcgtcccaagccaacccaggccaaccattctacattttagttgttaagcaggttttaagaattaaaacactaacttgggtacattgctaggcttgcccataaccgagggcgcagctattcgaatagattatactctgatcagaggtgtacatctttacccacaagacacgtcttcctcacgtgtaaccacgtgccacataccaccacggcatacggacggaagacgtgacatagttcccaacccatcatagccataaacaagagtaccgacccaacctcgcctacggccggaacccccgagataggtaggcaggattgagcccctagcagcaaaacaccgaccctgtgccatgacatctagactaccgagccgcaactcgtgtagccttcatttgtcctagagatgtccatcgagtcccgacttcgtccatctccatccgtgtacctttgtttatgaccagactgagccacaaactacgccttacccactagacatgtggaagtacggtagtgctttgcaacagaggcccgagcttaatccttatagtagcctaggtacgactaacaaaacccaaccccgcacctcgagcctagcctaaaaccattttgggggttttgaatagagggggaggtgtgtgtccaattccaacataagctagccattccatattgtccaaatgatatgagaattcccaaagtctaaagttataaaaccacctaatgttgcctaattaatcagcaaagcatctacctagattcatactagtggaaccataaatagagtacccactagttggggttttgtctatcctagggtgaacaaggtaataataacaatagcaataataataaggtcataacaaaggtaaataggcatggctaaataaaaccgtgataacgcgggaatttaagtaaagcgataatgcattaatttaaatcaaaataattttataaactgggattcaatatgctcgaggatgatgtgacttgccttgctcagagacaatggccttccgaaccttcggcgatgaccgcgaaccacgcttcaagaacctccggaacgacagaagctacgcaaagcacacaagcaaagctacaaacctataaagaagcaataacaatacataaaaaggaagcacagggttctttaggttataacaaacattaagagacttgaacgggtcgatttggggttcgtatgaccaagatatgatcatctgaagtttaatgctattatatggagatttgcagattattataattaggctttgcaactataaaacatgcgtaggcgctagcctagaaaagacaggaaggctacgccgttaacatgcagaccccacatgtcaacctaaaggaccacggtagaccgagtacacagagactgtccacgagtcaatggaaacggaccccgtgtgtcaaccgaagcgagtggccgacaaacggactccactagacacgtggaaaccacgcggctaccgagcgggcacactaacacggtcaccacacgcacaagcgaacgactaccgacaccagtacacgggtaccggggtcgacaaccgcacaacgggtacggggcgacaccgaaaggacgaggatggtgcagcgaaggagagatccttaccaccacgcaacgaggtgtgagaacgacgacgacgaacgggcgcggcagagacggacgggaacgacggagacgaacggcgaggggacgacttcggcggcgatccttggacgaaggcgagacgcggccggtgcaacgcttgacgacgcggagctgaggacgaagacgaagaaggagctgcagcggctcactttacggacgcggacgatggacgagaacgacttgacggagggacgaacgccacgacgatgaggacgatgaccgggaccggcgagaaggcgacgagggcagccggcagcagctgcacggagacgaggacggcttggaacatgccgctgtgatgacgatgacggtggcggcgcagcgagacgacgagccgggcgaccgacgggaggtcgatgacgaggacgaacggtgacgatgacgacggacagcagagcggttcggatggaggggaggtgaggccgagggcaaccttgacgcgtccgttcccgatgattgggggcacaaatcaaggggggaatatgggggaaagagagaggaatcaatgggtattaattcccactaattaattttggaatccaatgatttaatcacacggatttgagggaggaaaggagctatgttttcgggagagagaagg

SEQ ID NO: 63826 - DNA, 8104 bp, Oryza sativa
  unsure (1)..(8104): unsure at all n locations
tagattaaaaccaaaatataaaattaaaatcaactcaaacgcggatgacgaaccaaaatagattaaaaccaaaacataaaattaaaacctacttaaatacgaatgacgaaccgtggaaacatcttcgatttttataaccgactcaaagacagatgacggaccgcgaaaacatctttattttttttaagtagtaaagaagagatagagattccttttcccctctatttggaatattgtatcagcgacacataacacatatatgcatgcaagcatcacaaaatcgaagctgaataccgaactagggaaacagattagttgctactccctccgtttcacaatgtaagtcattctagtatttttcacatttatattgatgttatctatctagatttattaacatcaatatgaatatggaaaatactagaatgatttatactgtgaaacagataaggaagtagtaatatatgtctagcaacatacgcgctgcgcgactgcaaaggtatcggccatgagctgcacactcgtcggcttcaccgccttcgccactggcccattgccgtcaccaaccgcaaccgtggcgccggcgaggccgtctccggccgcgggtacagggagcaccgtctcggggactaatcgacgtggctgcagcgccacgtggggagcagcaagaactgggacaagattaggagctgcctcgccgacgccgtcatgtgcaggagcctgcaggacggcaacttgacgtgcgcgtagacgcgtagtttgtcgccgactttcaaataatttcggccaaaattttttgaaatttcggtcaccccggcataaaatccaatttcgaaattgaaaaccctggtcgccgacgacctgtccccgatccagtccggctgctgcaaggcgtccacgatcgagttgcaacttcacatactttcgagttgcaagtacgtaccagctacaactttcacgtacgacgacgtacgctgagtgctgatgaacaaagcagccaacaaataaatttagaccaacaaattcatagtacatcctaaattttttgtgaaatactccctccgtcttacaatataagggattttcaatttttgcttgcaacgtttgatcactcgtcttatttaattttttttgcaaatataaaaaacaaaaagttgtgcttaaagtactgtggataataaagtaagtcacaaataaaataattaataatttcaaaattttttgaataagacgagtgggcaaacgttgcaagtaaaaactcaaaatcccttatattatgggacggagggagtatttggtatagcggtgcccacccggcacaccctttgggtccacccctgactgtgactgcatgcttacgtccatggcgctgacaatccagtcccgcatgtgatttacgagaccgcatatgctatggagcaggctactagtatactcctcttgctcagatacgcctgcagtggaagcagccggaggcaggcacggtggacgacgaggagaggggcggctgccgccgctggtaggcccaaggggcgggagtggaggaggccgcgccatccttatctccgccggcgagaaaggagggaggagaggagagagagatgaagacaggagatgggagagaggaggaagaagaggaggggattgaggatggcatgtggggtccacgtgggctccactatttaatattactatgtgtaaaactgacatgtgggtcccatgggttctattattttttcggatcgaattgctatgtaagcgccacgttaatgccacgttagatgaagactaagtcaaattagccacgtaggcgtcacgtcagctaaaaccgccatccaaaccatcatgagcctatattacatcggtcttgacagttgatggacatattatatctggttttttgttgaaggatgaaaatcggattcgttgacaagttaagaacctcagatgcacttattccccatgagaaaccatccaaaatcttatgaacaaggagctgtacatgtgttgtatactaactaaaggggaaaaaaaaggtaattaagctagactcgaggtgagcgacatactgtacttggctatcaaggataggactgatagcgacatacacgtgttgtttctggttcggtttcccactctcatacgctttcaagtacaattattgtagccatataatgcgtgtatcatagtagtatgtcacgagctaatagttactatacgcaaaacaaatgcttagctgtcgagaatatgtcacaggttccattcaccgattaatttctctgtcggcttgattgtgatgccctcattgaattgacttgccactaattactgctccgtctgatcttaaatagtactctcttcgttcctaaatacagggcgtaacttcttttcaactgggttccataatacaaggcggcagcttctcggtgcatgcaggaattgatgagtaatcctcggctcctgtactggtgcatgcagaattaactgatgactcggtttggcttttaaatgcatctgcatgcatgctggctattcgcgcggaaagtgcaggtcgagcgcacgctgcatgcatggtggttaatgctagcgtatctactgcgcaacaaccgaaacgtcgctcttcgaacggagagaattaatcagcataactgctatttaaacggttttattggtctttgcaactacaacagtcacgccctatattatattaagaaacggagggagtagtacatgatcaactcagtcaaaatattagttttatattaagacaagtttataagatctaataaacgtgtatcagtgcaaatttgtgtatacttatatttttttataaattaagcatttgagaaattattgaccgagtattaccgtaaacataagatccaagaaatactttagttgcagaagctagctttacaaattttaacagtttgaccttttgtaaaaactaattttataaataaatcacgacaaaaacttatttcataaatgatccttttgttcagcgtcaaatcgtatagcactgaacttagaaacctcagcgccacgtcaactggtgttaaatgccatgctactgcggatgggagactgagttggcgtgccgacgtgcattcagcgccgtgctatttggcgctgaggtgtctaagttcagcaccatacgatttagcgctgaacaaaagggtcatttttaaaataagttttggccacgattcatttataaaattagtttctgtaaagggtcaaattgtcaaaatttgtgagctagcttggcttcactatcatcgagaaacgataagtctaatgtgtactccctctagtcgtagatatatttgacacttctaatcaaacttttgaaattctgattataaaaaggtttcttaaatgacaaaaactggtctcaatatgtagagatttgtctaaaaaaatattatactaataacatagatattaaagcttattgaattttatgaacttaaattaatataaattgattgctagaatttgaaaagtttaaacaaattttatcctagatgtcaaatatattttcaccgaaaggatagcaaattttacagtggtcttcataaaatcgtcaatttgaggaaatctataacttgtggaggagcgcgggaaagctattttgccatttgaccttgtgatatatatttttaaataaatccaagatagtctatatatggtactcctatatcacgctacataaatatacaaactaaatttgacttgtataaataaaaaaacaacaaattgaactttgcatgatagtactagattttcaccatagtactagctagatttaacacaaatgttcgtatttagaactaattattatttcaatagtaggcaatatactcgtcaacagcgagatgtctgtaatgaatttattaatttcaatatatactagctcaattttttcaagatactcatagcagaaggatgtatgtgtgggttcataggaatgagtgcacacgtgtcattagcacttatgtttgtaccgcatttctaaataaaaaaacattgcacagtatgtaatatctacccgacgggttggaatttatttcaaataagtccttcttcaaaataattttataaataactcatcggtactaatgacattggcaccatcaccttcgtataagtgaattagctttttcggagacgctgagccaatggcgttggcgcagcgaaaggatccaatcacggaataaacttgtttagggccttgcttgctaaataagttttcacaagggacccaaagtgaaaaatccagtcgtagaagtcgcttcccgtggcaatatatatagtctgatggatgagacgcgaaagaagactgaagacaacgatatcacttcgtcaccttgcctatttccgcaagaacgatcgcacgatgccgtcgtcgccatcgcacccgcacgtcgccgtggtggctttccccttcagctcccacgcccccaagctcctcgccgtcgcgcgcgccctcgccacggcggcgccctccgccaccttctccttcctctccaccgccgactccctcgcgcgcctccccgccaccgccgtcgtccccgccgggaacaacaacctgcggttcgtggaggtgcccacggatggtgatcaggaggagacgtggccggtgtggcgccggatggagatgttcgtcgaggctgcggagggtggcgggctcaggcgggcgatggaggcggccggcgacgcggctggcggggtggcggtgagctgcgtggtcggggacgcgttcatgtccatggccgccgaggttggggtgccctgggtcgccgtctggacgggtggcccgtgcgcgctcctggcgcacatcgtcggcgacgcgatccgggaggacatcggtgacgacgacgacctccacggtgctcgcggcgacgagctgctcacctcctaccctggcctcgggagntaccgcgtccgcgacctccccttcggcggcggcggcgtcggcggcgacatgcaccgcgtcatgaccatgctcctcggccgcgtggcgcggcggntgccacgcgccgccaccgccgtcgcgatcaacgcgttcccgggcctcttcccgccggacgtctccgccgccctcgccgacgcgctccccaactgcctccccatcggcccctaccacctcctccccggcgccgccgccacgcaagccaacgacgacgaccccccggctgcctcgcgtggctcgcgcgccgccccgcgggctccgtcgcgtacgtcagcttcggcacggtcgccgcgccgccgccggacgagctccgcgagctggccgcggggctcgaggccagcggcgcgccattcctctggtcactccgggaggactcgtggccgctgctcccgccggagttcctcgaccgcgccaccaaggccggcgactccgccgccgggctcgtggtggcgtggacgccgcaggccgccgtgctgcgccacccggcggtgggcgcgttcgtgacgcactccggctggggagccgtcctggaggcgatgtccggcggcgtgcccatggcgtgccggccattcttcggtgaccagcacatgaacgcacgcgccgtggcgcgcctgtggtgcttcggcatggcgttcgacgacgacaacgacggcggcggcaagccgtcgatgatgacgcgcggccgcgtggcagaggcggtggcgtcgctgctcgccggagaggaggaaggggcccggatgatgagggctagagcacgggagcttcaggccatggtggtctcggcgttcgagcccgacggtggatcgacgaaaaacttgcacaaatttgtcgaaattgtttgtgcccgtcgggtgtgatcgatacatgcatggcatcgatttttagaacttcagaagaaattaaaaattttagaacgataagctacaataatgttatatatcaccttaacctatataacaatatcatcttcttcctccatttcagattataaaatgttttgattttgatcaaagtcaaactactttaagtttgactaattctatagaaaaaagttgtaatatttttaacctaaaaaaatatatttgaaaatttatttaattatagatttaacgaaactatgttggtgttataaatattactactttattctacgtagtaagttattctacgtagttagtcaaagttaaagtagtatgactttgaccaaagtcgaaacgtcttataaccttaaaaaattaaaatattttactatatttatgaaaaatatttttaagacttgacatgtaggagatgtaagatttgagcgcacgcgcgctcactcaagttttataaacagacttttcattacaccacgacacaaaatccctaatagaagatcagtcggcaaagtacacattcaaagcacaatgtcggttgggaaaaaaatttcatgatagacttcaatattatatttctagatatggatacagtctccaatatttctcgtgttgattatattatatttataaacctataaatgaatttatacgtgtaatttgaggaatttactagccatttgcgtttctagagaaaaagaaaaggtagaggttgccatacgaggtatatatagaggaaagagtgtttgtcgtcggacggaaattaaaactactaggaggaaatgatcaattatattattttaattaattactgaatcattttttagtacatttaaacgactaataaccatgtgtcacttttgcaaatcgtcatgggaaatattatctatgcaacctacattttataatcggagaggctatcatttaattttaatttgttgaacaataggggtggataacataccaacggctcgtttgagcttatctatactttctataaaattataacccactaagtctaaagcttaacatgcaaccatgccacatcatcatccactagcaataattaggctgtgtttaattccacgccaaaattagaagtttgactaaaattgaaagtttaaagaaaaaagttagaagtttatgtgtgtaggaaagtttcgatgtgatggaaaaattggaagtttgaagaaaaagttgggactaaacaaggccttactttttttttacgaattacacagcacaacgcggacacactcacccctatgaacgcacgcaagcaaactttacccatatgacaaagtcatcataggcgcctcgttgtcgacgggtatgtcgccttctaccgaaagcacaatgccgttaaatccttgaaaattcgtttccagggggagtcgaacctaggacctaaggtgctactgaggctctagtaaccactaggctataggtcctttcgcaataactatttatttaacttcatgcaagcatgcaatatatatcatctacaatctatttaattgtataaatcaagatgcaagtatatccaattatcacccctcacatcatttacataatatttgcacagatctatctatcatttttataatatttaacattatccctaaaaatttatttcacattaaaacaggggtgtcatttatttgtttcatgataaatattgataagttttaacgtttcattatctttttttactcatagcttgattgtcgaaaaaatatattaaaaatcgtttagttattctagcagcaaagcctagctcattaattcatttatcttaatgagaagcctagctgcttggctcacgttagctcattaattcatttataccacctttataattttaaatttgctatgttataaaaatagtacatgatgaactcactcattaatacttttatactacctttatatactcctatatatacgtaataataaacactaactaaataaatagaaatagtttgataaaaataaagaactaaacactagttaagaagcactactgagtacataaaaataatgataataaatactgatatgttgtactaacactcagctcacgagcttggctcgttaagcttacgagctaaaagcctaatttagtttaactcagtaacgagttcgaactgatacaaaccataagcatcgaactgttcttttccaccacatttctaaaatgtcccttgacaactgagaaagctaccaatcaacagagctaaaggtcaaggaa

SEQ ID NO: 63827 - DNA, 6430 bp, Oryza sativa
aataatttatctagctataggtagtagtaagcttggatttagcgtagaaggtttcggccaggttcttgatgactaaaactgcgaacaaaagttcaggaccagcttctccaatagctccaacggcgccggcgtagacggcgagcccaccgacggcgaagccaccgacggcggcggccgccgcgatgacacggtcgatccgacggctagtctcgtcccacacgaagtatcccgttccgatcacccgcgtcctgaactccctcgccgacgagcgcgacgcctcggcccaggccatggagaggagcgtgcacgacgcgacgacgaacacgctatggatcagcagctcgtggatcaggccgggatccaccagcagcttcgacggcggcgtgacgtagtagacgaggccgcccaccgggtaggcggcgccgccgccggcgtccttccacctgccgagcaggttgacgacgaaaccgccgccgccgccgccgctgctgtggaggtggagctggtgcgagactcgacgcagaacgccgagacggcggaggcgtgcagcatgatgggcatcgcggaggtgtagagcagcttgattgggacgaactcgtcggtgccgcggcgcggtctggagcggtacagccgccggaggtgggtctcgtcgaggcgcacggcgaggacgaacataacgcaggtggtcatgtagttggagaggttgggaggtccaggcggagcagcgtgaagaggagcgccccggccttgtgccgccacgacggcggcgcggcggccacgcggtgggtgacggcgaacacgggcccctcgaactccgggccggcgccggcgaggcggagcttcacggggctgaacaggtgcgacaccgcgcgctcgcaggcgttggtggcgatgagcaaggaggcggcggagacgccctccacgccgtagcccgtctcgtggaggaggtcggccagcacgacgaccacgccgccggcgaagagctggagcacgacgagcgccgcgttgcccgctccgccgctcccgcacatcccaagcgccgccgcgatcccgatcaccaaccgcgacgcgttcctacgagagaccgtgacgtgtgtaaagccggagagaacgtgacgtgacgtaagcgaggcatcgagctagtaactcacaggaggccacggtggttgaggagtcggagtcgaagaggagggcggcgaggaggcgcaccaccacccacgacgtgacgacgggggcgacgccgagctccatcactgtgccgcggggcgcggcgaggaggggccgcgcccagaacagcgggtcggggtcggcgtcgccggcgccggcgtagagcgggacgtggctcagcgagagcaggagcagcagcgacgccgccgccgtgttccgcacctggccgcggaacggcaccgccgcttccctcctcctctgcatccgcggccccagcacgcaagcggccggagcagccgccacagcgccgtgccgcgagcccgtgacttctcctccgccgtgcgagccatatccgccgccgcgatggctcgccggcgatctcttctgcctcgtcgttgattcggactgttcgatcgataggccgagttgatataacatgacatccgcgcatgtgcgtaggccgagttgggctgcaattgggcccaaggaggggaataagttcaatttttgaccctcaaaagtggtcgaaatctaatccgtgaccccaaactacaaaactggatatctcgaccccctaactctcgaaatcggtacaatttgactccctgggtggttttagagcgcggtttcgctgacgtggcacctacgtaacggtgttggctcggtcttctttccacgtggcgcttacgtgacattagaaataaaaaatatttgggacccatttgtcatacacacaggaaaaatgtgggagtcactgttatgtggagcccacataatcctctcctccccgtcttcctcctcccttctctcctctccacggacgatggagtctgcgccgactcgccgccggccaccgccttggccgccgtcacagacggcatcaccaacgcccctcccccgcgggttgtcgtcggcctcccccacccctccccgcggagccgttgctagcgcacccggcggcgggcgggagggcgggcgctggagctgctgcgacgacgaccccttgtctcttgctctccttccttcttcaagcggtgtggcgacgaggagcagccgcggagcatgattcctgcggcggagatggcgatgacgcggtggaggccggtcggcctcgaggtagcgcgccgtggcggcgcacggggtgaggcaggcgtggaggacacggtggaccgggtggaggaagaggtggaacgcgtgcgggggcgcaggaggaagcgaccagcatcaattatcacgacgagctgctttgggtgtccgtccacgccgacatcggctactgcttttctgactcgcgccgcctcagcctgccataactccaatccaacatccaggtacagctcttactatacaattaaattaaatctgccattagttagtaactaagcttgataatatttgataatcagcgagatgtacagaggatcttggccatctccgagatatacagcggtgacgcctgcatgacaatcatcggtgagatgaatcaactgatatagaatttctccggtatctgcgccacagctcagagaaaggcacccgcccgccgccgccggaatcatgctccgcggctgctcctcgtcgccacaccgctcctactcgtcgtttctgtttcgccggaacatctccgccgctgacccccgtcccacggccgcagctcgccaacggaagagagaggggggagaggatgatttatgtgggccccacatatcagtgggttccacccatacttttggtgaatgacaaatgagttccacgtatatttttttatttctaatgccacctaagcgccacgtcaacgccacatgaaaagaagtccgagtcaataccaccacgtaggctatcagcgaaaccgccctccaaaaccactaagcgagttaaattgcaccggtttcgagagttagggggtcgagatatccggttttgtgatttacggttacggattagatttcgatcacttttgagggtcacgaagtgaacttattccccaaggaggacgcgaccgttggatcctattcgcagcccagctcggcgaagcaaatggattatttatttatttatttatttttattattactacaataaaaatgcccgtgcgttgcaatggatgaatgctattttaattttattattgttgtacggtttagctagaatgaaattcactttggcaattcgcctagatatttgatgaactaagtctgattttcattttaagttagcagtatttttaaagagatttttatatttccaaaagtaaacgaatttaaaatccgactcaaacacggatctgtattttaaaaagcgaacgaaattaaaaaccgactcaaatacggatgacgtacgaaaataccagcaaaaacatattcaatttttataatagtagagatagagattggattgtaatgagaaacgtaaagctattcttttgttatctgaaaagtatgtctcatattttcattgctcgttggcttattaattgcagcccaattttaaaatatgaaacttaattttagagttgtttttctcattgtaatttgtttttcaacgttggctttaaattattaagaacacgacataaaattgtactcataaattattttcgattgattatctattaattgccgcctccgcctccacgccctcggcgaagcgctccaccaccttctcctcctcctcgctgctgctcatgtcttcttcttggcattcttcctcctccagctgctgatctgtgtccatggcagagatcgccggagaagagatcgctcgacttgaggcccgcggcgtcggcgtcagcgccggctgcgaggcaggaggtggtggatcgacagacatccgcgcacgtgcgtgggccggtgataggctgagttgggctgcaactgggcccaaacaagacacgattctattcgtggccgagatcagtgagcaggacgtagcactgagaaaagtctatttgggctccctcaactatgtaccacaatcagcaaaggataatggtttaagctgagagcataatgagccggttttgataggtagaaacgcttttgttttagtttaacggtggaggaatacgaatcacattcagcaaatacttccttcagctacatatgcatcaacaatggttcagcacggcataaaccaaccaaggtaactcaatgccgattgctcaaagcatacacacatcacacaattcatagcattagcatagatagatagagatacataggtcctgaaacttgttcatccacacagcagcagaaaaaaaaaaaccagggttctaaaattttaagcttcaaacatggagagaccatacacacaggtgctagcactagctaggataaagcaagcaccatgcatgtatggacgcatatgtttaatacaatacggtggtggtattcaggtctttgttcagtttgccacaatggcacaaaagcaaaagcactagctggaagctggaaaccatggatggtggatcacatgaaggtccagttgacgagcatgaaggcgaggcagtgcggcgcgtcgtcgtcgctaagaaccttccacgccaccgcctgctcatacgatgcctgccgccccatgctcgacttgcagacgcctccagggagataggtgaaaccctgaaagaagatagacagaccccaaacaggcttgatcaggaacattgctcatggtctggtagtactctgatggatgcgtcaccgattgtcgcgaggcagggacacggtggttttacctgctgcatgatcttggggaactccgagcacagcgccttccggccctcgtcatccaggatcatctcgagcgagatgtcctggaggttgaccagcgtcgtctcaaggatgtcgaggccggcattgttggcgaaggtgaacataggagcaggctgccagtagataaccaaactgaccattagcaaggtttccagaacatgcatgtgatgaaatgagcataaaattagtgggcagcactactaaccttcagagaacagcacagtattgcgtcgctgtgcttccacaggagcgccaggggagaatcggcatcttcggtatcagaccaacggatatctgctccggtgtgagccctgaaagatccacggaaataactagtgcattaacatcattgatcacaacttcagatgtggcaatgtgtaggtggttctgatgatgaagaacctgagatagacttttgctaaaaataagtattttacttacctatagctcctaccaatccagctagcaagtgtaagcgcctcaggagaggctggagggtgcttcattccgatctggggtccaagtcgagaaggagctattgccacagccaccctctgcacggatgccatcacagctctgacataactcctagccattgccgccacgctctcacgaaggtggttctcgtatgagaattggaaagcaatggtcaggactgatctgttacatgtgccagatgcttcaactgaagcacgcgaagctccacctggtccaacctcaagggcggatgcaaggtcgagcgtgcgtgttgcagatggcccatcctgcaggtttgagtgcataacggttaattggtgagccaacatgggaaagacaaggcctctggaataagattatggaccagtcataccatttttgtatctagtggtatcacacggaatcctgagggtaaaagtggtgcatcatcagcaaaagattcgtcaataggagcaaagacaagctgtgcagatgcactagtagcattctcatcaaccccgctgcaaagctgcatagaaagcaatctctcagaaccaggaaaatgcaacaaacaggtacaacttaaggcaattgtcatgagcaaggattatgtggagaagaatcgggatgaatggggatagattggattatagtagatgaaataacaaggaatacggtcctgaacctaaacggcgcgacgctctccgtcgcactgagaaggcaggccgatgggcactaagataaatcttgatctaatgcctaattgacctgagataggatccctccttatatagatggaggactccttaatctaatcctaacaaaccttatctaatcctaacaaaccctaatcctatccaatggacttaggacgcccggcccaaagcccatgacattactcccccctttttgagcagctcgtcctcgagctgcagcacaccctgctagactaacgaagcaccataacctaaactaagactcttaaaccttttacatctcagcttttattatgaacaaaaataaaaaagggctgcaggaat

SEQ ID NO: 63828 - DNA, 1679 bp, Oryza sativa
cagcttcctctctagctcatcctgaaggcttttaatgcagtctccgatcataatgctggtgacctctaattgcatctcgtgttcccactggagatcacgaattgaagcactgaacaagctcagcatctccttgatttgccggaacaccacaaccagaagtagcttgaagccattgaagccctcatatatctcaacaagcttcccatggtgacacaccatagggcatgaaccatttgcatcaccatcatggaccaagctatgacttttcaggaaccttatatcctccttgagcttattaaggtgctgttcaacttccagtttcatcaaatctaagtactccgtgtaattaatctctacatttgcatccaacaagtgctggcgcagccgtgacattacagttgcaaacgcctcaaagttgctcccgatatcacagctgcgatggtaggacaacaaccatggtggcggcacttccaaatcgttgaacttttcagcctcgctgttaaactcactaatggaagaggaagacgttctgtcaatcaatggcccgctgaataaggacagatcattgtgagcagtacatcgtgattggcaagtagaggctggtataatcattctaccagtaaatgggtccattctttcatccaaaacctgcaacattttcaaacttaagatttggtataaaatagatttaaaattcgatgaaacatgcttagcacaatagcatctgttacgaaaacaatcaatgcggtttcatcagaaatgggtgtgataatcatggtcacacaggcatttgtcgtgattgaacacaaaaaaacagggttcctagaactatcagatactgcttgcctggctatactgattggcaaaatagcagttcagagaagctgagctccaccgccagagcagtatgcgaagcaacaggcgacgctaacaatactaacagagaacacaagccctacataaaaataaaaacactagatacttcactgcccactccattctattcattgcagaatgcagataccaagcaaacccgcagtaaaaaaatgcaggaagtaaccgcaggtcacagtgcggtgaagcagagtaattaacggcagtttcgttcacaggttcactctgctcatcctccaaactcccccacaaaccaaccagcagattcccgcagctcgatcccaaaaaaaacccttccgcaatcgcagcggagcgaagcatccccagtaccacaacctaggcgcaacgcaaccccccgaatcgcaccgcaccctcggatgaacgaaccgaacgcacaaataaaataaaataaaattcacagtgagcggaaaacacagtagcagcttacgggttggatccccgccatggacgggagccgcctgagctccccccctcgtcgccgtgggctcgccgctcgcctccctctgcgctgcagcctgcaaccgcaagcgtcgggcctcgggcgggcgaggagggagggaggatgcggcggcagcggtagggtttggggataaggggcagcagcggcagtggagtggaggagatcgcgcgtggtggtgaatcgtgggagagagagagagaggcggtaaattttttggttgggagcagtggacgatcgagcagcgatcgcgaggaggaagacgacgaggaggatgacgcagcactcgcggccagccaagcgaagc

SEQ ID NO: 63829 - DNA, 550 bp, Oryza sativa
gcagcccttatccaagacgatgcaaatggcaagaatttgggcgaggagctcaccggcgagagaggagcaacgttggcgatgcggagggagtcgtggcgaggtggtcgcgacggcggggcgggggcgagcaactggcggccggcaacaaaggcgcgggtgtttcgagcgaggcggagacgaaacgagaggggagggcgcgggctttataggcgaggaggagaggtcggtttggaggagggaaaccgacattggcggtcaagggagctcggctggtgttcacgggcggcagcggcggtttcgtgggcagtgagaaagcggcgacggcgtggatgcgttgggcggcgaaggtgatggatcgagcggcggaaatcgaaccgcgggagcgtgggctggcgtggtcaaggagagcgagttggcgcggtcggtcaagcggcgcggaggcagtgacaccggcagtggtcgggaaagggaaaaagaaggggaaaaaggggcttggtcccttgccataatgaggagagggagagtgaggaggaggaggagagggagagca

SEQ ID NO: 63830 - DNA, 2583 bp, Oryza sativa
caaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccatctttttggaagaaattttgaagcttgctcgggcagctggaggaggaagaagacatatatataggggtgggactttagtcccggttggtagcaccaactggggctaaagatcaccgggatctttagtcccggttggttacgatctttagtcccggttggtgttatcaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggaagcggcttggtagtagcaacactacctccttttggaagccaatttcctctcaaaaaatctgtgtcccttccatctcgcagaatatgagtcactgatatccaggggtgaagctacagcaaagcgtcggggtcagtagaccccgacgattttccacaaccatcgtataccccgtttatcttaccagccataaccccggtatagaataccattagaccccgatagattgattagttaaaggcaattgtgattaacaacaaagaatgacacaacaaaacagaaaatagctaagctagctcgtatgcattatatgccagcccagcccacataatgagacaacgtttggatgtgagcccacaaggctggcagccgtctccacaaattcccctgcgttgatgtcatattccagtattcctccattgtgatgaatttggaggcgtagacaagattttgtaagtaaccgctaccgaaccaagacttttttttttaacaaaaaatgtgccatagttgattttgtaccatcttatgtatagtcttgtgttcttttctcctgaagatgagacgaagattaagttttttacgcaaaacaaggtggtattaacatatgattgattgagttttaattattacaaacttgaaaaatagattagtatggtattttagagcaactttcatacagaaagttttcacacgaaacacaccgttcagcagtttgaaaagtgtgccacgaaaatcttaatcttcatccaacttttcttggagaaaagagcgggaccttagattattacaagctatagtctattgttagtatcattagttagtagaccccggcgatcatttatcctggctttgcccctgctgttattgccattcactcaattcctcgtgctgcgtgggctttcagcatagtgaaacaagttatcccatatcacctcgacaaggacacctacctccttcaaaccaaggatcacactggttgtagatgttttggaccgcgttgttctattttgcgtcgaggtttgctgcaacctatgtcccatgcacggaaggcgtaagacaaaaggaggaactcacccttgataagatggcatggggtaactccacttcttcacgttggacacctacacaacatgagaaactgagctagcagtgataaatcactaaaaaattagtggcaggtgagaaattgaaaatgaaaaattaaatttatggggagtcttttgtgtggtttgtgcggtctgtcagaagttttgatttttcccacaagtcgagtcctcagtttgccacagataaattagccccgagttttggtttccgattgaacatcagacatttcgatttttgtcttgaactctccgtttcaaacaaaaacatatgacctagaaggtccaatctagtactacctccgtctcaaaataagcgcagccatgagtttccgtgtccaacttcgaccgttcgtcttatttgaaattttttatgattagtatttttatttttattagattataaacatgaataatactttatgcga

SEQ ID NO: 63831 - DNA, 3419 bp, Oryza sativa
atctagcaagataatttagccgatactagcataaaccctataacaaatctcagccgatacaagtaaattacaatgctaaactagattgactaagatatatgataaataggttggcaaatatgtcaaccgaatcagagcaatccaagaggttgaagcgatgcagccttgaacaacgccaatgtagccaatacaattgccatggccggtggaacgtaagacttaccctttccccggagatcgaaagccgatgcaaccccgcgtcaggtgccaagttccgctgtgataagtaaaaacctcggaaaagaaagtggcgatgcgccgagagtagttgtattaatctgtggagatagtttacaatgaccccgggtgtacatatttatagccatgggtagatactagttcttgttggacaagaaaggaactttcctaaaaataaaaggaaaacataaagtccttatcggacactaaacacactatcctaaagataaaacgaaactaatagactattcctaattaatagataaactgtcatgccgcatcctccttgaactcggtcacttctggataaactttctttagcagattaatttccttaaccaaatctactaagaatccaactattggcaacttgataattcccatcggccgatttcaagactctgaagccgatactgactctaggccgatgatgacttcggggcttaccaaatttcactgttaacaatactataagtgtcggttgtatcttataaccggtacctataaactagaattgatgttggttttagtttaaccggcacctatgaaccaatatctatgagagattctgtagtagtgtaaaaagtgttggttgatttttcggatgagcccacaatccgaactaatttgagataagagataaggttgttttgtaatcggttaaaacaacttttaacacctaattcgagataagctcccgggccccaccagtgctatataagagaagtaatcgcaggaggagaggatgctcaattcttgctatctaatctaaaaccctaattcgccaccgatcggcttaagcgctggaaggggttcgttcggctgtctcagggcagtgctggtggagacccgaaggccggcgtgatctagcgagaagaaaagagaaagagaaagaagaagaaaagcaagaggaaccaatggcttcaaatgcgacaggtcagagaagttaattttgtaattaagagtgattgctttataggctaaagttaagatcttgtaatttagaactccaacaaaaagaaactatgcatgtgtagtaagtatattcggaccattttcccaatgtcaccgaacagaaatgccatcactactgtaccagtggtgatagctattcaagattcagtatccagttatttgcatcgaccgtcttgacggtacctggaaacacgaccatttagagttcagagtgcacttaggtttgtggaatttctgagaaatgatagatgactgaagtcatcatgggttcaggtaagctctgctgcaaaatgaacctcacatcccaatttcagacttgttcctgcatgattcgagtgtacaattaaccatcaatttattagagtgttagcttgttggagtgctccatcaaccgatttcatatgagaaaattcatacagatacttacacagtttgtcgagatacttagtgagggaggatgcacgttctgaacccaacatcacttaatgcagaatgcgcatctcttccatcaggagttgttacatccacagccttgcagtgaagagagtggtacaaacaagctttagaaaagggaaattctttcggtcagattgcgtgagcttctgttcacaaaataaattcagaacagagactataatttcatagtaaaatcattctgttaaaataaagggacttctctaccctgtcccagtcttttttttgcgaaagaaaggtgcaagagatcttctacttcgataaataaaatatacaagagcaggctatacaatggattccctaacaaaatttcttattgagtactaactctatttattcgaaaatcctattttatcacaacctagttcattagcctctagttaaaaacgacagaatacagttgttgatagtgtaaatatgtttcttttttttttttaccttctgtttggttgtcatcgctggtgtccttttctttacaatagactgtgttgttgattgcggtgggaatggctgctgttatttgggccatttagaaaactcgaaataaagcatgctttgagaaaaggtatccacaagatcccactgatttggtcaaagaaatctggagcaagtcaaagaagactgcaattgggggctaggctcataaggcaggtagcaaatgaaatctacagctcaagacatggatggagggcttgtgccagaagaattgagggatgatctgctgaatctttctcagtttatgttgtttgctcttcagtccagcgatgtatgttaacctgcagtgcttttgtaataggcatagttcctgttatctcagttcagtcctagacctgatggactgccttctcttttatttccagactctgtatgtgtgatcatttctaaaaaaagaaatgggggtattcttgcccttggtaaaaaagaaaaagttcttgctaacagagcttgtggtttttcagtcaagaccattgtcactgtagtgggtttgtatggaagatgcaggatgtttgattcatttccactcaggatccatttttttcagatatgttggcaaagaccctttcaatcagaagcttttctttcatttgcttaatgaaatccccatcatccaaaaatttagaggctttaaaggcaactttaatatgctccccacatctgagattgaaggagggtgcaaaacaaattgaatcttatctcgtatatagtttataatattgtatcagttgtaacaaacagataaaatggctatcctgtgatcaatttgaccaatactactattcatgcacggcaatataaatagccatgcactattcatgtcctgcttcaaaaacttctctccaaaattgattcttgtctctctctttttttttttttgacagagtacatgtcacatgaactgtacaggttaaagtatgtggctttgtgctacactgctactaactgccagtccttttctgcgtggaatatcacaattctcaccaaactgattcatagcctgcactaaagcacaacagagtgcagttagcaaaatgaataaaagagttgcatttaatcttcagactttcagggtgcatgtgacgtggagtattggactgtatatgtgcaataaccacaaatttcctaaaactattttttttgccatcaattaaccacgacacagtacttttgttgataatgaaactctgtcctctttttttccttttttaatttga

SEQ ID NO: 63832 - DNA, 43437 bp, Oryza sativa
  unsure (1)..(43437): unsure at all n locations
tgtcttaaacaaaaagggaaggtgcttaacatcggtacattgtttcctctatgggttagaattaatatgaggcctcacaggtacggcgtttgctccagtgaccacaagacgagtgacctgtcttcttcttgcataatggccggagtgatggcgcaggttacgcttcggctgtggacaatctctagagaaatgacctggttctttgcagttgtaacaaatcaacgtcttctttgctaagttgtccgtctgggaacgatcgttctgattaggagttggaattggtggttggaaatccttgctaacatcggcatcagcggtgccattattgctatcaccattggagtctttctcagtgtcgaaattgctaaggttgtcattctgggtgccttcattgatactatcgtcgatatcttggtgaatgatgttgacattgcacgcttgatctaagtggtcatgaatggggcaagaaccatggttgttggtggtatcatcagcattagtattgctattgttgttgtctgcattgcgttcatcttcttggggcaggaactctggatacacaacagaagatccggtgatctgaagtggctcagtgcgctgtctttggttaccacctggaaatactgggttgttaaccatccttctcttgcaattcgtcatccgattatgctcactttcgagttgcatggctttgtccacaagtttctcaaaatcttcataatcctctagaagtagttgcactgcgagctcatcttttaacccctggagaaacttctcttgtttgtcttcgcccgtttccacatcttctggtgcatagtgagccaaacgatagaacccgtgcaggtactctgcgacggtcaaatctccttgcttcaggtagcgaaactctcgttttcttagtgtgatcattcccgagggaacatgtgatctcctgaatacagatgaaaactcgttccaggtggtggtatgtccttctggctgtgatgcttcgtagttatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttggtgcttctctcattcccattggcttgggttcttgagtcatcggatccatcattcccatagccttggttaccaggattatccatctgtcacaaggtagaggttgagaggggaagcatacaaggaaagaatagaccagaactagggacaagaccttaaaggaactaactcttttcaatgatgtgttgtttgtttcacttattctgcaagttgattaagcaaacaacctagcatggttacatcacaacccactgatgcaaaccacgcgctacacacacaagcaaggaaacacacgacaaacgaaacactagagggtggcttaggttctgcgacgggttctcgaagatcttcactcctgcttcacatctggcttcactgcttcctccacttcgctagcggatcctgcagtcttccggagcttcggcaaacaactggcgatgtcctcttcttcactgacctgaccatctagtactagttgaaatccgaagaaggaagaagggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttcaggcctgacaagcaaaaataaacagcagcggactagcggcctacggctccatcttcacaggcgctcaactggggtataagccaagactccacctaagacttcttctccaaagcttctcttactgaaggggggagaaagatagagcaagaatgagtacaaccacagtactcagcaagccacaccggaggtgcatgattaatgcaagggaagtacaagggaataataatatagggattaagttttgcagtaaaccgcatttaaaaatcacttagttgcccaaagccattttgtaaagacgatcctagagctacacagtgttattaaacaaggccgtgaaccctcacgaacctgccttaacccaaggcctacgatgatttggaccgaactggcaacccgaccctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccctaactggcatgcacccaaaccccaccgaaaacaggttttaggggttttgaaagagaaagagaggtgtatgtccaattccaccataatccaacaattccatagtgtccaaatgatatgagaattcccaaagtctaaaattataaaaccacctaatgttgcctaattaaacagcgaagcatctacctaaatttatactagtggaaccatgaatagagtacccactagttagggttttatttattctagggtgaacaaggtaataataataacaataacaataataaggtcataacaaaggtaattgggcatggctagataaaacagtgataacgcgggaatttaaataaagcggtaatgcaataatttaaatcaacataattttacaaactgggattcaatatgttcaaggatgatgtgacttgccttgctcagagagaacggctttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcggattattgtaattaggttttgcaactataaaacatgtgtaagcgctagcctggaaaagacaggaaggctgcgccgttgacatgcggaccccacatgtcaacctaaaggaccgcggtagaccgagtgcacagagacggtccacgggtcgacggaagcggatcccgtgtgtcaaccgaggcgagtggccaacaaacggactccactagacaccacacggcctgcacacgtggaaaccacgcggctaccgagcgggcacactaacacggacactacacggtcaccacccgcacacgtgaacgactaccgacaccggtacacgggtaccggggccgacaaccgcacaacgggcacgggcgacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttgggcgaaggcgagctgcggccggcacgaggcttgacgacgcggagccgaggacgaacacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacgacgaggaccacgccgctacgatgccgacgacggaggcggcgccgcgagacgacgagccgggcgagagggaacgggatgatgacgacgaacaccggcggggttcggtcgaaggggaggcgaggccgaggacgacgtcgcgactgcgatgccgaagatggtggtggaggtggccgaccggtacacggcgaggagggacgggcggccgaacaactccggcgaggcggacggagaggttcgcggcgacgttccggcgaaaccgagggcaggccggggtggagggcgatgcggcgtcgccgagggaggagacggcgacgtcggccgacgctctggcgcggcgaccggggcagccggaggagatgtcgacgaggaggaaggtgaggccggcgcgggcgacggcgttccggcgaaattcgggcgaggaggaggtgatgccggggaagaaggcgatgccgcggtgtcgaaggagaagacggcggcgtcgatcggcgcaccggcgatgaacagcagccggctggagggagtacagtggcaccaatgccactggttgccggcgggggcaccgttccggcgagtttccggcgaggagacggtaaggccggtgaaggggacggtgttgcagagccgagggaggcgacggcacggccggacgatgctccggtgaggagggagaggtggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaattttggaattaaccgagtgaatcaagcggatttgagggaggattggcgctagggttcgcacggggagagggaagccgggcggcggctggaggaagaaggcgacggctgactgacgcgtgggccccacgcggggcgcgcggtcagcgcgcgcacgtgcgcgctcgggcggactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctatacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgttgccgtcgactggtgtttccgcttacgcggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatattttgccttttcctctgcctcactacaccaattggtcttccattgagtagtgagtcgggggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgcttggggaaatcaaaattaacaagagaagaaatacgtatttataaactgcttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccaccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttggtcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctggcctattatgctgccgttgttaggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaatacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccaactcgtgttatgccgccgccgactagtgcttttatcttcacaactgcgcgtcttcactaccggtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttggacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgttgtcaactacacaactttatcgctgagcgccttcatattcattgctggctgacctgactgccgccgactggtttcttcgccttcatggctatgcgacttcagtacttttgattggtatcactatcttcactaccaccaatatttttgccacctctggtgggcaatattctctctatattggttatcttgtctctatgccaactgcgtcagctaccatcaatagacaattgtgactacgacataaggacaagctatatgctcaggggcttactagttcaaacacaagtattatgtctccaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggccaaggcctaatatgtctgcagcccatattttcaggtgtggcctgtcatgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttcaaggtccttaagcacatctgttcaaccagtgtgcgcatggggtatgcccaacactttggaaatttctttattcacaacatacaagctttttatagctgttttgctatgtgaattttcaataatgtagccaactttaggttacactcatcatattttacaaagcagtcggtatatcactcggatcatgttattcagggatttacaccgcatatgctacatattaatatcaagtcgcttagttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcacatatgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacaatttctatggtgtctacggttgtttgggaagtacgccggccacgtatagtgattgaaattatggtagtattgtttgctgctggccagtttctatgtgctgaagttctaggaatgcgcctacgcatcaacagtcggctacgccgtcagatatcgctgtggagcctagtggttgcactctttattacttgctttctgtgtttacagagagcacaggagctcatagctggccatgtggatattgtacggtttgctccttgtggttgtgctcctagtgactattagcaggctgcagttcccaattataatcagccgagtacagggtgatttgggtcgcaaatacatattttggcgcccatttatcctactagcagctcggaaagttccaagaaaaaggtatgagcaaaccagtggcaaatccaaaaaagacaaaggaactggtacaattttcaatgatgccagcagtgatggctctgatgatgaattgggcatcggaagtgaaaaggctgccattgaaacttcttcagatgatgcatcctcatcagctgactcaggtgggaacctcattgaaatagtatcactgaacatgctacttaccagtattctctccgattgcatttgcactttgttttgcatatgtttaaccgtggaataaaaaactatgccctctttgtttatctcttatacttcttctggaaaataccctgttctatgcaaaatgcaaaagcgatgaattaaaagaaagttaacgaagacttgattattgagagaactgatcatacaacagctagtgttgcaatttattttcgtacgttcacttggaattcctgtgttgatatttctttggctagtattatgttctatgtatcttcagaatatcatttaatatttgtaatgctggtttagtgctatggtgattacgatatggaatgtcaggagcaatgtactctttgtttagagcagacttttcatgatatatgccttgggattctgattcagtgtgattaattatgaaatattttctaacagtgcatctgatatgctacctagcttgcttatgaaagtgatctaattgatgtgacaggtatttcatctgcagcccatgatagtggcgagcctgatgacgatggcaatgcatcactgtaagttctctaatttacaaagagaatggtctggtgtaggaattacgtttccttcgattttgtttatgtactccctccgtcccaaaaaaagtgaatctaggactagatgtgatatattatagtacaacgaatctggacaaatgtatggattcatagtactaggatgtgtcacatccagtactatgttggttttttatgtgacagagggagtaatgtagatgagcaggtacagatattgtatggtactgaatgttgatgatcgtcaacaaattgaaactttaggatttgctgctccaatgaggtgcacactggtttaggatctttcgctattgtctcagtgacatgtgggcctacattgagtggcaaatcgttctttggtgatgcaaatttcaaaacgtttttcacattatcaatagcgatttccaaaatttattagaatcacctaatatatctgtcatgagaatcacttagaagaacaaggctacccttctggtcttttggtctagttgaagaccgctgacacgttttctttttatttcttaccatttgttcagatcacagaaatctcgcaaaggggggcttggctccatcctcagaggctcttgtagttacaagaaggcaaagcagaaacaagccgtgcaattggatgacaccgaggttcctgatagccagccaatggacattttctgagactgaacttgatacttgaaagaagaaacacggacagctttggttttccattattttcatccacctgatagcatgccctggagtttgagcattgcatattagtatcccaaccagccttgataccatgtagtgggaagaaaaatgcacttggctgattctcatgttaccacatggcttttctgctccttgaactaaacaagcgctgcgatctcagctggaatgtaatcactatctggtggattgtcctcaatcagagattccactgatttttttatgaggcggtgtgcaactcttccaaaaaggataaatgtagcattggagctggcatcaccgccgatgagcactactttatatctacatgggtaatatacatgtgtatattaatgtgtgcagcacaattagaagcatggaaaaatctggaatgaggtgtggtatgaaccttggatctggtattcctatgttagaacagcttgagcatttgtagctagaaccgtatggcttataagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgttcttgtgaggattgagggcaagtatttcttgaatagttttttcctctgcagtgtcctggttgtaacctgttgctgggttatcaacccagctcactggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcggcgcactaagaatctatgcatgcataaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgaacacaatcattaggctattgtcgactggcctgtatgtcctattcgcatacctcacagtaaaggagtcaatatagtaaaccttttgttccttaagcaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtcaaaaatttcaagcatcaagcggcggagccaatagtgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtgaagacaggcttcctaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtattatacactgtaaaattctgtctcctaaaactgtgactaatagccttgttccattgcataacccaattgattgattaagatttcgtagcaacattacgacaacaccttctttaagaacaagtttatgcgttggaaagttagtagcatttattgaattcagaaactctggggggtataacagatcgaaatctggaatttgctcagagctttttgatatggtatcacagcttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaagtcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagtttgtgatagatgcattgattatagcctgacgggatcctttaggaataactgggagtatttgtttgaaatcaccacctaggacaataggctttcctccaaaaggtacaatagaatttgaagggcatgtctctgataaaatatctcgtaacgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcaattggtattttaaaccgagaatgagctgtcctacctctaggcaataggagagatgctacccctgatgaagcgacagcaagaacaatcttgttttgtgatctaagtttcgcaattattgtattccagagaaatgtcttgccagttccaccatgaccagacacaaaaaagaaaccaggttcattagcgatagcacgagaacaaatagtgctaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacatcaccaacagaacagtaaagaaggactgtcacaaaaagttgtctaagctgcgctgaagacgcagtcactatggcctcatcaaaaaggagatgccattcattatctccttcaagaagccctcgtgcctcacatgcctctctatacgtgccataaacaacaccatcgtatgtgcgaacatcagcatagctttgagcacctttgacaatcattaacaacatcctaagatagtaaagctcgcccgcagttggatgcacataatatattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcataggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcactgcaaggaccatgcatcataaactcgctaaccaattcatatcctagccggtcggtgtcatagtcaggtatctcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctataaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatctgcaatttcttgccatttggaatgacatgtgtatgtgacaaaaaggtcaggaggcccatagacacgacatattgccattgcatcttgataattcatgaccatatatcttcttcctccagtgaagctagcaggaagtatgacacgcttgccaactgaatctccatcagtgacacctttatcaatcgcatcaacaattccatctacagactcagagcgcaactctttttgatgatcgatgaagtattgtagcctatttgtttcaatagtagaaaatatatcaacatcgatttgatcgctcaagcgaccatagcatgtgaaaggatttggttcatttagtctgtaatgcatttcatatctataatattccggcatcgtgacatactttttgccaattccatcatagttactgtatttaatgcctaaatggaatccgcgttcaccatatggaaacaacaaaggatattgcaatgccatataagatggatgcaagggagaaatctggcacaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgctgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcacgcagttttggcaattgtatgcgtcctcctttgcaacatagattgtaaattatttttctttttgaaatagcagatgcactcttgaccctctcctggtaccagaacatggcaccacaatacgggcattcatacgtcggagggccatagtatgatctgtctgggtatgatgctgccacaaaagcgctggacaatgtcaaaaatagtctcgtgtaaaaaaacaatgcattacgtgcacgtattcagaacagcggccgaaccctttagcaatcggatatactccttgtctgtccgggaggaactaccgttggctcgtgcagtgtgatttgctgcgaacaaagacagtaaaacagcctatgaacctaaactgcacgaaaaaaaacaagcctaccatcacagacaacaaaaagagcataccatccacattggccaaaggaacggacggatccatctttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaacaatataaaacgaccgaaagctctggagcaaccacatgcagatttagacagcgatgaatgcaggcaatagaaacaaaatactaaaccaatgaaccataaataaaggacagaaagattaatagcgcgggaatacctttagcaaggaatatgctcgtcgacaggcagaatccactaaaacgcaccacgaagcgaacacacaagctgtgaacagaggcaaggaagaagacggaacagagctgcagagaacggagcatgatcagtgaataagaatgtaggaagcaaagcataacacaaggccaatgaaaccagcaacaaccaaaagtacctgctaggtcttagaagcagcccgcacacgtgcaatggaagatgatcaggaacctttaaaggtccattgcagcccatgcagattgcctcccctaaatggaacaaaaggtgcagggtcaatgctaccaagaacagccgcgcagtcataagcaaacaaacaagagagaacaaacataaaacccaaatgacagaacggacaggagaaccacacgcattgatccaggccttaccacgccataacgaaaagttgaacaggagcaaaacgagtgggagtttctcgagcaaggaacagaacaatggagcgaagaaaccgacgagaggaggagaaaccgaagggaagaaagaaagagaaacgcaagtagtaatatatacagacaaagatagaaggggttctccgccgagctgcagcaaggaagcaaacaatcatgtacacctgcacaccaaacacccacaaataggaaccaaacaaatggctagctgagatgacactgccccacctatcagcgatataagtgcagcgcacctagctacaacccaagaaaacctgaccagagagactaacagcataggctgcagaagaagaagactgcatggaccaagacgaatgaaccaagcatccaagcggattggacatggcccaggacgcagaggaacggggcgcatacaccaggaccacagcgatgcctgatatcgacaacccacgcaaacgcaccaatagcggagaagccatcacagagtaatcccactacaggcgcggtctccaacagcatatggtcctagaccgtaacacacaggttcagaataaagcagacccaccggccagagagaaactgtgccatggacacagcgcacacgcgcaccaagcgaccaaagcaatctgacacagcagctaaggcaaacagcatagacctgttccacgttaggtacgaacaggcagaggccatgcggcccacacggcagccacaggcaatctgtggaccatggctacctcaaaaaacaaagaaatgcaccacgcaacgcataacaccggagaaaacaatggcaaggacgcccaccctaccctgcgcgcggtgcaatgcaccgcacacaaaccaaccaaatgaggccaccacacagggaacaacacgtggcggacgcaacgcagagaaccagcggacgagaaaaaggaaaatgtggcatgccaaacgcaccgacgcacgatggtcatccaacggcggagaacgcgcgcaacgaccgcgctccaaatccacccctgggctccggctggatgacgtgccaagcaacggcaagggccacgacagcgtaaatcgccgcccagagcagccatttccggcgggtttgtatatagaagatgctcgtgcatgctcgctgcaattgtgatgccgatgttcatgattgagaaaatatatcgatatgcgataatgtttgtcgacatagaagccttggccattgtgtcattcggcaacttacagattccagcagcaatcgcgcatgtcgagctcgcagggttgcgccttaatccaaagggctacgacggccaaggtggcaccccacatcttgtcccatctctaaaaatcttctatggaatggtgattagccagggaataccttacattgtagccggcatactggaggtcttctcgttcatccctcagagagccctcatccgaaatggtggatttacaggtcagtggggagtagaatctgtcaatctgtactacgcatacgcctacgacaaatacatggaaggaggtttgtttgcatcaaagaggatcagcctcagcaactttgccattgattctctaaattcggacctgtccaagaatcagctgtatgggatacggatgatgcatatatttctgcagagagatctgaccagggcaaggctgctggagaaactcaccagttcaacacagacgatggccaggttaatcagcatgttggactggagtagtagaaaccattgtacagctatcaggttatatgctgccaaggtcactgccaagcttgcaaagaacctccgagttgtaaccgtccctggaacattgcagcttgtatctacgctcctggatgctgatggaaagccgaaaagaggacacccactcctagttgaagatgatgatcaagatcattttgttgatatattagatagacaagataaaaaaacatgatatagctggtgaccaagagccgactgaggacatcgataacctgttggaagcaccaacccgatcaatgcacatcaacgaccaaagatacatacctagaatttggcagaggatactggagtactggtcgattcccaaggagcagccattgacagacgatgatctcctccctgcactaggcatgtcaatcatatatagccttgctgaatgtgatcaaaataactgcgtggaaatcgacaaagtaactgacctgatccccaaaatcattggattcacaagctttagaagtgcaatggtaaattctgaagcacaacagaaggttctcttaaagtcatcactaaaggtgcttcagagactcacaagcattgaaggggaaattggcataacactgcggtacaagatatcaaaacatcccttcttattgagaaaccttgcagagatcttgggagacagcagcagcaacaaccaagaactgaggaggctcatggcaggaatcctcagaaaccttgcaattgacaaagacacaaggcaggagattggacaaatgaaaatgctcattaccaggctgatgaaggcattcctcgattctaacggatcatttagttcaaatgttgattgcttgctgccaaaggtcgctgggcaagcactggtaatgctgtcatcagaaaattcgcataactgcttcgttatgttgaaggaactagatttcgttaataaactaaaaaatatgatcctaatccatgatgataaatacatatatgttgcagcaagtctgttgcgtaatatgtgcttgcacgctcaacatgagctcacagaatcagacctaaaggaactatctcacaccttacgagaggtgagccctgctaatacaaactacgagtgcaacatagatgtgtatagcatgccatatcatttttgcattctctgtctattaatttttgtcatttttggtaaaaagaaggggggatttatttaccaatgaactatataagtataactatagtttgtacagctatatttatcatgctacatgacattgctggttccactacaggtgttggaaagaataatagacgctgaaggggcagaactagaaatcctcattggccttagttcacagatatgcaaactcattcctgaagaatttgcccaagagctagaacacgggcagattaagcggagattcattaagaggctagtggacgcactgaatgcaaacatgaaacaaaatgctcattgccctgggatcaggagggtgatacttgagcaatccatatacatgatggagtgcaattctcgcaatgccaagtgtttcaatgaattccggatgatggattcagtgtcgatggtcgaagagacaccctcaagggctgagaagtacatgtttttcttgggtgacatgggcttcatggaatgcaagacagctctctctgctctcgtggacagagcaaaagaactgatcagtcgccagtggctgcatgacatcaacagtgccaactgaagaaagttgtaagatgattttgcatttcagtcaaacgatcatgtcatcatgtatattgttagtacagggtaaaaaagttattgtgcatatgacctttctagaaagaacatagattttccttcgagatgagaaaggctatttgtatctgtgcctcattagtcattagtcctgcactgtaatctaggagtatttgctactgccaattatcatttgttggagtggacaatgcttaattgattaaagatgcttaaggtgattgcaattcctacacaatgtattagtgtgttctagtcttggcatcgattattttcaaaaaaaatgttgtttattcgactcctgaaaattgggtttcctgccctggtaattagtcccattcaacacaagatagtactctgtagtgttagcattgctttgggatcacctaggttagatctagtcgggtagaacactttggatagacgaacagcaatagatggattaacaaagagggagtgagagggtttagggatgtgaccggtcgatgttgaggaggaagtgcggccagccatcatcgttgtcgtcgcgggcttgatgcgaacggcagcgacggtgtgcttgacggcaacggtggtcgtagcagtgggagtcgtggtcgacgatgaggcgtggcgtggcggtggggcgttcccgtcactggctgcgccccctctcgatcggattagggtttgtgggggtggagttgccgccggcnacgaacttcgtgtcttgtgccgatccgcctccacccctctttatatggcgcagggtgacgggggcccaccagccattgggctgggtgcccccgatcagggcgcgggtcaaggcctccttgagctgttgggctcaaggggagggagatctatctaacattctcccccttgatctcactatttcttttagcctttttctattccatcatagatttgcatatagagcatgtttcatcgtcacggttaatcaccgatggattcgacagccactatacacatctctattcagaaacagatactttaacttttgggccctatagtccaggattcataaggcttcccttaaacccatgcatgctgcatgttccttgaacacgttgggaggtaggcctttcgtgagcggatccgcgagtatcctttctgttctaatgtgctcgagactgattgtttgatcctggactttgtctttcacaacatagtactttatgtcaatgtgtttggcagcaccacttgactgattgttgtgagagtacattactgtgggttcgctatcgcagtataactttagtggtttctcaatactgtcaaccacctttaaaaccgggtatgaatttctttagccagttcacctgccccgttgcctcatagcatgctataaactcggcatacatagtagaccctgcagtgatagtctgttttgagcttttccatgaaatagctcctcctgccagggtgaacacatatcccgatgttgactttgtattatcttttgcaaagtcagaatcagaatacctcactatctggagcgattctgattttctgtaagacagcatgaggccttttgttccttgcaaataacgcaagactttctataccaatttccagtgctctgggcctggattactctgaaatctgccaagtaacccggtaacaaatgccaagtcaggtcgtgtgtacatttgcgcatcctgttggcttcctacaactgacgcatatggctttgtttttcatttcattgagctcatactgatttctaggacattgcgatgccccatacttttcgcctttgactataggagcaggtgtagcactgcatctgtacatgttgaatttcttcaacacattttctatatatgccttttgagaaagtcctaatgcatactttgttctatctcggtgaatctctatgcccaaaacatatgaagcctcaccgagatctttcatgtcaaagtttgaggacaagaatttctttgtttcctgcagtagactgacatcactactagccagtagaatgtcatccacatacagaattaggaaaatgaatctcccattcttaaactttgaataaatacagttgtcctcgatattctcttgaaacccaaatttctttattgtcccatcaaacttcaagtaccactgtctcaaagcttattctaatccataaatggatctctttagacggcatcccatattttcatttcctttcatgacgaaaccttttggttgtgccatgtatactttttcctccaaatctccatttagaaatgtcgtttttacatccatctgatgtaattctaaatcataatgtgccaccagtgccattataatcccgaaggaaactttacaagagactggagaaaatgtctcattgtaatcaatcccttctcttttgcgtgaagccttttgccacaagtcacgctttaaacttttctatattccctctagagtcatatttggttttgtagacccatttacagcctactgttttggctcctttaggaattttttctaaatcccagacaacatttaatttcattgatttaatttcatctttcatggcttccaaccattcagatgagcgggcgcttcttatggcctcttcatatgaggtgggatcattctgcatatgcgactcttctatattataaacttcatagtcatcatggatagccgatcttctgactctttcagaccttctaggggcctcctgttttggcacattatctgtttgaggctattgtagctcctcctctggtgtggcaataatttctgttgaatcctgtagaacaggttcctcactttctttcattgttgccacaggagagataacaataggtgttggtaccgcaacgtcatgcattgcaagcacaacatcagcaggtagagaggagaaggctcttgaatcgactgagcgggctcagacacccgcctctcgtcaagatcaatttctcgaactaccgagctccccctaatcatttcgtcttccaagaagacggcatgtcccgtttctacaaactttgtacaactgtttggacagtagaaacaatgaccctttgatctttcagaatagccaataaaatgacagcttactgttttgggatccaatttcccaagatttgggttaaatactttggcctctgtaggactcccccacacacggaggatccatagctcatacggtgttttgggcgctgatgcattctatgcattgtatgcattgttctaaaactgagaactccaatggaggaagaattacattcttaaccagtctctcaattctccccctcgaaatatggcctaaacgacagtgccataatttcgatgagacatcaggagttcgctttcttttcttgttttcttttgtcaacgaggacacaacattcacattctcaaaaagagataacaaataaagctaatcttgcaacacagcaagaccaatacatgcattattataccatagttcacatttgccatttccaaaatgacaatcatatccatcaaaatacaatttggatacacttatttctttgcaaagaagggacataaaaaacatctcgaagtaaaagtgtgaagccattcgtgagctctaggcgaagatctctaacagcttcaacttttgcttcaactccattggcaactctaatggatctttcgcttctttgcatagtcctcatcgaacggaatccctttaaacaattacacacatgaatagttgctccagaatcaatccaccatgtggatctagaataaccaatcataatgagattcatttacaaatgtaataatgttctcacctttctttgccatgatcactgtcacgaagtcaggacgatctttcttggaatgtcttgtcttcttgcagtggagacactgatcctgtctcaactgtgaactgttgttgctgaggcagatgctgaggctgttttgcttttgaggagggtgacctgtggctcttttccttgttatctttaacaaggttaattgagccaccaatggtctctttgattctttcctcctcttgcacacaattagagatgagctcttcaatattccatttctctggacttattttgtagttgacaacaaggttgacaaagtgctttggcaatgaggtcataaccagatgaaccagaaagtcatctgagatgcccaaatctttttgcttcaacttggaagccatgttgctcatcctaagaatgtggtcttttacaccacctctatggtacctttctgtcacaagctgctttatcagttgtgtcgcataaaactttgaagaaccagcaaactggctctttatactttcgaggtacttagagacggtgtcatactctgggattaagcccaatatggttggctcaatcgtgttctttaccgcagccaaacattccttgttggctaaggtccatttcgtatgcccaatgtcatacgacatgatgagggaagcattttccctctctctcttttgccattcagcatctgactctttttcacctctgaaaagttcagcaggttctataggacatggggtagtcaacacccagtccacctctcccaagataaaagcaaggtcgagttctcttttccattctttgtagttatctcctttcagggtcggaatatctttaatgtaacccatcaaggagtagtcacctgagataatcatgtattgtgagaacaaaattaacattaaaaatattatgtattaagtctacatcaccgttgggcagaaaatagacataacacataaagccataactataacattgcaatcatcaacgtgggtcagaaaattacaacatcatagcacataattaatgttcctaaaattaaattctcccgttggttcgaaatttaattttagaaacactaattttcatcaatatcatctatttgcagcggaagatctatattaaaatccataagaacagtaacaaaactatgttatttactctctgtaaaaattctcctgttggttcaaatttaaacagaggaaaaacatgtaaaaacaattcaaaattctattgtaatttgcatgaaaacatacaaaatacatgttcagaagcatttctcacatttatctattctctaaacaattttcacaatttacaaattgcttagaaataaaaacaatcattaaacatattgaaaatgattctgaatagggacatttattaaacttcttttccttcgccgagggacctaatatggacttttttggcctttgccggtcggcccacggtcgcctttaggcgcttgcggccatgccccctcccccaggccgcaacctaggcctgggccaggaaagccgccccccgcgcgcgccctcttgggctattttcggcccggccgccgccggccgtccgatcgctagggtttcgatcggacgaccgcgcggagagatcgggcaaaacaaaacctgacccccagtcgcctgcgccaaaaaccctagcttcttctcttctctctcatgcgaccgccgaaaccctagcacagcgccggcggcggcacggccccggcggcggcttaccgcgcggcggcggaacggcgacacggcagcgccgtcgcactccccctcgccggtgcgcgcactcactcaagggtgagtgcgctaccgtcgagcggctgtgccgcggcgccccctccttttctcttcgctttctctctcgggcgggctcggccgcgccgagcggtgtcgtcgacgcctcttttctcttctcccccatcgcgccaccagccccaccgagtgagagagagtagcggcgacgaaggagatggcggcgccgccgcgggccccctcgccggcgcgcgcgtgcacccgcgggtgcgcgcgcagccgtcgaggggctccttggcggtgcctctttgcccctcccccctccgttgtcggcgtcaacgacggccggcgacgaggtaagattagggttagggtttctcttttcaatccgttggatcgtttgcttttctttcttttgcttttctctttggatttccatccccgaaaacaagatccaaacgctagggttgctctgataccatttgttagcattgctttgggatcacctaggttagatctagtcgggtagaacactttggatagacgaacaacaatagatggattaacaaagagggagtgagagggtttagggatgtgaccggtcgatgttgaggaggaggaagtgcggccggccatcgtcgttgtcgtcgcgggcttgacgtggacggcggcgatggtgtgcttgacggcgacggtggtcgtagcagtgggagtcgtggtcgacgatgaggcgtggcgcggcggtggggcgttcccatcactggctgcgccccctctcgatctgattagggtttgtggggtggagttggcggcggtgacaaacttcgtgtcttgtgccgctctgcctccacccctctttatatggcgcagggtgatgggggcccaccagccattgggctgggcgcccccgatcagggcgtgggtcaaggcctccttgagccgttgggctcaaggggagggagatctatctaacatgtagcagcccagaactcacctactatggctaagaaattcagaccatgacaatgcgcaacttatgggttcagtgtttctatctctcgttttgtccaccgagcaaaaactttactcctaattaatgggtgctcaactgttatataatataagtcatgcgcccatgtcaatgcattatgcgtgccatggcccatggtgcctgaaattttgttgagcacagggttctcaaattcacgcccctcgtgtcgagaccaaagctgcggtgcattgggtttctgcaactcaccttgcaattaaccagtaataaactagtaatcgattccctaagcagaatagtcgattccagaataaccatgattctctccctttttttagtgcgactacaaccatgactaggactagaactggatcgggagggatgcaagcagggtgggcaagcgggctttttttgcccgcttatcccacttctagttcatttattcttctaaattttgaactaccatgcaagaaatacactagcaagcggatttttatgtgggtagcgggactacccacttgcatccctagatcgagttagcaaagcaacgaaaacaagggtttccttgccaagcaaagaggatccaagaaggattcggagggggataaggggggagagagcacccgtagaggaatggcctggatgggattctccctcgcctcgtcggttgctcttggtccggtcgtagagcctcgcctgccgtcaagccggcaccctagcgcttagctgatcgcctcgccgccatcgccggtcacctcgcgattactcggtcgagttgactagtcgagggcacccctcagttttctcggatcgtgcgaagtgaagttaggagatctcgggaagtagatgggctgatatgtaattggggcggttggtttatttctgaacagaaacagaaatatgtactttctctgtctcaaaatattactactacctagtatcttctgttcttaggtattgctatccaaaatattaaaagcttagcgataaacaaatcatgttgttacctaaaaattctatcttagatagcaatattttgagatagaggtggtagttggtgtggaggagccgaggaggtagttaagagtttccttcgctggctcgagctactctccgccaaacagccggatcagctgtttcgcatagccttcggatgttaccggctcccggccgctccggcacgtgccaagccaaacactccgagtccacgacattcgccctctgaccagtgacgaagctacatgtaatctgtatagtcagctaaccccataggtttttgcaaaatagataaaaaaaattgatatttgtgttgtaacaatagaaaacttaaaaaaatttatagctttgaccccgcaggtttttgctgctggcttcctcatgcatcaggctgtgaccttgccagttggcacccatcggtcgggctagggctgtcaacgagccgagctcgagcgagcttgcttgcctaggctcgagcttgtgtgacacaggctcgagccaagctcgaatcgagcctagtcctccttcgagcttttaagcaggctcagctcgagctcggttaggctcgcgagctcgatcaagtataagacaatgtatattttgatggcaaaattttgcaaaaaaaaataattttaattaacaatattgaaggaaaaaaaatgagaatctaagattaatatatgatgccaaaatacaattttcacacgaatatatactaatttatcctcgagctactaacttatcatataaaaagataaatatttcacacacagttaggctcgtgagaagctcgagctcggctcgacaaagctcgcgagcttgcagctaggctcgggttcggctcgttaagatctcgagctgagctcgaatcgagtctgagacgagccgagctcgagcaactcgcgagcctcgtgctttttttgacagccctacgtcaggcctcccacagggccgacatcacgtcaggtccatgtcgcgctcctcgtgttgctgagtttcccggcccaactgccaaacccgtgtgtcgcgatgaacgcacgttcacctcacgtcctacctccaagcattccatcccgagttcggatgcctccgacagacaagctgtgtttagattcaggggtgaaaagttttggcatgtcacatcggatatacggatatatatttgaagtattaaacgtagattaataataaaacaaattatagattccgtctataaactgcgagacgaatttattaagcctaattaatccgtcattagcaaatgtttactgtaacaccatattatcaaatcatggagcaattaggtttaaaagattcgtctctcaattcacacgcaatctgtataattagttattttttcgtttatatttaatactccatgcatatgtccaaacattcgatatgacagggtaaaaaattttgccgggggatgtaaacagggccaagaattcctgtcttttcggagacattgcctgattgactatgacacatgtgagtcgcgatgcgccggtgacaacctggccaaaaacaacaataaggggaatgagaaagaaggtgaaaccacatctgcacctgataaaaataacaggggagatgaggtcatgtcacccacatctacccaattgatctcactaatgtgccaataagccaattattaattagaaacttcgcactcgtgtcgattgtagctgaattgaccagcttcgtagagtcaatgttgcagctttgaattttttgtcaggccggcaatggagcaccgcccaggtttttctttttctttggacttcccagtgcccaccattgtttaaaattttggaacacagattgagttgcatcaccggcggtgcccaaggtctcttgttgaagcgcgtggtccggaaatgggggacatcgccggcgaagagcatcgagtccagatagcagccagagccagctccgaccggcaagacaaggtcgcggcgccggaaaaatgggtgaattgcttcgttcgcgtggtgacactgatggagaggacgagcaatgcactcggcacgctggctttcacttgggctaccgttgtcctgctaggtggctaccctgtggtgctcgactcgcatggcgatttttggttcgcgacagccatcgtattcctagaagccgcaaggtatatacagctacttatgtactgcccatctacacctgtttttgattttttgttctgcagtctaagttttcacttttctttgattacacaggatgttcggtcgcaacaatagatttgattaccaattgttcttccggacaagaggtgctttcagtttcagatcacttggcgggaacggactgatcgcgatcgtatacttttctgctgctaaggtggccattgttgttcgggaggtgcaggacggggcatttatgttgattataatcatggtattagtagtaatactacttacggttggcccattagtatctcgaggagctcgaagaccacgcacctgtagtctgctgctccgtgtgatatcgctatggagccccgtggttgcaatcctattgatgggttcctccatattccatatgtacggagacagttttgtcatgtggatagtgtacatagtgctccttgcggttgtgctcttggtgacggtcagcaggctgcggttctcaattattgtcaaccaagtgcgtcctgctttgggcagtaaacacgtattttggcgtcggtttattccttttttttttttttttttttttttggcaaccgtcggtttattcttaactcgtgcatgcttgctgcgatagtgatgatgcttttcatggttgatccagtccttcaactgttcaacacgtgatgatcttgctcgatttatgtggttttgccatactgtcatctggcaacttgcagattcctgcagctatcgtgcgcgaagagctcgcgaggatgcgccttacgcgacatgactacatcggtgttggtgagaagacaaatcttggccaatctcttaccatcctctacagcatggtgcttggccaaggcatactttacatcgttgccggcacgctggaggtcttctcgttcatcccactgagatccctcgtttgccgtgctggatttacaggtcagtggggagttgaatctatcaatctgtactacgaatatgccttcgacaaatacatggaaggaggtgtgtttgctccaaagaggatcaacctcagcaactttgcgatagattctataaactctgacttgtccaagaatcaactgtacgggatccagatgatgcacacttttctgcaaagagatccgacaagagcacaactcctggagaaactcaccacttcaatgcagacgaaggccaggttgatcaacatgttggactggactaatggaaaccaacatacaactattagattatatgctgcgaaggtcatggccgagttcgcaaagagcctccgaattgtaactgtccctgaggcaatgcagcttgtatcaacgcttctggataccgagggaagaccaaaaagaggacacccacttctaaatgcagatgatgatcaagatccttttgttgatccaacagaagaaagactagatgcagctggtgatcaagagcaaagacaagaattagttgcggacactgacaactagctggaaacgccaacccaatcagcacacagcaacgaccaagtatccatactcagaagttggcagaggatatcagagtattggtcaattcccaaggagcagccgctgacaaaggacgatcttctcccagcattgggcatgtcaattgtctacagtcttgctagttgtgatcaaaataactgtgtggaaatagacaaagtaactgacctgatccccaaaatcataggattcacaagcttcagaagtgcaatggtgaattccgtagcacaacagaaggttctcgtaaagtcatcactgagggtgctgtagaggctcacaagcattgaaggggaaattggcatagcattgcggtacaagatatcaaaacatcccttcctgttgggaaaccttgcggagatcttgggagacaacactagcatgcaagaattaaggaagctcgtcgcaggaatcctcagaaaccttgccattgaccgagacacaaggcaggagattgggcaaatgcaggtgctcattaccaggctgatgaaggcgtccctcaattctgatggaccatctagtacagatggtgattgcttgcttccgaaggttgctgggcaagcattggcaatgctggcatcagaaaatgtgcataactgcttggttatgttgaaggaaccagaattcattaataaactaaaaaatatgatcctaatccatgatgggaaatgtatatatgtggctgcgagcctgttgcgtaatctgtacctgcatgctcaagctcaacccgacctcacagaatcaaaccaaaatgacctatctgatgcctttcaaaaggtgagccctgctaatccatacttcaagtgtaatattagatatgtatagtatgttgtatcatttgtacatttgttgtctattaatgtttgtcaagacataattattttataatcaaaatggacatttatttaccactaaattgtataagtataattatagtttacaactatgttcatcatgctacatgacattgctggttccactacacaggtcttggaaacaataacggatgttgaaggggcagaattagaaatcctcattggtcttagttcacagatatgcaaagtcaaacctgaagaatttgtgcaagagctagagcacggacagattaagcgaagattcgtgaagaagctagtggatgcactgaatgcgaatatgaaaccaagtgttgattaccctgggatccggaggatgatacttgagcaaaccatatatatgatggagagcagttcttgctatgccaattgtttcaatgaatttcagatgatgaatgcactgctgatggtagaagagacgccctcaagggttgagaactacatgattttcttgggtgatacaggcttcatggaatgcaacacacctctctctgctctcgtggacagagcaaaacaattgattggacattagtggctgcaaggcatcagcagcgacaaataaataaattgtaagagatgaattcccattgacagttgcagtgaattattgaactgttattgcagttgaaatgctatgaatttataatttacgcatgttgtggcgatgacataaggaacagagaaaaaaaatggtggcattagaatcagaataccattcatattgttacttgtttttttttttttgccggaatgaccgaaggaggtcattcaatgcaattaagataggaagaaaatattacaagaaaagttttacatcgacagctggctgtcgaggaaggatgtgcactagagcacacgccccgaaccatgtgccaaccgtccaaacacacgctacagagagggaagccaagcaccgaaccggccatcgctatgcgagaccgatcgccaccgggccaacaacaccattatgacacgaagactctaaaacgacgccctcacaagggtcgcgacgccgaaagacgccgtcgtcatccgtccaaaaactggacaaggttttcacccagagttccttgccgagggaggaggggtatctcaacaatgccctcaggatggttaccatgcctgaaggcgtagtcaccgttggcccaaagaaattaggctaagctttcgctcgaaaccccttaccgccgtggtccatcgcccaatccgaatccaccatctaaacatcggcggcacatggcttccaccacacccgaccgatgcccctccgcgattagcttccagtcctgccaacgacaagactgccaccacaccgcaccgacgccccaccgtcggccgacttcatcgaaccaccatccctgagagctggcctaggacccctccatgccaccacccgccggcctcctcgccagatctggctgaaggagaacctgggactgggtggcattgcttcggcatcctgagcttcccccgctgacaagtgacaacctgccgtctcaatccaacctagaaactccctgcaaagaaggggggagctccagaaagggcgagggtgccgaccagcaacgaagaagacgacccacagccgccagctccctttgcactaccatctgagcctacgccgatgccggaaatgctgccgctccggcttcggagcccccccacggtcgccgcgtcttgggctgccggccactaggcggccaagccgagcggccgtcgccgagccgccgctgccgcacctccgcaccgacctccgtgctgcacttcggccaccgcgccgacgcaggctctactccggccgatgcgtcgacatcgtgccaccgacacagccggcgcgccaccaccactggccgccgcgccaccagccaccacatgggcgcaagcgacactccggctgccgcgtcaccgacgtagccggcgcgctgacagcccgagccgccgccacgccggagccagaccgacgcccagccaccgcgttgccaccacgggccaccgcgccgccgcagtggccctgccacggtcgccacgccgtcgctcgagctcgcgccgtcgccgcaccgaccagattcgggggtgggagggccggatctaccgcctccacacgatgccctgccatcttcgcctccaaccgctgaggttgacgctgtcggctttgccccaacctcctcgcgccaaggaggacgccgccgagctcaactggcctcgccgccgccttcccagctcgccggcggcacgccggcaagctccggcggtggcgaggtggaggagagggccgggatgcggcggcgcgggcggctagggtttcgcctcccgagccgcccacccgtgttacttgttagcacggggtaaaaaactggaatgtgcatatggctttagaaagaaacatgattttcgttcgagatgagcaaacgttatttgtaattttacctcattagtactgtttgtctgcttttctactgatgatttgtccaaatatcatctcttaagagtgaccaattaatgcataataattggttagatataggtgtttaaggtgattgcagttcctatgccaagttctagtgcgtcccgcttttggcatcaaattttttggtaaaatctttgggttattttttatacctggaaattatttgctatcaattaatgtgaactcaactgaacatccatgaaatatacaaatcatgcgcccatgtcaaccgtgcatgccatgacatctgactctagtttagtacagggccactaaagtcatgtacatggccctattgagaccaaaactatgctgtactggagctttctactaactcagcattgcgattgacctagtagtaaactagcaacccaagagcactcccaagattccaaatccctaagcagagcagtcgatttcagtataaccatcactctgttctttctgtaagactaagagtgtaaacatcagttaccttgccaagaggagagggggcacggaggaagagatgaggcaaaagggtgatcggatcgggacctgtttgaggaatggcctggaggggattcgccggctcgccctcgccacgtatgtcggctgctcgtctccaccgaagatcctcgcccgccgcccccgcctggtgccgtcgcgcctagctggtcgccttgtcggctgctttggttgcccgccggagatcgtcgcccagccagcaccgtcgcgcctagcagcctggcaggttgccggccgcctcgcgttagtcgatcgaggcagccaggccattgccggatcgtgcgtctgtcggtgggatggacaatgagggctgctagagaacggtataccgttcaacggtatatccattacctctcccctagacgagatgcgtgtgtatccactcgacaggacgtgccccctagacacactatagggtctagtagcttgcctgccggctggtatggagttgtgctatgtgtcaatcgctagctagctacggagtagaagctatgcatatgcgtcagtatgggacagtgttccctggctgtagtctgcactaaaattaattactcttgtataatgagtttgcttatggtaaaatagttgttccgttatttttattattaaataatttagatttttaagccaaccatgcacaattattagttggctaattgggccaactaatgattgctcatttaatttagttggatcatattagacgaattgtcaatattatatctggtacccataggtaggtaccataggtaccggagcaaagctaatatcacgggtaccaggtacttggtatctggtacccgtgatacctggtagcctggacgaggaggagaagagagaggataaggcagccgcgtggtggagcatggaggcaagacgacggtagcgcggcacctggaccacacgtttgagaaagctcgcgtcagcgcacttcgtaatgtagttgttggtggtgataccttctatgctcgggcgatgatacttgtaggcacttatgatgatatatgtctagttaaaagggatgatagtgatgatacgtatcaatgtatagttatatatacatgtactagtgtacatatccatatgactgatttgactgctgcataggcctcacgatcatgcatgcatgactggttcaccagctatcacctgcacacatggaccccacccatgtaagcctacttctaccatgcagtaggtgtcacgccctaaaaatcctaattatataaattgttgtttaattggaatttttagaaatttaaattaaaagcctacaagctaaaccctaataatctaggaaaattttcaacataaaaatgagctagataaaattttattaaatactacacttgctcctctattttctagatttttctgggaattatttgagcaagggaagtatttttaataaatgaaacaacatttcacaaattttttttaattaaaaagttccaaaactcctcctttaagccgttgggctgagtttggcccaacatgccccctccccgcccgagcggccgagccggcccattcggcccagccgacaccgcccgccctccctcacgtgggacaccgacatgtggggcccacatgtcgggcccttctcctacctccggccggccggccatgccaagcccgagccgccgccttgcgccctcaaatccgccccaatccagccgccccgagtccgattgttaggggggtttttatcctctcatcctcctctatctttacccccaaaaatcgaagcaaatcgttgagtatcttgcccgaatcgaactcgttttcgagtttatctccaaaaccgagttttgtttttctcggatcgatttcttgcgggaggagtccgatctcttcaatccaaggctttatataggaccccctagtccttctctttcgtttgccccatctcccgtgctttcccgtgccttgtagcgccgccgccacaccacccaacccgccgccgccgccggccatcctccggccacgccgcgccgccgcgtccgccgtcgttgccgcctctcgttgccgccgttaggtgcgcacgggagcgaggaagctcggccgccccctctccgccgtcgccggccgtcgtagcgccatcaccgccgttcaaccgagccgccgccgtctcttgcgttgtcgccggccgccgtccctcgttgttggacgcattggtgagtaccatcgggttcgccccgacgtcctctacgcgtaggtgtcctccaaaatcccggccgaccaccctagctccggcgaggttgccatccgagccggccaccattgatgacgtcatcatgacatcatcatcttatccttttcgttttttctaatagattaaatcttcagaaaatcgtaactaaataaccgtagatccgtttcaggtggttcaagttgctaaatttttctaaaatcaagatctacatgttaaaaatattcacatgtactgtttatgcttgtttttgtactgttttgttgattttttgtttaattgctttagtttccgacgttccggaggagtgcgtttccgttgaggaaggttccgaagagtttgcggaagcccaagacaagtcacacagatcccaaacaaccctttgagcatgttgaacccgtttaaagctattatttaatttcaactatgcattattttcgaatgtcatcgggtggtgaacctttcccaattaattaatggccgaagatgatcttattttcctatgggttataatttgattagcatgaaccttatatgttggattggttcagctaaatgctatatgtaagtttgcttagccatgtttagaaacattagctaactaaagggattaattataaattatgttactttattgttttaattatggttacattaaatggtagctcacgatggttaatcgtgtgatgttaattgattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgagaagcggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtacccgcggttatgggtgagttgagcaatgtttttcgtgattagtttcacactactcatcaatgttaataatgtgataattaatttgactcctggtttggaatggataattcctggtttggaggtttgatctgtacgaccggggttggttgttcaggtttggttgggcctgagtggcatgggtgtgctgttcagtgttgattaatattgatgattaattactctattgttttactactcttaaatctttgctaaatgctgtttttgcaaatgagcctatattatgccatcctttggtatccttgtgcacttgcatacttgctgtgtagcttgttgagtatgtcatatgctcattcttgcaatattcaatcatcagaagaggagtatttcagcgaaggtgatgatctgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttcaggcctgacaagcaaaaataaacagcagcggactagcggcctacggctccatcttcacaggcgctcaactggggtataagccaagactccacctaagacttcttctccaaagcttctcttactgaaggggggagaaagatagagcaagaatgagtacaaccacagtactcagcaagccacaccggaggtgcatgattaatgcaagggaagtacaagggaataataatatagggattaagttttgcagtaaaccgcatttaaaaatcacttagttgcccaaagccattttgtaaagacgatcctagagctacacagtgttattaaacaaggccgtgaaccctcacgaacctgccttaacccaaggcctacgatgatttggaccgaactggcaacccgaccttgggtcccagctcgtcccaagccaacccaggccaaccattccatat

SEQ ID NO: 63833 - DNA, 63470 bp, Oryza sativa
cgcgtgggcgtgggaagagtagggaagccggcggcgcgaaggtcgtcgtcgcggccgagaggagccgtcggcgcgcggaggcgacgtcgcggtcgtcgtcgtcgccgaggagggagccggccagcggcgaaggtggggaaccggcggtgcgcggacgcgggagagaagggagtcggcggcgcgcggacgtggggagaggaggggagccggcgtcgcgaaggtcatcgtcacggccgatgggagccgtcggcgcgcagagccggcgtcgcagtcgtcgtcgtcgccgaggaggaagcccgccggcggcgaggagagggccgtccggcggcggaggtggggagccggcggcgcacggtcgtggtagaggagagattttttctaagtgagagagagagaggggggagggaaatgagtggtggagaggagaggagaggataaggatgactagattttttttggtaggtatgatttttgcaggcggaccacataaggtgcgtaggcgttgcttaagtggtcaggcgccgcttaagtggtccgcagcgaacttcaccccgatttatattttttgtaggcagttattgggctccaagggccatgtccgactgcgaatataagaccccacattagaaaaatgctttttccagtagtgtgagattcccttggcaaaagtagggatttaaagccaacattgaagaagagagagagagagagagaaatcaaacatatgctgtatatatgcacttaattagacctggtactttattcttaatttttttctcaacaaatatattttttagcctcctagctaacaccactaaccctattcccccaaactaaggggaaggatgcttataattttcgagtgaatacccagtcttaaatgtaacaagaagatgtcttggcttttgtgttttcagtacaaagataattcataaaatacctcacagagtgtctctagactgcatgtccaaattttagaatcgattttacaaccacctatagaaatgtgttgtaggatcaaatacaataactaaggcttcgttcgttccgggcgatttgagagagaaaagcatctcgttttccgcgcgcacgcttcccaaactactaaacggtgtgttttttataaaaaaattctataggaaaattgctttaaaaaatcatattaatccatttttgaagtttaaaatagttaataatcaattaatcatgtgctaatggctcacctcgttttgcgtatcttcccaatctccccaatctccttattctcaaacacaccctaagcctagtagagaggtgattgaatggtagaaacactaaaaaccaaaaaaaaaattacggaataaaaggaaccctaaaaccttatgaagatgcatcggtttgaccaaaagtattgatgagaaaactacatcccgatctcccaaaaatattgataattctcaattcggtggaaacttaacacacacgattcgacttccgactaacacgatccgagtcctgcaatcgcagcaccacgtctcatttggttaccaaccatgccgaaacccagttgatcttgccgagaaggctaatccctgcatgcgaatcgaagaacacaagcaagaacaaagtagatagcaactcaattgcatatgaataattaagcactcgactttggggcacaaaaagatctagcggcgaaattgcaatggcagaactaatctaagcaaaaccccactctgaactataacagctactgaataaatatgatttggaatgttctagggttgccctggggtgcatacccccttgggcttaggccaagcccacgacacaattacaagaccaaaaacccaaatcagattcggactgaataagatacatggctcgttttgcagattcctgacaactcggtaggaattttgacgtggaactaaaactatctgaaagtactcacaggtccagagattccttctaaatcagcggcttggtccgtttaaagttgatgctgtcaggaggcccgaatccgaatccaaaacgtgtagtcttgccttctataattcaaaagtgacgtggtgaggtaggagtggacttgaggaagatcttggtttgatccctaatcaacttttttatcatccatgtattctttacgctcagtcgcttttccttcacccaagcaagtacctctacaaacgaaaaacatacggaactcattgtgtagcaatatttcctcatcaggtatgccgccggtctgattgcctgcaagccaccggtctgaccgctctctagccaccattttgatcgcggcttcctcatctactcattgcctattcgctgctgccggtctaagtgctcgttgtactctggtcagaccattaggatccagaaaaacagaaattgatgaaacccttaaaagtagatcaacttaaattgcatgaatatgtatttacaaagtggatctaaaacactactctctcaactctcaatctagaattgaagcttaaagtagatcctaacttttctctctcgaaaagttcgtatacttctaaccacattccctcttctatttatacccgaatcatggctgctgatagctacagatcctactagaacttgggcttctaatcacataagaaacctaccaaaaaaggaaacaacatcctcatacaattccaaactccattcttaccaaacttttcaatccaattgactacattttccatacgcagacaacaccatgttaatgcagggtttaacttatcgatttgaccgattgtatcagaggtcaccgatagaccaaaatttcaaaaaaattgaaaaaaattagttaaattttaacaaaaattaccaaaattcatgaaaaaattaaaaattttggcctaaataatattgtatcggagtggtccgaaatgaccaaaatttcactccgaaattgccaaccctgcgtgtttgtcatatgcaaacgttcacctccatatgtattgtcctctaggttgaacatcccacatgatatcctttatcatctagatctcatcttctaccaagcctatactacaataaaagagtgctacggagactagctagtccagatctatcaccggctatactcccatagccttaacaacacccacacacgaacaacaatgaaactccatatccgagtaaaagttcttaccaacttaactcacatcctctcttactataaagttagagcccactaaattttaaagcttaacatgcaaagatgccacatcatccacaaacaattattacatttaaatatgatacaagcatattatattatctataattttataatgtattaaattttataatttttcaagtgcaagcatgttaaataatcatctcacataattcacatactatttcaatgtctctcaaacagtttttataatatcttatatacctatatagtttatcctaactcctaacttagttaaaatatgctctctctctctctctctctctatctctaatgtcattaagccatatcacatcaattgttttgtccttaaatgattatctatggtctaaattgtctcccctattttcttcttttattaagtcgtatcacctcaattgttattagcccttatatgatttatccaatctatctcttcattttgttttctcataaagtcacatcaacttacttttacttttgaattatcaacttatgtaagtttatattatctagctatctttaaaattatttttacttagtattataatactaaactctctcagcagcgcgcggggtttcacctagttaacacaataacaatatcacatatgtatagaaaccatttagaagtcataaacatgaagcaatctataacattcaccaaactgactctctccaccgatctaaccgtcgggctgcctggtcagaccgcaataacacttccgatctgaccgactgcacctgcttggtttgaccccggccatgtccagagactattcaccgtatttttataaactcttatcacatgattttacaagtgtctccaaatgtttttttttgtttagttacattacatgattgcgatgtataacatcttgcatgtgctaacttctccgcaaaatacagtggtacgtatacagccatacaggtacgtcaatagtgacgatagatcatcaaatgcatggtttaaattttaaaactgaactcaaccagtcgatgatcgatctctctctcagagacagacagacaggctgtcgtatactgtgctcgcaacagctgcagggaagttgcttctgcgaatagcgcttatatggattatatataaaaactaacaatttaactaatacagaatataccgataaacttctcacattcgtcactcactgtgtatcttcctgatgaagctagattatgagcacatatcgatccaaccaaacgaaccgcctataaattgagcagatcatgctaccccttttgtcacaaacttccaaacatttcctaaacaaaacctgacaaacttccaaaactatacatccaacaacaaaggaaagcatcaaaaagcaagccaccatgactaacctgttcccagatactccggcaacgatctccttccaccctgctcaccggccgggtcacaaactgaagcttgtgcgaaccggcggccagaagttcaagtgcgacggatgcatggagcacggcgacggcccgaggtatcggtgcgagcgcgagacgtgcaacttcgacctgcacacgtgctgcgccctcgcgccggcgaccagagagcaccgcctcttcccgggctgcacgttcgtcctcctcccggagcctccgccgccgaccgccgctggtgaacggaggatctgcgacgcgtgcggcgagggcgtgcatgcgcgcggcctggtgtaccactgctccggccgaggcgacggcggcctcggcctcgacctccacccgacgtgcgcgtccctgccggcgcggttcgccgtcggcggcggccgcgtcttcgagctccggaaggaggcgtcgaggcggtgcgccgagtgcggggagatgaggtgcggcggcggccgcaggttctggttctaccggtcgtactcgtacgccgacggcgacggcgaggcgctgtacctgcacgtcgcgtgcctcaagcgcatgcagacgcagtacggcgccgccgccgacgtccggagcgtgcaggtgatgagctcgccggtgatggagggcgtgctgcggagcctgccgccggccaggaggagggcgacggcggcggacggtggcggtggcttgaccggttcttgacgatcgttgccggtgtcatacgtgccatcatcggggtcatcttcggtgatccgacgttcttgattgaactggcagtaggcgcgatccttaattcctaaggttgaagtatatatatgaaattattggcgaacctaagccatggatatgagttcgctttacaataaagaacatttcagttaatttgaagcagtttgtaaccaaagtcacaatgttacaagttaatgtttggggagtgtgcgagaatatggagagtttttgttgtagtaggtgagtgcaaatctatctattatataataaaaatgaaaaaggctatatgtgctaactttttcttactaaattcttatcaacactgatgtgtcacgctataagtgcatctaaatttttcataacttccaactatctaaatcaaatggttgagatgattcttagtaaagatttagtaaaaaaaacttagtatgtgtagaataaaaattcattgaacttcctgtaaacgcttctaacatatcacgtggcactcctgcgaacactcatatgccatcacgtgtcattacaatcttcactattgaaaagtaaaactcaaaatgagacaagaatgtgcgacaatcatctatgaaataatagccgttggattggttaagaaaaaaaaacatggaatcaatgttaaccgttcgatcgaacttaaatactagccgtaaaaagcagagggttctagacccttcaagcagcaggcaggggatgcatgaatgagaaaggaaataaagtgtgggaaagaatgatgagttgtcattagcaagagaaggtgacgtgtatactgatagaattaacagtagtaattcatgtgcccattcaaatattcaatcacattatcacactgttcacgtgttctcataacaacaatttattctaccctgacacacctaacctctctttgttacagtagaaatattttttaaaaatattctcacttagatcaggggtggatctacagttataggaccggtatcagacgacatcgacgactttcggtaaaatctatagcgatctgcttattcatatactatagcaccataatctaaatataataagcatactatgacaccgatagatgcgttttgataccaacgaatcaattttttagatccgccaccgactgagatcacacaaaaagagtggagtggcgtggatgttttgtttcttataaactgatacattttggaggtttataaaacacaaaatgccaaccaattgtatttgaaaaatatattgtgaaaggaatatctttttacgtacagttaaattccataactttggtttttacgctaaatttcataaatttatcataatgataacaaattatttattgtcatgataatacttactccccccgtttcggttataagatgttttgactttggtcacagtaaaactgcttcaagtctgtttgaccaagtttgtagaaaaaaatagtaatatttttgacccaagataaatttattataaaaatatatttaattaataatttaataaaactaatttaataatgtaaatattagtaacttagtcaaatttgaaatagtttgacttacttagtcaaatttgaaatagtttgactttgaccaagtcaaaacatcttataacctaaaacggaggagagaatagttattaaagatcaagaaaaatttatttgcgttggaactagatttcatctatatatgaacaccaattcaagtacataatacatatatgtacgagtaggaataagcaaaatatgagaggagcataagactcatgcaccagcggagatagcgagactcatgcacctgcggagatagcgagaagactgtaactcaagcaacaacgaataaggcggaacagaacacatggaaaggggaaatggtaatacagaagatgaatagaaatcctaaccctaagcactgcactcaccattttgttcagccaatcatgaattgggcatttcaatttacaagtctatttacaatattcaataaagatagacaattgttggggtaattattgtatggaaactatttgatgttattaattgccaattttatgccgctaatacctgcataaacagaagaaataaaacatccaacatagtgatagggtttaattctaatgtattccacaagtgttggtgtttatttgaatgcaggtaatataccgccaatgttgggatgaaatccagatctatgtgaaggaggaatcctatccatataaagagtaggccttgaactacatcaaaacatcatcaaatgggccaaatgctcggagaaatggataaagtagagcagggaggggaaccagaccaaaattggaggtcacctggcccagaccaggttcggccaaaccctggtgagagtcgtttaatccaggttttcgtatggacgctcctgatttgctctactcctgatggtgattggaggtcactttcgtcaattcacatcagataaccgttattacctgcctataaatagagctcacttcactcatttcaacacacactccaagcttaagctaaattataagaggctatattgtactttattgtatactagaataagggagagagtagagtagaggaagtccgaggaattcccgagctgtcggtaatcctcttcttatttcttttactatgttaattactctgctttaatccaaatactattctgagtaattaagatttattttgtgagacttatctcttggttagttcctaatcaacgtacgagatcattgataactataatccagtaaaatatagtggttgctctagttttagctaacgctaaagtagtttttaactgcgtagacgtggtgtctgggtagttaatttctggtggttgcttcatattctacagtaggtttgaggtgggtgtagaggtggtgacatccctcaattacactaaagtccttcctgtccgggtacgcagtagagccatatctaggagcagcgggctggccagtgcccgaagtatcgcattaggattaaattgaactttccgtagacactgtctctcactagtaattcctccctaccatttgcctatttttgcttcgtgtccttggatgaacctggtgaagagctgatacatatgttccctgtggaaattgataccttagaatactcccgggtgaagtgctacatcggtatctttcatgtgtttgcggattctatctataacattaagaaataccaacagtaacatgttcggcgaacgactagttaacgaccagtcttcctaatctaacgcaaagggcaatattctataagaagggacaaaaattcaaatccagtgccaatggatagttcttgattttagaagaattttgatgaaagtttcattgaaatctgatttaaaatgagagagttatggcctcccaaaatttcaaatttgaattaaatcaaattaatagagaagccttcctgttcagccatttactcatattttggaataaattttgtatagcaaaatatcttgtataactgactggtgggacccacaaccttttctcttttacaatacacttgctttccaataggaaagtccctgattcaacgacttgcgggccagggtcaaccttgacctggtcaaattaaccatttaaagcggcctgtgggcccacatgtaagtgacacaggttttaaacatcattttatttaagttttaataatagatgtggcccatatgacaaactaatatgttaaacacttatttatcttaatcaccttttgtcgacgggagatacccatagaccggatatagatggtattggagtacgctggtacgaggatctacgtagtacgacatcaagcaaacagaaaacagggattatactggttcaggtcccttggtaggtaatagccctaatccagttgatatgagattatacgatggaaatcacagattacaaagggaatagtggaactcgatgataccgacgagatcgtagtcgagttggttcaactagatcacccagcgacttggctcctgtaggctccggcttcgtaggctgtggtggttgtcttagctgtgagattcgatgccttaggtccttccgggggtcctatttataccgcaggtcagttagtcaccaagtaaaactcagagatatcggaccctacacgatacaatgacgacccagttctgtccgagtaggactccttccatctgtggactccgtgatggatttccttaatgtgtacagaaagcgtccgtatacgcgcaggtataccatatcaatacacgacgtatatccaaaggtagagggtataccttatccgtaaccctgacacctttattaattataacacacaatagtttttaagtggtgcctggctgtcagctctcctccatctttttctcccttctctctgcttagagcagatacaatagcaggctatcagccagctacaaatactccatccatttcaaaatataaggcacaaccacccataacccaaagaccaacaaataattattctcatcttgttgttcggatcatcctaataaatataatgcatgcatccaatagaattagataacatgagagtagatgatttaaaaaagtagtaatttaatagagaagatgtcacagttaattgtatgcttgtacatgccttatattatggaacatctaagaaaagtgattgtgtcttatattatggaatggagggagtatattttaaggagataaaagaggagagagaagagcagcgagctatagatttatagccagctgtagcacggactccaagacacaatatgtgtatgatatatgggaccagttattaatagtgtagtatgtaactattgtatgaattgattatatatgatttggagtcagtagttgactatactattaaaattgattatatactattgattatagatgatttaaagaacttctactatcgattgccagtacttattagtcggaccagattctaggtgatctgccaaaaaccgcctcgtcgtattccattctttttctttgaatggagccttaccgtgatccgttgcagccagagacagtaggcctcccaaactcgctacaaggcaaaaaccaacctctataagtcaactccaataaagaagcatggtggaaagaaggggtgtttaagatccccaagcaaaatttttcaccatgtcacatcgaatgtttggacatatgcatatagtattaaatataaacgaaaaaataactaattacacagattgcgtgtaaattataagtcgagtcttttaagcctaattgctctatgatttgacaatgtggtgctacaataaacatttgctaataacggattaattaggcttaataaattcatctcgcagtttacaggtggaatatgtaatttgttttgttattagtctatgtttaatacttcaaatgtatatccatatatcagatgtaacacgccaaaactttacaacatgaatctaaacacccccgtacgtctcttagatccgttatccttcctaaaataataggttttgcctctatactatttatctaggctggggttaggtttggcctggtttagttaccaatttttttccctaaaacatcacggtgaatctttggacacatgcatggagctttaaataaataattgcactgtttgaatggaaatcacgagacgaatcttttaagcctaattagtctatgattagcaataagtgctatagtaacccacctgtgctaatgatggcttaattaggctcaaaagattcgtctcgcggtttccaggcgagttatgaaattagttttttcattcgggtacgaaaacaccttccgacatccagtcaaacatccgatatgacctccaaaaaatttctttcacgaactaaacagggccattgctattggtcgggtttctcaattataggtggaagactttctaggaaagtaagctttatagcctggcttactttcttgtgctttctctcaagcgcgcgagcacgccggcggcatgcgccaccaaagtaggggcggccggggatggtaggttctagggtttccccaccgtccgtggacagcagcacgcagcctggaaaagcccaaaacagctaggtggcttgggtgaggcggcagactatgtgcggacaccatggacgccggcccggtgacgatggcgaaggcatgggggatgcgaagttggagctctagggtggccatgggttcaccaggacatgcgcacgaaggggcgggggtcggggatggccggaatagcttttcccccaattgctcccatagcggcggcgaccggagttgattccggtgaaatccgccggctcaggtggtccaccgcccaaggcatcactaggcgtagaatcgtaagggttacagggctgtaacccctaagtattgcggccagagatggtgcggtgggggttcagcaccggcagggaacacggcgaacgaggtaccgcggtgagaatgctggtgaggtcccaaattggacgtcgagagggaaggggttctctacggtaatccataggcatggtcagcttggaggggaagacgaggccgcagcggtcgggtgagctcggcgcatatggacgcacatttacggtcgaccaggcgggcactggactaggagcggggaaagaacgggggcaccgggcggcgggcaaggcgcggggccacgggtatagatagccatctaggccgcctgacacggcacgacccggcccaagctcggccgtgcctgggccgagacttgttgggtcggcacagcccgaccgacataccgggccgtgtcagcccacgggcggcatacatggcccaatactactcgggccgtgccgggccggcccgaaggcacgacggcccatcgtgcttcctctcagaaaaagtctacttttggtccctcaactctgtgggctgtgtttaaatggctggaaaataagtctattttgtatacctcttgtcttgggccttgcgttatacgattatttaagtctattttacatcccaatatttttttatttgatcgggccgtgccgggctggcccactgtgccgagggtgtagcccaggcacggctcggctatcgggccgtgccatgctttggccaggccaaaattgcgggctttggggtgggccgtgggcctcaggccatatggctatctatagccgcgggcagtgttgatggaccacttgccacctgcccggccattaatgcgccgccctcaagctcccgggttttcttgcggtgaggacgtggcggctggtctcacggccgccgtcgcgcgcgcgcgcgatggagttgggcgcggtgcggtgcgggcgggccgacgctgcgcctgtgtctcgacatctcgtgcgcgacgcacgagatgcgggtcatagtgtggtgcacggtagagtggtgccatagtgcgttggcgcctgtgccgcatacgtcttgtcatgcggctccggtcaggtggccgcgcgccgcacgaggaaagtagagcagggcacagcgcacgacataggggatgaagatgcacttaaaccccctggtgggttttggtgatcaataacaaggtggttaaaggggactaacgtgtttatcaagtttattcataggagttcagtcctaaagcaagttttgatgactaagaatgcaaggagacccccccccccaatttgaatcttcctaagtgcgaaaaacaccgaaggtgattagactaggtttttctctttcgaaattgagtttaggaaaaaccgtactattaagaggggtttcaagtgtggttctagggtatacaaagtgctcttagtcatatccataagtcaaaagatttttggaatcatttttgaaaaatgattttctccccgggacagaaagggctacccggaggttctggccggaacttccgggcaccgtttatttgcaaaaaatttcctaagtgttgcccggaagttcctggcacttttgctcggaacctcctggcaggtttccagttcaaacttgtgagtaacggctagatgacgtcacctagccgttatatatatgaatttcgtccccaggtcaccttttggccattccacttctgttcattcatgttctagggttttctagccactcccaagcttcctttgcttcctccactcaaatctagagactatcttgtgagattgagagattagatgagagtgtaggagtgttttggagatggcttgaagattaggtttgattgagaactttggataccttgtgggctgtcacttgggcttattactcttggagatcttctcctagatggttaggcgtcgcccgtgagcttccaaagatcttgtggatgtcccgggaaagtttgtgaaggttttcctcacctccacaagcaaacgaggtaagtgagtaaagtttcttgtgctgagttttcagaggttgtcctaggtagagcaacttgcacttgtggtcttttctagaaggaattgtgagttggatcttggtggtcactcaattctagaaaacaacctagaagtgttgagttgaagactgtggacctcttctgggatgaagcataagtgaggcaaggggttaatcgagacccggctctttggagcacctcaacggagagtaggatccgtgtgatccgaacttcggaaaaaactcgcctttgtctctcgtgtgcttgatctgtgtttgaatctgctggtatcttgtgattttcatcttgtgcaaccctgtgcctgattttcactagctaggacctgttatacttctcatatttcgtttttctctgttgcccggaagttcctggctcaagaactccggaagttccgggctgctcatcactgctaggatgttccggtgttcatcactaggaggttctgggccctgtcaatttaaccgctgcgtttgttgagaaaattgcaggaaagcctattcaccccccccccctctaggctacatctctgcacgttcaggggagagcggcatcggcttgacggctcgctaggtttggcgatagcgcagtggtccctggctgcatcgaggcatggcgagaggagcggaaggcgcgcgacggttggcttgccggcgaagggcggccatgcgggcctatatgggtgggcggcggcgatcgaacggcgctgcacgctgcgaggagcggctggtggctctacttgctaggctggcttgaccggctgggccaaggcaggcccggtggcttgggccggataggagagacagaaggagagaaaaggaaggccagacgaaagaataggaggtgaagtcaacttctagcagatggggttagggtttggatgggctaggctggcctgaagtggaaagaaaaaggtcaaagagggaaaactgggggccaaaaacagacttttcctagaaaggtttttcaacaaaagatggtttggaatttatttcataaattggactttttgataaatactttattaatagtatttgcttacgaaaataatcagggaatcaacccttataagggatttttagaaactaaataatttgaaattttcatttgtaaaataatcgcttaaagagatattaattcataaaagagtttttttaaggaacatacatagcatttacttttatttgaaaataaatcattaattaatattatttcataatcatggttctttaatgaacattattctaaattcaaaattgaatttagaatttgaaaataaccttaaactttatttaattgaggcactggcacaacaagaaaagaaaagaaaataaaatccaacaaataccaatatgaacgaactttgacaaacatttctttattattcccattttttgtttctggattttaaaacttgaaaatttcagggtgctacaaacacctcgagcacctggtccacaaaccccgtgaggcgaggtgttcaatgacaacggtgtatgtgccggtgttcggaagtgcaccttcatggaccatggaggaggttgtgtgcagcatgcccaggatggcagaggcaagtgagaggcagtgagggaaggggaaaggaggcaaggagggaccgaaggttggggaacactacaaaggaggcaagggtctggaagagttggagccggttgtggcaggagggtcgtctccgccaacgagtccatggccgcctaagctagctccacttctcatataactgctaccatcaatcctccaccatgagctcggtgacgctgtggctaccacccttgacgacctaggggaaatatgggaagacaagggagaaggaagcgagaaggaagaagactgagacattgattccgggaaagaggcgacagagggcgggagaagggtattcaggacgagcggcttgcgacctgtgggcgataggtgcagctctagcgatgacccccagcagcaccaacaccccaagtacgagagagacactatgcatggacatgtggcagtgggtggtgccaccagtcctccttggcttcctcttactctgtcctctctgtcgcctttggggcattccctgcggcttctccttctcgttcctctccggtagttcctcctggactaccgcggtgtccacctcctactcttccgcaaccatggcaccaccgtgaagctcgccgtcactgacccatcgagacgcgcctgctaccctatcaatgtgcccaccaccgacatccttgtcggcctcctctcctgccaccggcgcagtctggttcacgcactagcgcaccacaccccttgtataagagggagcagtagtcgtggccggatgggagcggtacaaaattctaccttcgagtacttgggatattagtgatacacaattttacataaagaatatgataccttctagtatctcctcaagaaaattttattagagatgcaaataaacttacatatactaaagtacaattagcaatcacttggtagctagaaacaagttcaaaatatggcaccaaatcttcatagcaaaactattgtgtttttctcttcgataatggaattaaactcagcctctacatcacatattatccgcccaccatagtattaatctagtttagttcatgaaccgattgctaatggttcgatcgagatgatagatatatgttggttcacatgacggcgcaggcgttggggttgtcgtcgctgaagagggtggcgaggcgctcctcctggctgggggtgaccggcagcacggcgtccacccggcggatgtgcccgttcggcgccttcttgtcgtacgccgccggcggcgccacgtacgggttggtgtaggggacgtacggccacagctcggtgcgcttccccgtcgactgcgcccgccgcagcacccgctgcgtgtccaccatcccctgcaccgtcaccttctgctgcttcctgtttatctccaccgactgcacccctgcgtccatatatatacgtactccataataaactcaccgcctcagctagcgtacataacctgacatctctgtgacgggttatagtttgaaaccttacattggaattgttacatatgtcggttccaaaccaaaacccgtcacagaaattaaatccccatttgtagaagtgtttcgaacactttttttcttggattgaaacaaattaacctagtcgatcgttttggctttcgcaaacggtggtttttgactaattaaatttggcttgtgtggagaccattatatattgtgtcagagagttcacgtcgtagtacctttcatgttggcaagggtgttcctgaccttgagctcgcagccgtcgcagtccatcctcaccttcagctccaccgtgttgaactgcctcttcttcttgtggctagtcttgccgctgctgccacccagcagcagatcagacaggtagtgcagcgtgcctcccatgcttctcaactttgcctctaatgaaagttactaatcaagtgcaaactctactaattaattatagaagaaacttttccctggaaagagataagagatcaagtactgtaatctctagctagcttgggtaatttggtgacatgctatttgtaatggctgcttatatatagacagaggatgcagggagagaatcagagaaggcaatttgtgcacatcaaggtcaggatgcagtgatgcagctaaggattagtgtgtgggagttgctggcaaagagctttctctgagatgcctttgttccttcctacctttgctttgctttcctttgcttcctcctacacagctcactgcacacgctgacctgattacacattttgccacacatgattgttcttatataggagagttccagctctcaaatgatataaagccatggccgaccactgttgataaagtagagatgatatattcgccccctgtacctgctcattaatttgaaaggcttaacaacataaaacaaacaaaaagaaaaatagaagtactccgtccagtcaaatatcaaatatttttactagagggagtatctcctcatccatgcttaccttgttttgtagtacagactggaatggccgaaaaacaacatgcccacatgcacgtgcaaaatatcttatttcaatacattattgtgcagtttgaaaacattattgactggattattctagtggattatatgtctacgtaattacaggaataaatatattaacaaaataacaagtaaaaataaaaaatagcttaaacaattaaaaaaaaagaattcagggcttcttttgaaacacatgattgagaaaacgaatgcaaaacaaagtattataaaacataagagaaaaaaaatacaagaatgatcgtttcagtaaaacacagggaaaaatagaggaataggatgaaacacatatactcaaaataaaattttagatagattgaagttcttgccaactttcttccaaaatatgtataagattgatcattttataagaatattaaaaaaatcaatcatttgtttcaaagacattccaaggaatttatcttacgattaaaatcctccaaattttatttgtttttcctaaaaatcaaagagtgcctcggtatgaaactcagaactgaaacataaatattccctgagctggtgaagttctttcggccggccttcacctaactcgatcacccatcaaaaacaaaatctcacttttctcgtgatgcaaaaatctttagaaagaacagtgacagggaatggtgaattttgggtatagctaggatgaccattccacaattgttcaagatattggattaatgtgtagacgtatatagaacgacattccgacacttttagtaaaatatcttcaagtggttaattaattcgtgagatgcatgggatattacatatatatactagtttctaaaattgcgactttgatatagtccattcattcagtaaataaggggagacctgaaagtgttgctctagttcctctagcacttaggtgcttggtgctgcctaaccctctttgaacggcagccggtcagtcatcttttcctaattaacttcattcgtcttttcgtccaccttaatttgcagaaaaagcgtgcaaaattgtgatgtcgtcagtcttcgtcctgccctaagtggatgcatgatcgtatagtatatacaaattaaagtactctaagtgctactccctccgtcccaaaatataagtatttttgtaccctgacacggtctccgagatactattttgaccaacaatatctataaaaatagtttgtttaatgataaatctagtaacatcaattttatataattgatttttttattttttattaatagtcaaagttaaaaatgtttttttgcgatgaaagttaaaaatgttgacttgtcactatgctaaaaatgcttatattttcggaaggagggagtagctaatacatgaattccaatagttaacaacaaggaaactacgaaaataaatagtttttacatctccttaattaatcgactatagcaaaactaacacagagagatggctggctagctctagtggccatgccatcgttagttttcacttaccaatgagcaaacaaaaagtatataatggcaaaatttgctctaaagtgtttgattgcaatttgttaaattacaatttgcggctaatattttattttattttattttgctcaaatggagacagaagattttagaaatgacacttttaccctgtggtaacttaggccagggttctatattttgaactgcaatttcgaaacaaagggtatttttccctactaggatatcatcatcacaaaacgtattaaatttctgagtttataaaaatttgtttagatttaaccaatatttatttattgttgctttacattttgaaattttcagaaaattcctttctattgccccctaaaaaaagaaattaaaaaaattttatctctgtaatttgggacaagttttcatgtttgccaaatttctttaaattcagccaatttttgtttagcttgatgctacatcatgcgaaacaactctaaatattgaccaaagatacatatatatatcttaaaaattgaatagcttccaatttggagatcaagcacggtcgctttaaaacttttgtaaaagcttaattagggttgcaaaatatactcctaccatccattcaaaaatatactccttccacttctcaacctggtctttcaagtcaaaattgtgcgcaaagttttgttcgtcatatttacgagagaaaattgcacgcaacaaggtgcttatatatgtccagtgagattccaaggagaagactttgcagtgtgttgagcgcgaaatttggcattgaagaagagaaaagaaggaacaaagaatatatatcaactcagcttttctcttttgttctaatttgactatatatgatgtattagtaagatcttgaccatctaaacgtagatgataagatcgaactagcttgtctagatgggacttatctccttaatgcctggctgaagatactccgaaataatggatggccaaaaatttatgcgtagctgaaaggccaccaaagaatatattgaccctagaggtgctacgaagcatgacaaaatgttggaaaatcatatgaactttaaaggaatcactgtccttatataacatggctcattgtcttggggttccttacatttgtcgattgagggaaatcaaaatataaccacgcgtaaattttcactcatatcctaattaaatgttttgaattaaatagttattgtgattacactattcatttactctctccgtctaaaaataaatcaacttttctaaagcatgacaaaatgtttgaaagtcaaatgaaccaaaggaatcactactcgtgcattatcttgggattcaaaacatttgtctattgataagaaatgaaaacataactattgcaagttttcattcgtttcctaattaaatgttatgaattaaatagttgtagtgattacatcaaacaattattctcttcatccgaaaataagtaaacttttgtatttgaatctgaacataattgatttatatacaaaagttaaattattttaggacggatggactaccaaagtatacaaggtctgtttccattaattttcttgttaattttcacgcgcttccttgtgttgttaagttcatatgcaccctaagcttcattctcattttatacaaaagagttaataataaatactcctacgttggagtatatggacatgtggaaccaatccacaacacacaccatatataccaattatatggttgtgaggtactacaaaccatgtacgactgcaaataacgaacccagggaatgatcaatgatgaacgtggaatatgacaatcgaccacttttacgagaggagaatatgaggctagcttaattggtgacgcactgtagatcgagctggaaattaaacagtgacctactacctaacttggaacaagtaccttccgattattaggccccacacacatcacaatctatagtcatgctaactaaggaattcgtacgtgtctagaattaaccattcgaattttgtgattgtgattgatcaacacacttgacacatccaattagttatgtactgcatgtgatttctgcatgcttaattttttttattttggggtttgatctatatacatttataatagaaaactctcaagttgaattaaagttcttctcatgaacagcacattattgtcaatctatccaatttttttcagctttccccccttattaaaaggtaaataaaagctcttttttggcaattgacttttgcttgaagttggttgtttttcatcccaaaactttcaaaaatcgaaaaattaacactttacaacatactgtattatttttagcggtttttgtttgaaaacaaagcgagttttttaagttcatattctttctgtgcacattttgttgatgtatatgttgcttttagggccacaactatgaaatggaagtagtagctaaaaaatattcgatggtttttctcccccaaacttttgaatttgtgaccaccggattgtcttgagatttgggcggcatacaaggaaaaaaactgcaagtcatccttgggagggagtcaaacccacaacatgtggcttcaaagcttgtgaaggtagccacaacttccgggggtaaattttgacaagttatgtataaactagattgcaattatagtaattattgtgtagttataatttaattacatttcaaatatgctatatacttatatttggtttaatgttgtttggctgatcttcaagtaaattatcgaatgttgtatggctgatcccctatgaaattacctaattgaagttcatggtagggataaaccactttcataccgattaaaagtttaaaacaccataaaatatattatggatgttattatttttttaaaaaagctaaggatgaaaaaaaaattggttctgtgttggaagtgaaaaatatattttgagcaaattcaattaccaaacatagacttttttccaataaggataaaatgtgattatatatttctgacctctggatactgtgcacacacaaaccaaccaacaaaaaccattgtcccctgtttgatcaggatgatgacttgcatattgtagcatccatcttgacatcgaatccatgataggtaggaaccacagctgcatgtatctcactactactccactcatcaacggctggcttttgacaattaagcgacgatccatggagcgcgaaaatagaaccgctcttttggaaaaaaaagaaagagagatcgagatcgcgtactgcgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctgcatgcatccggtggcaacgacggctctgacgacgactcgagaggatattaatattagtaaagccggtggctatatagcagcgcattatggctgtccctcttgcccatgatcaatcattgtgcatgcatggcttggcttcttatatactccctccgtttcaaaatgtaagactttctaacattgtccacatacatatagatattaatgaatctaaacacacacacacatatatatatatatagattcattaacatctaaatgaatatgggtaatgctaaaaagttttacattgtgaaatagaggtagtactagcttaactggtgccctgaaaaaaggttgatgcttttccacagaaaaaggagagcttggatcgatcctttgaggcatctggccaatcttgttctggcttatgcaacaatcagggtgtacacagacacaataattaactttggagctttctctaaaaacacatataaacgcatacactcaaatacacgcacacatcctatatatctataaagtttatcctcactaagtgtagtcaatactatttctccattctctcatacaaccacatcaattcatttgtttttaaccattggatgattgatctattatcttcattttttctcttatgaattttgttggatgacctacatatctataaagctcattcacactaagtgtagttaatgatatttctcttttatctcattaagtcacattacttcaattgtttttagccgttggatgattgatctatgattcaaattatcttcattcgtttcttctcctatgaagtcatatcactttaattttgcttttggatgatcaatctatattatcttccttcgttttccttagttattgagccatatcacattatttctgcttttgaatgatttaaattatcataaactatgtcatcttaattatttatattttttttcaatggtcaatcaaagatgaaaattatataaagttgatgaagttatgtcatccagttatcttatatactccttccgtcctaaaatataacaacatttacccctcaaaatttgtcctaaaatataacaacttctccaccaacattctcttcccaaccaatcacagctctccaccattcacttttcccacctacctccactactcaaccaatcacaacactccactattcacttctatctactttcttaataaccatgttcaactctaaaaatacttatattctgggatgaaggaagtattatttatactattattatatagaactctcacagcaacacgcagggtttcatctagtttactgaagggtgtcgagtctacaatttaattaaatccgagtagacagattctaccataagaaatttaatcagttgagatacgctcactcatacatttaattttttcgatgcaatgttgtgttgggggattatgcccaagattgtcataattaaggatattactagagcggctgtaaataaaagatattttggcaaaatgcatgaaaatcgattccgtgaattggatcctgagataagccttcaaattgagccattgaggtaacaaaataagtccaattttcatttatgatatttggatatatgcaattaagttcaattgaattggggatacgtctatcacgagtcttgatagtactagataacagatttagttataatttaacgacgtattttgagaagctgggaaccatcacatgaaagatattaaaccttcattcacaaatgtgcagcaaaatcaaattaatcccacatctaataacacatgttttgtcttttaggtttaaaacctaattctcctttttggacagcaaggcaccagtggtctagtggtagaatagtaccctgccacggtacagacccgggttcgattcccggctggtgcatgaacttctatttttttgggttctagcttttctttagcgaaaattttgacgaaaacaaacaaacagccacagtttcagtttttaacagaaataattccggcgaaaattccgaaagacatctccagcccaagctctacataatcgtaccaaatatttgtgaaaagaagtagatgagtgagaattgaacactgtgggctggttacagatgagcgtacgagtctatcttgctagcttgcatctttggttatattaatggaacttataattatctagtatcatattatgtgataatataatattatgacattattcggttatatatatatgtgctaaataaactataaatgatatgaagtaatataatcatgtattataattaagtatgtgatattataatactttatttctgatacgaattttcaccttaacattatatttctttttcgacaatcccatctccaatatccaatagatctgttcagattatattctcgagaaaaaagtaatgataaaaatggaagatagatttgttcgaccattctcatatatatctagccagtcttctctttctttttctttcactctcgtaatctattattctaaagctggcagtgcttgctgccatttgattggtccgattggaaacacatttatacgtcgacacgtgtccagctaaaattaatgcttagtcgcgattcgtggggaagcagcgcgaggaatcgcacggagcaccgagcggcccatcagttcaaccacagatgtcgaaggctgcaactgcaaagatggttggcaggctgtcgcaggcctatcgagtctaactgggcacctggatgcccaataaccacacatgcacatgtagtccagtccaaataggtgaatgcttttgtgtctatgcttgtggtatatataaaaatatttaatttagatgatcacaagattttattcacataccaaacttattggtgtgtatatattagttattatgcaccctaggcttgtgcacacatatttcctttttaaaaaccaaaattattgatgagtcaatcaattgataatttatttttcaaaatatcaaataacaaatgcaagtaaatgtcacatcatgccaaacgtatatatgtgcactcaccgtacatactatgtgctgccctcggttacactcatttttaatttgtaatattaagggtacttgttttggtaacataaaaacatgagataacacatggaataagtgtccaattgcttggttttcataataagctgaataaaaatatacaaggtaacaaaaatatttgcctaaggaaaaaatggatttatcagcttttagcgaggctaaaaataggtataggtgattcagaaaagaattggcattgtgccacacaaaaacactatatttggattctaattggacaacattagtagtttcggctcaatttggagcacttaaaacgtaagagtttatagattatgtttgcacaacgccatatctcagacaaaagttaaatttgaagtttgtatgataaataatagtgatttaaaattatatattttatctaggatgggaacaaaataattcatcgaaagataatcttaaatctgaagtagtgccaaacaaaggccataatatacgtgggctaaaattagctagcgcgtcaaaggacgcgcctattttctagtgttgtactgaagaggatgcccaaattaatgagcataggaagtccatgccctttttgtcccgctctcgcgagcttatcaagggatacaataataaacttgttatatcttataatacaaattccatgcaaacaattgaaagaagaattgtgccacgtggcaacaccggtttcacgggatggctcgatcctgctaattgcgcgcgtgcaagctatgtgatttctcgcgttgctgccgtacggctggcaaagctcaggcagctattgcttcctcctaccaccggatattgaggattaaagaagtaatgatacatattttggttagagactaaaagaggattaacaagatgtaatcaaatcacccactaaaattcctacgttgcaaacatccatccttttacagttattgtgtttccttattttgtatccgtattcatgtgatttatattatttctttcctgtgttttcctctatggaaatcatataaccttttctctttggggcaatttcattcttacccctactttaatgtttaatattgatgttgcccagtattttagggttatttttttgcccatagttttttgaaataaagataaatttagtccctacttttgatggacagattaacgatgttaaatctttagcgagaaggcattcaatacccttactcatgttgcaaacttcccctgtttttgttcatgattgagaatttgcccacatttagcacatgaaccttgcaaattcgataaacttttacccaatatgataattttaacataaatatcaacaaaaatttgcttcaaaatttgacatcttgaaaaaaacaaacaagtcaagcaaatctattgcctacctatgccaagctgtcgtcgtcgtcgcctcctctcataaaccgccgccacctttgttgcctcctcttcccaccgagccgccgccacctcctccccacgtcgagccgccaccatcacctccccgcgctaagccgccgttgttgcctcctccgatcatcgagccaccaccgccatcgttgacctgacctgttgtcctcctccccgtcgcctcctcgacacgtcgagcagccgcacctcctccctacgctgagctacagcagccgccattgtcctcctctctaccatggcctcttgtgcaatgcctagcctcctcctacacgttgcaactgggttgggtggcctacacttgctcgggtcgtccccgttgcctggccggcccacggacactgccgccactgtttcacaacggggattcgggtttaggaagggaagagttgatgccaagtgcccaagcttggagggacaccaagcggtacatgcatattttctaggggtaaaagggtcaatcaataatttaaaaaatcattatctctttctttctctaattctttaccgcactaagtccaatcccactcacttccatcaaaaacaggggtaaacgcctcattcattgaaaaaaatagggcaaaaaacaacaaccctaaaatgtaggcaaaaaacaacaaccctaaaatgtagggtaaaatcggtattggacatcaaagtaggggtacaattgtacaaacaaaattgtccctttctctgttctccctcggtccaatgcaacctatatatgtcttgtgagggctactttgaaacgaagattgagggatgaataggaaaaactagaattctcacaaaaaatcaagcgcaaaacaaagaattataaaacacataaaaatatatgaaataatcgtttgattggaccgtacgaaaaatgcaagaattagatgagagagataaactcataagagacttcgcatgatattgaacctcatgttaaaaatactccaaaacttgtatgaattggggcattccttagaaatttgataagactcaatagttttcaataatcctttggttcaaagaatcatatagaaaaatttcctatagcaaagtttatcgtttctatacagaataaaagttcatatatttttctttcaagtaaagggaccctaattagttactccactaaagtcgaatgagctgggttcactttaccatgcgtggcgaagccacgtggtttttctagtttttctagtgaataccgtattcctcgtttggtgcggtctgtaatacaaatagctttagaactttaattactacctcatagtgttttgtatatgtttagttgttggcttttcggactaacaattgatatgaaaccttacgatctattaggaacggccatttattatggctatgctgaacgacatggtatttgacaaaaaaaaaagttgggttgatgggatttggttgctatggcatgtcaacatttggagcggatggtcaaagaatgttttacatagagcataaatgtaacactccgggtatcttttacctataatgctacacactacggaacaaaaaccactaagttctaaattcattaaaattttgacagtctcccctgtaaatatggacatccacgacaggcagttacatattaaataattaataatatcattcccacagtacgatccatccttataatccacagaaagaaacaaatagatatctgaaagattattataataccaaacgaggatatagtttaaatgtcattatagacctaagcaatatagtttgatagtgtgcagataaatgtgtatataagggtgctacttcccgcccaagcatgcccatctcaatgtgtatctaaaaccaaataaacacaaaagtgagtacataaatactcagcaagtacaatataacacatacacatattggaaataaagaatgagcagaaagttttctttctttgaaaaagaaattgcaaggttaaagaaaatagtagttcccatttcgggcatacatgaaatgaagtagtagtttctatcccggacaattgtgaatacagccgcgcttacccataggaacataaataaaaaccagatagcacatcaatgactcgcatggaacatgaataattgaaaacggaacaaagaaccaaattgaaaccatatcgcacatccatggcaaacataaaacttgaattatttaccaagaaccaaaatacagattattaaaataagaataacatcgtaaacataagataaacttaaaatctaaatggcatgaacaacagtctgcacataagcagccacatatcacatatagaaatacaacagaaataaatagatagagcaaacaattcatgaatcacacaactagttcgtcacgcacttgcctttaaccttgacgataacccgatgaaccaccttccacaccagatctctccacacctatggagcaaaactacgaataaatccttatattcaactaatgatagttacgagatatttactaaaatcgaaacttagaacatataaactttttactgatttgtattaaacaacctatagtagtttcattactgttttatgcgtaactcgcaaaccatctaatgaaatctggcaaccaatataacttcggtcatctagacaaaattttctacaactttcatgttgggcgaaaaatcagtttactacttttctaggtctcagattaaggaaaaaagaattggtgtcactattttcatacccggcagcagtactgcttttgttgtttctcctaagccgtttaccggaatcgagcaaaactagcaccgttagaaagatatcgatgatgaatacaaactttatttaggacaactaacctgaatcccgatgttttaatacctttcaaaatatattttccagcctgcaatcaagaacctcaaaaattgcacgagcggctatcgaatcaatttatatttgaatcttatacttctaaggagtaaacaaaagtaccgttgcagcgaggacactagaatttgagaataaacccactagttacgaaatcaccgaaatccccaaaattgctcggcctttaccttcccttcttcctcctgttctcttgcttcctctgcactatgcacccttctcctctctgtccgatgcagtagcagcagccccacgaaaccattagtagcagcaagaaacaaccaaagccacagccatagatcagatcgacagcagcaggagctcaccgggaagaagcaaaacggaaaggagccaccagttgcgatggatgacgatggctgcggatctccagcaatggccgtggtggcggcgcaaagacggcggtggcaaccgggacgacagcagcggcagcaacagctagcgcaggagtggtggcggctagggctggctgtagtgatctctcgtttttacctttttctttttttttttgttatataaagagactaaacaggagatctaatggcccacatcgtttcaatccttgggacttcgttcgaactccaattactatgaacttatattctattttgcactactcaatgagctctacgcatccatggttcctaatcgcctattcgaacaacggtttcatagttgaacttttgcatttttgttgtaatatttcctgaaatacactaattcaaaactcaggatattacaataagcgacaatctagtctacggattgatggtccctagcatttcttattcgtcctggtttaaaaaactattgtgtgggtgaggtcgggagcatttgcagtacacttttatctattggaattaaaaatatatgactcccacatgtaaaaagtgtacgataaataatagccatgatcacgagttgaattggcaatgaggttttggtcttctaaacaatagatagatctaattttctccaactagtaacgagacatagtggattggtacgtaaccttctttgaggacagaatcctatatttatgggagaactaagttgctggatttctattgcagatctaggtgccaagcggcagtggcctggtgaagacgggtgcccttgaccagtagtggacacgcaattgggtggaggaagccgttaggtggccatcccggtggtggggtgcaagggagtaagtgaagatggatcctaacatggcgtggatctagaagtgctggcagaggatgttggagttttcaggcgggtttcgaggttgtcacataggtagcgctcaacgccgtcatgatcatcgctaacctatcactctactcgctagcgttatgcgcggtgccatgctggtagatagtgggtgtgtcatcttcggctgtcacctataggtattaagcctgataccccctaggtatcacggctgttacccacatatattaggcttggaacctgggtctgatataagggtttgataccttcaatattaggtccggtacacaagcacctattggtacccatagatatactagcttggtactacgttttgtacaatacatgctattatcatatcttgtatcttagactagccaaaaaatatcagagggtagtgataaatgagattattggatttatcggaattcatcggtgatagacaaaaaattttggacaaaatttggaaaaaaaattgaagaaaatttgttaggaaataacatagattttatccaatccattttttattaaaaaacaacacatatatattctgtaaatgagataatatcaacattttatagtgcacacacagcaagcaaatggaaccgaaaaaaaaaagagagaacaaaaatcgtggcttcgcttgaagcaaactcgaaacctgttggttgagagctaccgcttgtaaccaaggcatcaaagcaacttctatagcaactatcgaggctgtcttttatattatagcaggaaattcaagatagaagattttctcggagggtagtgataaaagatgtggcttccctctacgtggtgtacgcctatttgcttccctttcaccggtggccctatttcctgccttcctgggccttgcccctagtcttctgatcatctccatcgtagaagagtttcagactccattactccgttctctcggtgacaaaaatgaaacaccacggctaagaacatcaatcctcacgcagttgtgaatggccattgtttcctggtgatttatgtattcaacttagaagctactctctccgtttcaagttacaaaatgttttgattttgatcaaaatcaaactatttcaagtttaactaaatttatagacaaatatagtaatatttataatactaaattagtgtcatcaaatcaataattgaatatattttcataataaatttgttttgtgttgaaaatattactattttttctataatcttggtcaaacctaaagcagtttgactttgaccaaagttaaaacatcttataacctgaaatggagggagtacttgatttataccatctcaatcaactttgcttactgatagatgaacacagggataaaggtcagcaagtttttctttcctgaatgtgtagcagttaatctgctagggattcgtttcaatttttacgggaataattaagactagaaattaagaacggtaagaataaataaaataacgcaaggaggcatatatcatggtgtctcatattgtaatcaattaatgatctatccagctgcttcaacctaattaagtcatcctctttgatgccatccatgtcttcgatcgtaagcaagagttatcaattaatgtttgggaaggtttagggggcgatggcactcactggtgaagaacccatcttcactcccgatttacaacctcattaagtctcgggttacaaaccggaactatgaactccagaactaaagatgtccatctttaatcccaattgaaataactggatctttagttctggttggtaatcattagtaccggatggtgttaccaactgggacttttttttttttgctattttgcatatcttgcgtccgatatccccaacaacaaaatatcatctcccgacactccaaatcatccacaataacataatcataacaaatcatccacaacaacataatcccaaatcatccacaacaacataatcattctcaaatcacagatcaaatgaacaaattatcctcaacaaacaatcattcacaaattaagagggaaaaaggaaaaaaagaaagaaaataattcccacggcgaccaccacggccgccatccgtgccgaccgctgccctcctcgtgtgacggctccaccggccgccgccgtctgccactgctaggcacggccctccgcgccggtcgcccgcggaagggagtggaggaggaggaggaggagaggggataaggaggatgcgctggaagagataagatcgaggttgggagaggaggcacacaactcgatttttttaatcttggtcccagttgttataaccaaccgggactaaatatggatctttagtcccgtttggtaacacaccaattgagactaaagatcatctaagttccgtggtagttttaaaccggggcaaaaaagatatttagtcctggttaatattggaacgggactaatgtgatttttggccaacccatcagttctctactcaagaggatctccttgtaccttgctattgcgatcgtatcctgattcctgaagagcttgcacctgcagcagcagacagacgctgtgcatccatgcctccatgacggctatgagaggcgagggtccaaccgattatcagcgaaaaagttcaggcagaaactattttggaaggctggagactcgattttatatttatgtttttcttcggtggaggagggccaccagtagaacgataacaaatgggcgtatgccacgtagcgggaacagggatgggaacacaaaggcacagcccgagagaggcgtttttgttggaccaattttgcacctatccgataacagcgagaaatccgttcgttttcgcagcaaatcggccagtctggactctggaggctctcgctcgctcttatcgatcgatacgaccagaccggaggccatctcactccagagctcgcgggattttttgacttgaaaatagcgtgatcgcctctcatgtcatgcagatatcgtgatgcgtgagaagaaaccgtctatcctcctataaactctcgagcatgcagtccgttgtgcattcgtgcaacgcggttaagttagttgttgttgcgatccatagatagagctaaacccctaactagtaactacccagagagaactgataaggccagtgtcgagctagccagctgacggccgccacagtttgcttgatcaaggctgatcgatcgatcgatggacatcaccggcgcgggcgctatgggaggaggatccacggccgccaccgccgccgcggcggcgggggccgggtggaagacgccggtgtcgatggtgctggtgcagctgttcatcacggggcagatcctgctgtccaaggtgtccatcggcggtggcatgttgatcttcgtgctgcttgcgtacaacagcttcttcgccgtcgtcttcctcctccccttcgcgctcatcttcgagaggttttaatcttctccggtttttatttgtgtgtgttttaaagaaattttacgtttcttaataaagtacctcgaggtacctaaatattacactaaatattacctaaatccgaaggtatcaaattttacaccagaaaatatgtacatcctgataatttctcaggatgatgaaattatccgtgtttttatgatcagcttgccgtgaatatttgcagatttcgcatcttcagaatatttttttctcttcggacaaacattttacaaaactaggatatcggaatgagataatttatggtcatccattagtgactcttttctaaatttattgaaaaatcattttgtaatgtcaataattataaaatgtatgtctagtttaagttgcgaatcaattgattcaataatgaataacaccacatgtatacttctgatcgaataaatggataaccctggaattaatcacccgctaagaatactgaatgtgattgtaattaagaaaagtaattagcagcggctgtatgcattctaaaatcgggtttcatggtgaaaatttaatatgctgctaatttggttttgtgtagaggcaagtggagggacatggattggggtgcattcggatggatctttctcaatgcgttcattgggtatgtacgacatgtgtatctgaaccttcaaattcagtcaaactgtccataattatacttattatttaggaacaagtccaaataacccctaaacttggaactgaagttcgtttagcaccctaaactttaaaaccggacattcaacccccctaaactttataataccgtttatataacccctaagatggttttgcatagtagggtttttatctaatttatatataagttggatgagtttgatcacatatcatactctttggagtaaaattttgacttaaatatttatttttctacttatgagctctcacttacaaacaagtacgtacatgataatagtatgatattactgaataagaataaattgatgagttgcaactgatgatatgcaaatgtgttatattacttatttaaaattgttcgtttaagcttccaaaatatacaaaaccatcatccaaaaccaccttagggggtgatatggatggtatggcaaagttcggggggttggataactgattttaaagtttagggtgctagacggatttccgtctaaagtttatggatgtatttggactttttcctattatttatttattgtgtgtgttgattcgatcgatagtacatgaagatccattcgttgacacgtctcacctctattattactcttcctatcgttttttcataaaaagagagtatggtttgaatactattcgtaacagtgagttaacgtcgaaaaatacctgtcctttgtacggcttgtaggttgcaactcacctacgtgagagaaaattgtaaaatataccaataagctagctgtgtagaccagacaattttagataattagttatttggaggatttttttaaaaaaaaataattggtttgagactactgaggaagcaccgcagcatgatattaatatatgatgatatttcaaaaacatgcatgattgtataaatatgccagctccacctcctaacaactctagatatgaaattttctccaatgcaacgatagcaaacccaagtaaattgggagggagaaggataaatttacactaacttagcattagaacagagtgctcacttcttggttcttaacttcatcacttcccttatggaaaagattgatttcacttgtccttccagttccaggtctgtgttggacttcggattgccctctatttccatctaaccatgtgcattcagacaggcttttgcacataggattcaattttacagaacaattatgtaacactaaaagcatatataaatttttagatttttgtttgtttccctctgtctgtgcatccaggcagcctattgcacatgtaattcatctttgcaaaaccattatgtaacacaaaagcatatattttaaagcagaggttgataatattcttgattatatatactctgatatttctctcaaaatagttctggcaaagcacagaagaaaataattacacatttattaacattaaaatgttttgactatacaccttctgattttggttgtattcgctccttcttaaaatagttaccttactacaaatgttactatattttaaaacagagggagtacacaagcacataatttgttagaaggatttgttgcacaaagctgcaaactctagatatgtgcttcaacaacaaaaatgaactcataaatctgctaagagcttccttagaaggataacagcataaactttgatgaaagatttttttttcaaaaacaatgatacaaatatagaccattagtctgttcagagttgttgtgataaataaaaacttagcctccaataataagatatttatttactgataatagtagcaatttggtgaaagactctactgcatatagagccacctttatttaaaataaatagaaaaggcaaagatgaagacattgccttatttattgatagagaaggggaaataacatcaacccaagcaaggataaacactaaaaaaccatcaatttgattatactcaataaccaatttcttgatggctatttattacttcctgagacaaattatttttagtttttcttctgacatgccaaaatatgcaggtactctgtgccaatgagcctctactactatggcctcaaggataccacatcatcctattccgttatctttcttaatataactcccctgttcaccttcatcctctcacttatgttcaggtaagagtctcactcaactagttgttgtatacgatgtactacttggtaactataggttccaacaacaacagttccatatcatgcaaaaaaaaaaaaagtcatacgggtaaaattcaaatcgtgtcgcaaaattaatgttccatctcattgaaacatatgtatgaacatgattataggttggaggcattcaaacttagaagcatacctggagtactgaaaatagcgagcatactgctttccattggagggacaatgcttataagcctttacaaaggcaagtcattgcatctctgggattctatcatacaacaccaaaatgaacacaagtcagcaaccaatcagctaagaggaacaattctattggttggcagcagcttcacctttgcttgctggtttcttattcaggtaatcataaacattgcttctaataaagtatatatatttagggtaatttttacttctttgagaaggtattttctagtgtaaaactcggtaccttgagttacttaatttcttaatgcccataaaaattctcatatatctatatattacagtaaattttatccccatacaatgacatcttataactattgtcacagtcaaagattctcaaagtgtatccatacaaatattggtcgtccatggtgacatgcttggttggagtatttcaaaccgcattggtcggaatcatattaaggagagacaagagtgcatgggagctaggatggaatctcaaccttgttaccatcgtgtacacggtataccttcaaccttcctaacccttgaaattaatttagtgagctagaacaataaatatattttataaaataagtttttttttctcggtgttcagtgatgcttaaaataagaaatccatttgcaaagaacattttgttttctgttttttggtgtccactaaaacttgaattgtattaactaacaagtttagagttatggtattattttgggaaagatgaaattttagggaatgcgtaggggactgtcttagggatttgacatgaaaaatattttggtgtagggggcacttgcaacagccgggaaatatatattgaattcatgggcaataactaagcgaggcccaacctatcccacaatgttcagtccattatcagtcgtcttcactgttgtgttggattcagtccttctaggaaatgatattacaattggaaggtcagttgctttcatttgtgtctatcatgcatgtttaatgttgcaaaaggaaaatatatttgatcagttaatgtggcaaatgtaatcctttgccaaactgaataagactaagtttacatagcaaaaggaaagtaaaccttggaaatttcttatgcatatttccaagaaatattatacataataatcagtacaaacaacggcaaaatggagaatcaaagaagtcggtgatgtgaatagtgcaagcactttcaacaattgcagcttgtccttttcaattcacttttacgtttacaaaaattgtgaagcacacaaaagatactagtataacatagatgactcttggaataatttcacacaaccacatgtgttatggtgcaagttatgaaaaaccacaagagtttaggactgcacataaccacaacaattatggtattaatgatttacaaaaccaaactcttacacaaatttagccattcttatgtgaactattccaccaatgattagccacactgaccatgtgcataagaatagctaagtttattaatagtgtgcttttatgaaaaactaatatcataactgctatggttaagtgccaaatgtcaaacatctatggttttttataatgcagaccataaagcatgtggttttgtgaaatttactgttttactttgtattcctcgaaactatatgaagtgtatttgcagtacagtttattttttgaccattggcagcaatagatgtaattgttctcctattctcaatgtgcagtcttctaggcacagcattggtgattgtcgggctctacctttttctctgggccaaagcacgagaaatacctaagaagtcaacatagtatattctacacaagtcctggtagctaaacaacacataggagttatttatgtacacaatgagatgtatacagcacagttatttaaatgcgaaagtatcatatacttgagacggatagcttataatgtttgtttatttgttgttaatggatactattgtatttcataacactgttaaaagaaaatattgttgatcagcccctgtcctcttactactatttctttacacctataaaagaacatgttggtggccatgaactcgtgatttcctggccatgtccaatattacattcgttcacttaggccatctttggaaactacgaatagcaaaacaaagttagaaaaagacaagatttaggtagtttgcacatgcaaaacataggttaaatccaaatttaaccgtttggacaggctatagaaaaaacacatgcataagagaggtaaaactaaagaaaattttctatgagaatgaacatcaattgaataagagggtggtgaactatgaatccaccaccaagtttcaataaaatgatctcaaaggttgaagccaccacacttagacatcatggcaacatgacttgaaggagcgatgagccatccgtgtcaactgcgcccgctaagcaatggtgattacttccgtatttcatagtcgatgttacaaaatatggatacacaaataactaataatgcagtattatatatttatagtatgcaccatcattattcacaactcataatcaagtgtaaaagaagcttagaaaataaattaaaaactaaattatacttgtaacattaaatagaattaatgattgctttccgtagcctaaaatccaagaaagatgtgaatcaagatttaatttagtattgtgcaagactggcacactttaaccatagcaactttgatcatgtttgatcgtcgcatttcactacatgcgacaccataacggacagccagagtccaaaactattcccctatttctattttggcaaaatttgccacatgacatctaaaaatcatgtaatttgttagaagacataaaaaaacgcgacactgccaatggacactacaaaatttgtgtaattagctttaggacacccgaggcaatattttattattttcggtgaaaaagaggagagagaaatttcaaaaggacggaaatgccctcagcctcagtacctgaaatccccatccaacttcaactgcggcggcggcttcggctggttgcggcgttgggaagcgacggcggtggtgatggctcggccggtcatggcgcaccaggagctcgccgcgctgcaggaccagcaagaccatgagttccgcgctgcaagagctcgccgcgcacgccgcgaactccggcgaaggcgccacgctgccgccgtggtgcgtctcgaagctgagccccacggcgccgtcgccgccgccgcaggccgcggtctgcaggtcctgttctccacagacccgtcgccatggatccagctcaaacctgcacacacatcaacaagaaaccaatcaacggcaacaaatcgatcaaatgcaatgcacaaatcacaatggcgatggagccgctcgccaccaccacccgctgctgcagccgctctgcaacgccgccaccgcagccacggcgcagagctcggccaagtccgcaccaccgacgctgcagccgcactagcagctgcccgctgccgccacgcatctgtccgccacaatgcacctgtccgtcgcgcctcgccgtcaccggcggtgagaccctggcggagcgccgcctctttttccgcagcgcgccgagccatcccggctcgggccgtcgcgccgttcctccgctccgccgcgtgcgtgaggaagaagaggataggagagagatgtggactccacttatgattaccaaatagtaatcaccctactaattacaaataaattagtccatgactcgtagacccatgtggttaaaaacctattaaaaattagattaaagataggttgtcgatgacatgtgggacccaccagtatttaaagaaggaaagagaaagagcaatccgggcatttagataaatatctcacttttttttttacctaaaaataataaaataatacgaccggtgtcctacggccaattacacgtattttacgtgtcctgtggcaaattttgccgtctattttctatgctccacatttcattaggcctaacagttgtccacaccacaccaccgccacgtgtatatatgagtgtggaatgctcaatcgtccctgataattgtgccaaacaagaaatgtttttgttcgtgtggttacacttggatgagggctatccaaggacactgtacgtctttgtaatgtagggcaattgagaagagaggtgcttcttgtcacgtattaatgcctggcagtttttaacattaatactaaaaatctcgcaatatgtgaatcttcttttcccgattcgtcatgcggtgcgtgagtttatgaccccagtgacccttcatcaccctagtgaccccaatgacccgtccgaaaataagcgcagccatgagtttccgtgttcaactttgatcgttcgtcttatttgaaattttttttatgattagtatttttatttttactagattataaaacatgaataatactttatgcgtgactcatgtttttaagtttttttaaaaaaaaattcaaataagacaaataattaaagtttaacacagaaatttatggttatgcttattttgggatggagggagtataactatgtcatgggctcatggctgcccctaccctagaacatgtctgacaaactgcccatgaacaaaacaatgtaatatcagtattgacaccgtgtttagttgcaaacttttgtttcaaacttccaacttttccatcacatcaaaactttcctacacacataaatttctaacttttccggtcacatctttccaatttcaaccaaacttttaattttagcatgaactaaacacaccctgagtttccttgcaatcatgtaacttttggaagagcgaacaacaaagcagtgctaagagcatctccaagagactctccaagctaaattttggccattttagcaaaaaatctcactccaacagtctcataaaaatctcactccaacagtctctctactagaatggctaagccaaatagctggctaaattcctcccctcaatggccaaacttggccagcccaaacagcatagctattcgtgggtcccacgcgtagagttttctctcaccctgcactacccgtgtcctgaggttaggatgcggtggtgggacggcacgacggcgagcattgccaaggcctcccgctcgccggccgccggcatcgagggcatgaagggagcagcggcagcgagatgttgtcatcgcccctcttccttgccgacgccgtcgcctccgccctcgaccgcatccgacgtcgccacccgcagccctcccatcgtcggccatccagcgccgctgtctccatccacgccatccagcgttgcccccaccgcctccactccacgggtcgtcgtagagagccaccaccgccgttgctggcctagagaagaggaaaagggagagagaggaggaagaaagtgtagtagaggctgacgtatgggtcacagtgtcataggctcataatggagagtccgagagtgtaaatggagaggctgttggagcgaggaatgagtttggcttgataaatcaactggagagctagctatataggtgtttgaagagtccgatttgaagaggttgttagagatgctcttagaccatgataatattagcagcatggataaaatgttgtcgattgaaaacctaatcaaaagattctcagaaaataaatatcacaggagagaacttgtacataagcatcccagtttaacgcaacttcaccataccaccacaacttaatgctcaaggcaaattccatgataaaaggtaacaaatggagattaatatttaccagttagcaaaacaatgaatatcagcacctagaaatagcaacaatccctgcccagctctctgggtagccaaatttcttttttgaaatatgcttccatcaccataaacaaaataaaccggtaatctgaaattaatcaaaaacatcggaattctgttcagtttgagagtagtctcgtagccaaattcagatgaagcacaacgctaacagagtaacaggtaatgaacaaatgaagtctaattttagtattactgattcagaagagaacagagagagagagagagagtcataatcagacactacaggggcaaacaatgattctttttcattgccttcgcatttaaagataaactggacaggaggataaacagtgagattatgcattaccttcatgcacacaaatattctcttgacagaagcctactcatatctacaatttccaacctctgcaacatgccatttctcaaaggtacacatgaaaactgaaagcagttcatcaaaatgaaaattgtagaaatataacttacggttacctgccccacttttctatacattgacatccattatgtgtatcatcagctttcatgttgcttggatgatttagtaaacatcatatatgctattctagctccattttggatttgtgggacaaaaaatagaatatggtattcgacaattcaatccttcaatggttcacaaagataaggcaaacaatcaaactaatccactctaacattggctcattatgatcaacatcaaaagtttcatgttggacttgctatacagctattcgtctcaccattatttttctcatgtgtcatcatggttgttccttttctgtaacatttccttcctcagatcttctgccttaatttcatttccatattttgagtaggcctcaaccatgatattatgtattgcattactgggtacaacattattttgcatcattttctgatacagatattccatttcatttaatctccctgcaccacctaatccgctaataagttgatggtatgttctcaccgtagatttgatgccatacttatgcattctttgctgaagatccaaggctttatcaatattgcctctgtaacagcatgctgatattaaagtattatagctgacagcatcaggtatcaacctgtgattacttaagctgttaataatttcctcagcttcagatatctgcgactggttgcaaaggccttttataagcaaattgtaggttactatacttggagatattccgttactcttcatcttctcaactaaaataaaagcctgatcattgggaccatgctctacgtatgcatctatgatagcattgtacacctgggcatttggtaaaacatctttatgaaacatatcatccaatatagctacagcttctgggatttttccattcttacaaaaagcattgacaattgaaccataggagacaacatttggttttagcccattctcttgcatttcggaaagaacaatgaaacatttctcaagttgcccagtccttccataagcatcaatcagcgtattgaaagtttccacagttggattcactccattgtcctgcatctccattaacagatcttgtgcattggtgattctttcagccttacacaaaccattgattagtgcattgtaggtaatgtgatctggcttgatatgccgcgacttcatctgtccaaaggttgagaaggccccttcaagctctccagtctggcaatatccattgatcagagtgttatagatcacccttgttgggactaaccctgcatttaccagtgactgaagaacctcttcagcaattgaaactttgccatccttacacaggccattcaacaagatactacaagtgtaatctccaattgtcactccattcttcaaatattttccaaacaatgaaagcattgcctttgagtcaccatttcttgagagaccatcaaataaaatgctatatgtgaagccatcgggcaccatcttttgtgatgccatttcatccaacaaggctgacgtctctcccatcctgccagcacggcacagaccggacaggagcacattatacgtaatcgcattcggcttcaagccatgacacaccatctgatcccgcagcctgaaaccagcctccaggtcgccgcccttgatgtgcccatcaatcatcgtattgtatgtgatatgattcggcagcacggccctctccgtcatttcatcgaacacctcaacggcgtcaccacccctccctgccctccacatccccgcgatgaccacgttgtacgagaacgcgttgggcggcggcgcgccgtcgcgtcccatccgccggagcatcccgacggcctcgccgaggtcgcccgccgcgacgcacgcctggacggccttgttccacgcgaacgtgtccgggcgcgccccggcggacgcgaggatcccaaacgcgcggcgcacgtcggcgtggcggccgagcgagaggagggcctcgaggaggaggttgcaggaggagagggatggcagcggcgcgcgggcttcgtcggcgaggtcggacagaagccggagcgcgccgtcggggaggcggagccgcgcggacgcgacgacgagggcggaggcggcgtcgcagaggaaggaggaggccggatgagggtctccaggcgaggcggatgcggatgcggatgcggcggcggcggcgacggcggcgagggcgtggtagaggtcggggacgacggaggcggcgggcggctgcgcggtgaggaggagagacttggcgaggtcgacggaggcgtggaagcggccggcggcgaggagggaggcgagctcgtggaggtgggtggcggcggccgccgcggaggtggagcagagggagcggcgtgggaggaggaggcggcgagacatttgggaggagcggccttcttcttcctcatcagttcctctctctccccaaaggtttttttggagtttggtggggtataggctgtgttatcttcaaactttcaaaaattgcgtgacatcaaatgttttaactttcgaaaattagtctacgtttaatactgtatctgtatacgtaaaaaaagtttgatggagaaactaaacacggccttaggccgggggttctgcagtgtagtgtccgacttttatggcttttttgaaattcaaaaaattgataggatttgttggacgtagtttgtcatttcttgacgtttttattgtttagtaatatcgccaccatcaccacttcattaacaccacttcggtgggagatggggaactagggattggtgtgctagcagagcaaaagagggcagcgaggcgattttgccttatgctggctagggagattgggatgggtagaagatggatgggggaatttaggggcggcatgagtggcttcgaccttacgggagctccgaggcattttcgcgtgcattgggcaagatttggcggctaggagagggaggcggtgcacaaagctgtatgcggacggaagaggaagacaaggcgttgggtgcggcgttttcgtgcaggagatcgaaaggggtagaggtatttttgcacaggggcggagctagagaaaaaatgagggaggtttcctgactttctctgtgtaataccggtatgtataattctaaagtgatattgtactaaatagttgcgtacccaatacttataaacatcatctctctaattgatggcgatatacaacaagaaaatgcatagaaaaattaaaaatatgtgtatcataatgaagaaaccatcttataacttgccacttgcccctccgttgaatgcaagcaacaaacgctaacttaatcaataatcatgggttatgggtagtccagcaaaactgaaagaggggaacaacgtgacttgacttaccgattagattttgaggctgcggcctgcggaggtggtccaggtggagtaggtggcaaacgacgaactgctggccgacgtcgggcatggtaggggtaggcgataccggcggctggcacaagggcactagggcaggttgcactgccacaggcatccagggctgatccaggtgatacggacgtctccgtgtcgggcaagatcagcggtagatcgagacggcgagagattgagaggcgagggatgagtcacgcgttttgatttttggaagatggaacgatgccgccctgatttctggtcgccgattcgccgccctggctccctgatgagttgtcgcgcgcgcatggatcgatcaaaacacgtgcagtgcgactcctcatctcctctcggctaggccttctccaccaatatagaatctatgggctggccggctgggccttatcgagtagaagttttgggctagacaaatggaggggttcctcagtttgggctagaggggtgcccatgtggtggaggtataggggttacaagctatttcgaattttaggtcgggttcctgggcacccccctgggtctgttgggctccgcccctatttttgcatgcgagagaagaaagaaaaccgagcgaggcggcagtgtttgcttcggcgcgcgagggctgagaggagaataggggatccatgtgtggcgaggtgggcggaggggatcgagagggttctatgtgggacccatataaacatattttttttatcatatcttatggctgcacgcgagcgatacagttttgggagctgtgcacgcgtcggtgctaaaacaagcgcccacttgtttctttctctatgattttctttccttaatcccagattaagctgattaacaagttttggagctggcttaataatgctattttactgctctaagggcctgtagcctagtggttacaagagcctcagtagcaccttagatcctgggttcgactccccgtggaagcgaattttccaggatttaacggctttgtgctttcagtggtaggcaacgtacccgtcgacagcgaggcgcccatggtgacttcgtcaatctccaagatggatttgccggcccagtcttcgaaaatgctcacaggggtagggtttgcgtgcgttcataggggtgagtgtgcgtacgttgtattgtgtaattctaaaaaaataaaataaaaactaatgatagtcatactagcaaaagtgatgaggtggcaaataaatacgtggacaaaagtagcgtgtgactaaatagtgaccaagtatacataatcttctatactactccctccgtcctaaaatataagaacccatctgatcctacgttcttatattttaggatggagggagcaataagcagcacctgcttcttccgatcgaagtagtatccaagtattttcaggatttttcttgaaatcatttgagcattggaagtatttttaacaattcaaagatcatttcagtgattattttaattggaaaaggtttttaaatcctctcctaagccgttgggttgatttcagcccaacatctctctccctcgcgcgcgtgctgtgcagcccaagccaagtcgagctgctctgatctgttctaagccatccgaaagtctaatttgcctccctccttcaatcgggccgaggaaatgaagcccggcaggaagtctgttttgcatccctctgctacagtgtcgcccctaacctccagccggtcgatctcctccctgccgtgcccgtgtacagcgccgcctccccaccaaattcgtcctctccgttgctcctctttccaaattagttgtgggaatatattcctctcgatctcctctatcttgtccccaagaaacccccttaaattccatggtatatcgcgtggattcgacgcggttttgagttcctattttccggcgaaccctaactaatccgtcgccgattccatccgttcccaagccgatctctccctcttccggctataaatagcatcccctaaccgtcctcttccatttgcctctagtcccaagttgagccgtcgcccgtagcgccgccgccacgttgtcttagccgccgccgtcgctggcgatcctccggtcgcatcgcgccgccgctagcgccgtcgccgttgccgtccgtcgccgccttcgggtgcgcacggagaaggagtacctcgtccgccccttcgcagccgccgaagaccgccggagcgccgtcgtcgttgttgagccgaaccgtgccgccgttgaacctcgtcgccggtcgtcgttcgtcgtcgttcgtcgtagtttcttgcaccggtgagttcgcgtcgtcgtcctcttcgcgtaggtgtcctcggatagcccaaccgagctctcttttgccggtggtcgcgtggaagcagtgccatggccggcgatgacgtcagcgatgacgtcataaatccatttttcttagtttctttattagatgaaaatcgattagacttcggaaattcataactaaatcatcgtaactcggatttgagtggttcaaattgctaaattcatctaaaatctagatctacatgttaaaaatatccacatgtactgtttatgcttgttttttttactgttttgttgattttgttcttttgctttagtttccgacgttccggaggagagcgttttcgttgaggaaggttcggaagtgtttgcggaagatcaaggcaagtcacacagatcccaaacaaccctttgagcatgttgaacctgtttaaagctattgtttatttcaacttatgcattattttcgaatgtcaccgggtggtgagcctttcccaattaattaatagccgaagatgactttattttcctatgggttataatttgattagctagaaccttatatattggtttggttcagttaaatgctatatatatatatatatataattgcttagccatgcttagaaacattagctcattaatgggatgaatcatatatactacattattattcatgattatatttaatggtagctcacgatggttaaccgtgttatgataattaattgataattaaaacttgataatggtgggttgtgagcacatggttttgaaggtcgtgttcatggcaattaaggaccggttcgcgagctactattgtgagacattaaccgtgccaactacaagccagcgtgggcaacgactttaccttttgtataacatgattcattgcggggtgccagactgtgaagcggtaagaagtccgtgggggtcgccggggagtccatgcctctggttatatttatagagggggtgattatgatctaggaatggtgcactgtggtgagttgtgttgtgcaggggtattgtcacagcctctattcgggtactttccagtatcgcgacgcatggtagacataatgttgaggctgtgtcttgtgggtacagtggtacacctctggccagagtaaaactattcgaatagccgtgcccgcggttatgggcgagttgagcaatgtttttcgtgattagtctcacatctctcacaataattattgatgctataactggtaataatttgcttagctcctggtttggagttagatctatgcagccgggtttggttgttcaggatggttgggcctgagcagcatgggtgtgctgttcagtgttgattaaaattgatgattactctattgttttactactcttaaatctttgctaaatgctgcttttgcaaatgagactatattatgccatcatttggtatccttgtgcacttgtatatttgctgtgtggcttgttgagtatgtcatatgctcatttttgtaataatcaatcaacctcagttgaagaaaaatgatctagaaggagaagacatttggcttataccccagttgagttgcctgtgggagtggagctgaagccatcgctagaccgttaattccgctgttgtttttcttttcttctgtaattatgtaacgttattattatgatggattcgtatattaaattgtcagtttgtgtacctcggctaatttctggacgagggttttatgcacaaataagttcgggaattactagtgaatttccgggcgtgacataacctcctcctactaaataagtacatcttctgtcccaaaataagttcattagtaaatttatatatccaacgtttaaccatccgtcttatttaaaatatttttattgttattagattattaaacatgaatagtactttatgcatgccttagtttttttttataatttttcatttttttttaaataagacataaacccacaaatattttgagacgggggtgctgacaggaagaaagatgcaaagaaaatgataaacgaaaaacatacacaaatatgtgtatagataatctaatagtaatagctaactattgtacacaatacctcttcttaagttaactctattgctgatgtggatgtttttagctaattactgattacagtacactattaactttgctctaagagcactccaatacagtgacgacctcatatgtcacgtggaatatactactatcatatatgagccattcattgagacaacaaaggctactttacgccttgtctagattcaaagtttgatcttcaaattttcaattttttgtcacatcgaaattttctatacatacaaacttccaactttttcgtcacaccgttccaatttctttaaacttctaattttgacgtggaactaaacacacacttaatgtgttttctttccatatatcattacttgtacgtcagccctttcaatgttccttttttttttgacaggaaacaataggagaggctcctactgtgctaataaatatattaataatataaggagtttatgtacagagaaatatttacaatggaaatagagaatttacagaagaattagaaaatagagtcaatccatgattgataggaaggtttatcctcctccagtcctccttcactctttgcataagaagagtgaaatcctctctgaaagcatacttctggttattgaaagatgaatgaatattgtcaaagatgagcgtatttctttcggtcgatatctgccagcaggccgtgcccaccacttcaacaaaaaacggcttgttaaaattaatataagctgtttcctcatcccagttgataccaatgaaattgcagcacaccttggcataaggacaaccaaaaaacaaatgaaccatatcttccaaaacccctggcatgcacattctacaggatggaccatcttataatcaaataagttttagacctatggactttgaaaaaaccacggatgtacatgtcagccactctttcactctcttttcacccctcacctctaatcccctccctatataggtcccgttctaagattttaattttcgtggcacgcttttcagattgctaaatggtgtatttcgcacgaaaactttctatatgaaagtcgcactaaaatatcatattaatttattttttaagtttgtaataactaaaactcaataaatcatacgttaataccatctcgttttgcgtaaaaaaaacttaatcttcattttcatcttgagaagaaaagaacaccaccatagttcacgtcctttcccctctgctatcatttcctcctcaccactgccccgctgccccctcgaatgaggtggtagagcccgcaccatcctcttcttcatctggtgctgcaaatcaatgttatctctttaatccccttctccttcaagtactctagacaagtcgacgagtcccccgcctccatcgccaccaacctccaggaccgatgagcggatctagcgatgtggttggtgagctctgggaccaacaaacggcatgactactcaatccaagcagcgaggcgagctgatgctcgtcagagttggccgcaccagaggtggtcgaggacaacctccaacttctaaattaggcgcaaatgaggggatgagctcgccggcttatgagtggcaataggctcctctccctcctctgttgccctcgttctcttctcctatcatgttcaccgtgtcattgctgttcgggtagggttaaggtggagataagggtgtggaccacactacgggagcatgacctcacctaatacggtgtcccgatgcgttcgtcccctaaggccttgttcggttaatcctcataagggagggatttggaattattatatggtgtgtaattattccccctcaatcccctacaaaccgaacaacacctaacagggacatggatcattctcgaaatagggttcgactcctacgtggcgagcctatgcctcgtcttgtaggagcattgggcaaggcgtatgaaagcacaaattgcctgacaaatcggcatgttgcaatttgcaaatatttgcccacaatttccgttccgcagttatttagcgaatccgcttaaaaaatagccagctcaacacatctcgcggtactgacatcttagacactttcgccatccctttccactactgctactattgcacagccgcacaacccgacatcccctgctggcacaagaacagattaattttcggctcgatcgacgccatcttctattcattcgatcttgcaatcacaaataataaaagcagctcaacgagcctagatccaagatcgaaaatccttcggatggatcgcaaactgagtcaccaaacgcttctgatcttgagctacgagacatgtcccagcatttgaatcatatttgaatcacaaattttgtagtagtatgtactacaagtataagtaaacaatccaaaattgttgtgtgttgtagcgttgatccgtcacaatgaacaaacaaatcccctatctaaccaagcgaaaccacgcgacaaggatcgtgtagagtggatcggagcggcagcgaaacgcgggcggctaccgtgccggcgccggcgcggtcgccgcgacgccgccggcgccgcggcggcgcagcgcgttggtgtagttgatgatggagttgatgcgctgcagcttgaggtcctccctgaactgcttgatgaaccgctcggcccgcgcgttcacctccgccttcccttcctctacctcctctgcccgcgcccgccgcggcttggcgtccgccgccttcgccgccgccgcggcatctggtgcggaacgcggcgagcgcgcctgcgcctgctgggccagcgcgtacgcctcgtccaagctgatggactcctcctcctcctctgcttccgcctcttcttcctcgttcttgatcgccgccgctgttgcggcggccacaggcgagctccgtggcgccgccatggacggcgtcgtcgccgccacgacctccctcaccggcgccggcggctccggccggaacggcgccgccgcgacggcctccaccaactcctcctctgcctcacgcgggtagtagaagtaatcggaccccgacgagacgtcgccgtggacgtggagcggcgtggcgctgtagtcgccggagaggtactggaaggggaagttggcgacggaccggagcctctccatcacaacggtcgacgcggtgcgcgccagcctccgccgcgccgccgacgacggcgtcgaggtcgtcccgcccacgccctgccccagccacgacacgacggcgatggcgccgacgatgacgttcaggaacacgaaccacgccgccccggagctgagccacgacagcatctgcaccaccgccatagacgacgacgacgatcgatgatccaatccaagaaactcacctcacagctgagtgagctcgatctgttcgaccggtgaatcgaatcggaggaaaggcgatgatgagatgagatgggtgggtgggtagcgagctcaggtgagctgggcacatggttatataggcaggtgagtgtgtgtctgttcgtggagaggtgggtgagaacggcaggagaagaaaggcggcaccgcgtcgcgtcgcgcgccgccgcgtccacggttggcatcgcgtggctcgtagcggcaagttggcaaccgctttctgctattctatcagcggcagagagcaaagctgcggaccatgcagcagcagcggcagcggcaggaagattcatgtgcgtgtacaggtgaaagtagatagtactagcgtgcaaggcttgttctgctctaggagttaatgaactggatcatgcagagtcttgaagaaaaaatgaacttgatatcaagccagacgtgacagccagcgacatgtcggtatttagctggtttgatggagtatttaggctctgttcgtttcgtggagttcccaactcccccatctcattttccgcgcgcacgcttttcaaactgctaaacggtgtattttttgcaaaaagtttatatacgaaagttgcttaaaaaaattatattgatccatttttgaaaaaaaattagcaaataattaattaatcacatgctaatggactgcttcgttttccgtaccggagggatgggtacccaactcaaccaaaagaacagagcctagggtgtgtttagttggccaaagaaaatttggggtgccacatcggatgaccagatgtcggaaagcgttttcggacacaaatgaaaaaaattaattttataactcgcctggaaaccgcgagacaaatttattaagctaattaatctatcattagtatatgtaggttactgtagcatttatggctaatcatagactaattagactcaaaagattcgtctcgtgatttccatacaaactgtgcaattagttttttctttttatctatatataatgttctatacatgtgttcaaagattcgatataatgtttttgaaaaaaaaaattggaaactaaatcaagccatactagttttgactctgagttgtcgaggctttgaccatttggaaaatctaattagatacatatcattagatttgtaatcaattgaactcaactgattatattaattgtctagtagtattaaatttaaattaaatttgtctactagtaattagcaagagggagataactaatagagattgagtaaagctggtgagttttcaggagcggagggagcaatttgcaggtttttttggctgttcttgtgaaactactgaatttgtttttacgcgagtcaaacaactcaattagtattcaacatggaaccgtgttagtactcaacagggaaccgtgttaatatataggtggcgtttagcgtagtagcgtactactgtacactattactctctcgttatcatctacggagtacagctgcatggccatccaggtggaaatcgttgggaatcgttatcttgcaaacaacttcacctgacatgtaaatttaaaattaattgttacctactcgtaggttcttctgttcctcatttgactcgtgacctgcaaagttcaaagctatcatgcattgtatatgcccaataccaagatcatgatggccggtgaacccctgtagattatttgcaaagttaatccgtgtctatcgagtgaaacatatactattctgctacacgctattcgcctgtcaattagctagtaacttttccccgcaaaaaaaaaaaaggtactaaccttgatactttatgctactcgtctgcttgatgctaaactggtgccttcgtgcgaggaaaacgtgagttgtctaatatgctacttgctacactactttattctaagtatcatgcttaaattagctagagcgatcatcgatgggctcgccttgtggacgtccacacacaccaccccagcgaagatccccatgttcctaatcaattaattcctgattaattaattttcccattttttctttctcttcatttcggacggcctttcggttcaaagtagagtcctccactgcagcaaatgatcggctatcgcctctccacttaaatcaaatccctttaatttctctttacaggaaagatacgttgttgagaccagcagctagcggaaccggccggacttttgcgatcggatctagttacaaatattgtttgattaatgtattacacgtgtgttgatctgtctatttgggtatcgattaaaatcttaatggccaaagatatatttggatcattgggtatatatgttgttgtaatcatatcattattaattgagacgacatatattattttcttgtaaatatatatggaatattctgcatccccgcactttcaggttataaaattgtactggatttcataatcagctgttagccatatagttacatgtatcatttacatgttcatgctccgtaagttttctaatattcaaattagaggagaaaaaacagaaatggtagaaattctgagaaaaaaaacaacgatatctaacttttaatctgcctaaagtttcttacttatccagaatcttaatactagagcactccgtataaatactaagcaacggacccacaatgataagaatatatcttacttaaataagaaaaataaataccaaagaaatcataaatactgatacttatataaaagaagtatccatcgagttacaagatcggagagaatgccaacaactctaacactcatccgagattccaatggagagagtgccaacatcttcagcacttctccagaactcccctagaaggaattccgacatatggtgcattccttccagcgcttcccctcactctcatcctatactctaaattctaactctactagagtgtaatctaaatatgaaagtgagttgtactccacttgagttgtgttgtgctttgagaatgaagtgataactccttttataagctctaacgacggttactatggcgatagtgaggtcggttcacccacaaccatcatagggaaccaatcaacatcctccacgtggaaggtgggggatgagtggctgcaagggtggtttagccgaaccatggttcggccgaccccctagctccaccatatcccctctcctttggcctggtcactatccagtcccctctcctttggcctgttcactatccagtaggaccttatgacagtgcccattggttgacccattttgaggtgatttggtcagcttgtaggccttccattccgtatacatgcgtctgattggctggagctgtgtttcttcgcatggcgagtggtaattttcatacaaaatccatgcattcacatatttcaccaatatttgtggaaatgatatttcaccactaccactaagtgtgatattttatttcaattgcttttatgcaggaattggtgatcagatttgacatttaaggatcgtcaacaggttttcctcacttccacaagggaagaagtaagtcagtgaaacccgagctagtttctaggagtttgcttgatagagcaagcttctccaaaggaaggtctaggtgttttatccttggaccttggtggttgggagatacctattagcctttggtcgttccttggagactaaagttttttcctggttattagcttggtgaggcaagggaacaatcgagatcctgctccttggagttccttgacatagagtatctcttataccgaattccatgcggattcacgtgcaaatagcccctccacgtggcattgtgggatttcagctttcgtccctctccttagccgtcacatcgcggatctcgatggatggatatcgctgcggtggacctcattctaaaaaatgaagtttgagggggtttttatgcaaaagcgcttaattcctacccttcccgtggccatcctcggtggggctcctcctcctggttggctggtcctcgccgccagcctcctcacctctcctccccggtccggtgcccccctctcctgttcccctctccgccgacggtaatagctcggtagggtgacgagcgaggaaaatctcgacggcggcaacctttcctccaccactacctctcccaactcgccggtgaggagctctcctccctccctccctcccatctaccggcgaggccctctcctcccacgcgctggcgcgccgccctcttccctcccgtgtcctcctcctcgtctctggatggggcgaagagctcggtggcggcgcgcgtggattgggagtagctcggtgtcggtgacgagctccggtgatgccgccacctctaccctcaagctcggcggcgtctgcgcatcgccgcccatccacctccctccttgccgatgcattcgaccctgtgggccagcggtcgagcttggcgccacgctcgactgggagggccgggcgcgggggcttggcttcgatgttgaggtgctcaatccactggcgtagccgtcctgtgcctcacgccctcaccaccaccacctccattctccccactgtcgcgcgatgatgacctgtgcaatcaagaaaggtggtagggatgcgactagctcaaaccacaacaacgagaaggaagtagtagaggtgaggtagctctgcttgtcatagtgtccttgaagaaaccaagatgaatggaataggaggctgctgcttgtcgtccaatgtccatccgcaacctgcttgcttggagcagccaccgccgccgctacgatatgctcgctgtgtgtcattaccgccttaccagcaagcagttctgtaaggtagtgtttggttggatggtttcggtgggtcgggtcggggccatccctttttttttttggagctgtttggtttgaggattaggtgggttgggttggttaaaaaaggaagagtaaatttcatagaactacagatactttgcacaatctatcacaaaactacagatttaagaacttgtttcacaaaactacagattcattgtattcatttaacataaaactacatgtactttgcacaatatatcacaaaactacagatttaagaacttgtttcataaaactacagatttaatatcctcatttatcataaaactacaagtttagtgtctctattatcacaaaactacaggttgtagcattgtaaaaatctatagttttgtgataatggatacactaaatttgtagttttatgataaatgaagacactaaatgtatagttctgtgatatacactaaatctatagttttatgaaacaagtttttaaatctatagttttatgatagattgtacaaagtacttgtagttttgtgataaacggagacactaaatctgtagttttgtgaaacaagctcttaattctatagttttgtgataatttgtgtcaaatacctatagttttgtaaaatttacttaaaaaaagaatattccaccaatattcgggatgaactgaccacccaaaaaagaccggaccgatcgaacccacctctctcccgtcgcgcacgtgagttgcacgcgcccgcgcgcacgagcaggcggtggcagctcgcatcctccctccatcctccatcctccatccccctcctctctgaatctctactggtcaacatctcgcccttggctgctgcagcaacaagaggaagaagaaccggcgcccccacctggcctcctgtgtagagtaaggtgatagaggtttcagatgttttgagaatattctctgctcatgaacgcatccagtaactgctggaggagtgtggagaaggcaagcgattgatgaatccggtggctgggaggaccgatctactgcagaagatgtggacctgacactgggagcaggactactgagctgggaatttgtctatgttggtagccttaaggtatttttacttctgcagttaaatactaccaatatgatggcatgccaatccatgaacaaaaacattaacatgtaaatgattgaagcacctgtgtttggttgccctgcttgtttaattgtgcttctccctcagttttgtgcttgccctgggctacttgctgttcctaatgctactgcttttaggtactttactgctgctatattgctcatcttaaagatcacaaaagtaacaaaagcaagtactttttagttcttaacaatacagcactctgcatgtaaaatggcattggatttttcccgttcccctaatttttttgttcggaactgttgatgcatgcacttttcttccaattgctttcctgttctgacatagagaactggccttgcaagctgcggtgctggtttacaattcgttaatactacgttggacggttggagtaagaaactggtggttcacatcaatgtcaatgggggagaacactttatttgattttaggaatactttctttcctgtttttatttaagtgagtacaaatcaggcaacatgtatttattctgaaaacccaacaactaaacatatataaaacactatgaggtggtagaagtactgaagctatttgtagaccacaccaaatgaggaagatggtattcgtagaacaagtttattattgttccaaggagatcaatatatgacacttgcccacaagccttgttcccctggccttggcctaggttgataagctcgcgagagcgggacaacagggcatggactttctatgcttgtttgagcatatccttcagtactacattattttttttgagaaggaaagaaaaaacaaaaataagtctggctaatatatatgagaatggtccgaaaaatctatcttccattatcatcattacttttttctcggaaacataatctgaacagacctattagatattggagatgggactgtcgaaaaagaaatataccggtatcggttggaaggtgaaaattcgtatcagaaacagtaaatgtcagttctgcaacaaagaggaaagtgtagagcatcttttctttcattgtagcattgctaggtttgtatttggaacgctttcaatagtgtttttgactgtaggatgctgaaggcatacaaaattcgtatcacaaaaaagcatccggggcctttttgtgattgatgcttttttgtgattgttgctgaaaataaattactaacaaaataaattatagacatgtggagggataaaatgaagataagtactttcattactttggttcattggaatttagaatttgtgtgcacatattcgactttcaacttatgtccatgaactcattttcttgcagccttcaattgatctgaataaagcttatgcccgaaactatgtcatattttagagcaattagatattgtaagtaaattaaattcacattacagatagcagaaattggtactgatttgttatgtcgttagcattatttactctacttacggattgtttctgcattttctcagcacacaagtggaaaattaaatctggaaatgcatgcatcgttttgtaattttaataaatttgtaaactaataattaacctatggagagcttcctcgtacatttgtaaactaataattaacctatgtagtgccgtcaaaagtcaaaactcaagtacggttgaattagtaccatgcttaatcgtagcttcatgcactttttttattaattttggcaatggtctctatgcgtactcttcaaatcatgcaatgccatgatactaaataggaaaaagtacgaattaccctcccccgaactatcgtagttgtccgaattaccccctaaaccacaaaaccggacattcttcaccaccaactatgcaaaccggacgaattacccctctcgaccaaatccgcggtggttttggtctacgtagtatatgtgtggcagtccagccagcattctatttataaaaaaatgtaggacccacctgccatatcctctctctctcattctcagtctcactcttcccctctctctcatgtgcatggcagcaggcgggggcggcggcacgcacgcacacggacggggggctagaggcggcggcgtggccgagacgcacacaacggcgacggcgcgtggcgcaggcgaggctcgaggggagatggcgacggcgcgcagcgcgagtgacgccgacaggcgacacgacggcacggggacaggggccggaggcggcggcgaggaatgacgcaagaacaccccctccctccggggatacgatggcgatggcggccgcttccgccttagccatgcaaggcaggccgcctctgccgccacagcggggccggcggcgccgaagcgggcgctcgtgctggtcgcggatggcacagtgctggtggaggcggtcgccactgccgatgtgctcaaccgcgccggcgcgtcgaggaggacgagcgcgctgggcggagggaagtcaaggccttgagcttgcaaccgc

SEQ ID NO: 63834 - DNA, 556 bp, Oryza sativa
tggtgtggggaggtttggagatgaacgggggcttttataggactttgggggcaaatggtcggcctaatgatgatgtgacggcggtgcacgggctcggaacgacggcgacgcgcgcggcgcgaggcaacgcgacggcggcgcggcgcggcagcggcgatgttgacggcgcgcggcaacgcgatggcgcgacacgacggcgacgggttcggcgcggcagcggcgacaagacgcgacggcgacggttcgcggcgcggcagcggcgacgcgacggaggcggcgcggcgtgggacgcaaggcgacgacgcgacggctgcgcggcgcgctggtgcgggacgcgaggcgacgcgacagcgacggcgacggctctgcagcggcaacgcgacggcgcgcggcgcggcgcggggcgcgaggcaacgacggcgacggctcgacagtggcgacgcgacggcgcgcggcgcgccgcggggcgcgaggcagcgacggcgacagcgtggcagtggcggcaccgggctcgggacggccacgcgcgggaccggaggatgggttttagggctag

SEQ ID NO: 63835 - DNA, 1379 bp, Oryza sativa
tgcaggtacaggggcccaagtgcaattatctgaggcacgatatgaactatgaggtgttgcatcatatccaaaaatgatggagggaaacacatctcaagctcgcacactgtctgtatagtgaaagcctggagaggacataactctttaggatcaattactttctgagatatggaattgaagaaataacacagcttagtgatgaccagctttacgtgaactggttcgactgctctagttgcaatggcaaggaatactgtgagcattacatgacagttatgagaattgtagcctgaaagcgacagatccttcatcgacactagtcgcttaatgtttgaggagaaggcagtaggcactctcaccccatgtagggatttgcacaatgcaattttgtcctctcttgtcaaggtgtagcaagcaggcggaaggtactctttccttatttgcatatccacgaggtccttacgtgatttcagcctatccttggtcttagttggtatgtccagtatagtcccaatggtgctatcgaagacatttttctctaggtgcatgacatcgatagaatggcgtatgtctaaatctttccagtacggaaggtacttaaagaaaatggagtgcttcttgaatggcacgctagggcttgttggcacttcggcattatttctcttccgcttatttgtttccttcttttttaccttcccaaaaacaaccttcaggtttttggtcattctgaacactttatcacccttccatggttctggtgcatcaccttcctcaacagtaccatcgaaatattctgcttaggagcggtacgagtgattctttctcaagaaatgctagtgccgcatgtacactagcttcttcgatcccttaagatacctgtacatggtaccatccacacaaataacgcaacccgtctttcccttgatttgtcccaatagggaaaacagtgtaggcaagtcgttgacggtgacaatgataattacatgtagcgtgaagtactcccacaggaattcgtcccaaactcggatcccgtgttcccacaaatcgcgcatatcctccaacaaaggctccagaaacacatccatgtcattgccaggttgtcgtggtccctgtacaaggatggtcaacaagatatacttccttttcggacacagccacgttgggaggttgttgttgagattatagacatataatgatttaatctattccataaataaatcatgacattacagatgaaaactagcatgaacgcatcattagatctatacatgtaaactacacagtataacatgaacagatcaaatatgcgcaacatattgaacacgtaccgaggtgacggaaagatcggttgcttggtcgaaacttttcgcaggtgtcta

SEQ ID NO: 63836 - DNA, 1620 bp, Oryza sativa
aacacctaatacatttgtaacaatgtctccctttcttgacctatatcttccttttatcctagttgggacagttacttttatgtgtgtaccatccaatgcacctaggcaattctacaatccagaacaccacatcaataaaatatggtacaattaatagtgctgagatgtgattttttttaaaggaaatgtgatttattttttagaatgggttaccttgaaatatttccatctatcgtcggtggtgtcctcaggtataggttctggcttcttaagtagaagttgatgaagcctcagaacagcaagtaggcataaattgaaatgcctactcacagtctctccacttcggtaaaaaaactttcctattgttctattctttaaatggtgagatagtatatataagaatgaagctactgattcctccaacggcatatttcttgtatcctcaatacctccgacgtctctaagcatgtcacatagaatgtgaaatgtcctcctgtccattcggagctcgcttatacaagcaatatcactctcacgaataagctggaatagtctttcactcctaagttctctagttctgatcctcctctctattttccaacattttctcttatatgaaattaaaaacagtacaacaacatgataatacataagtatgacagcaatcatcatatttctaagccctaaatttcttctctgcgttttggtacttaagggaaggcgagccatagcactctacaaatatataaaacaaaagcattaaccatgtccagaatatatcctgctagcacgcataatacatcaagctaccactaaaataaacacagtacatattttttttattgctaaacctaagtgatttgctagaacacaatatcaagcatccattcagggatatttacatgtatctgttgttttacacaaaactttttttccaatcttacattgtggaaaatgatatatcacctggcagtaaaagaaatcaaaattctaaaaatctagatagtaaaaatgagttggtcaaacttccctacactcaaaaaaaatattcactaatattcaactttcctgcaatctgggaaaatatattctacataaccatgtgaacttatgaagaaaacatgtatgaggcaggatgaatacatgagattcactagtataagctacttcatgatttgttaatgaaaagattatcacaggatcatcactcatcagcattcacaatttataaagagaggtggtttcagtagggggagggttctcaccggcgaggtgattgatagatgacagcaacgacggaagtccgatgtggttgatggcaccagccccctgcttcacagcctcgcccttgttcccggagttcttccggtcaagatccacatcggaagacggcggtggtggaggagcgcaagacggcggcgtcggcgatgcgcggggggtgaggggacggcgccggcgacacgcgggacgatggggaggcgcggggacacgcgcggggcgagggggctgcgccggcgatgcgaacagggtgaggaggaggcgccggcgatgcgcacagggagagggggcagcgatggcgacgcgcgcgatgtggaggagaagctgcggcggcgctcgatc

SEQ ID NO: 63837 - DNA, 1452 bp, Oryza sativa
agttcttaagcctccctagttgcattgaagtcagtctctgtttctattggagtgtataaattcgtaggaagaaaatatgttgcgtcacatgcataggaaaatacatggatatgaagtcctctatatgacagctttgctgatttagatccatggaaatcatttaggtaaaaacctcgaaatttagtttaaggtggaacagaaatttcggtatatatagagattaatatgctggactttgaagatatggcttcaaaaagaaattatgttcccttgattgcagaaaccttttttctgatgcagtaaatgatgattatatatataatgcagtaaatgatgatgtgttgttaactcgtaatcttaacaagcgcttaacatcttagtgatgttctttttttttcggaagaagggcaggtgggccctcttaggctcttattaaagagaaggaataaaagcaaaagttctaccagtccaacatcttattgatgatcattttaaaaaaccctgaactttttataagcaaccttgcttcccacttttttttttctcaaatattccgaaatacaacgaaccatttcagaaacccagcatctttgtgtgttcttgttcctaatgtttcataatgaccatgcatggatgtgtggctataactattctttgtgtggttgattcgtgatgactctgcaggtgcattcattggtgtttcgttggaagggaacttcgttgcaacccgaagggacgcaaatctgcggttttacggcgacccgtatctgacaaccagcgatattctcatgggggatatgcagagaccaaatgctgccaagtttctgtacacagcgttggatggcctgtactctgggctgagtcgttaggacgatgtaaatctcaactgtacatatttgctctgattcttctggctgtaggcgtttttagctaggcttattgattcttctaagtgcttgccattgtagctaggtccactgctatcagtcaagttccagatggcaagtcaaaacctctatagtttacatgtaaatatatcttcctatgatacatacaccgcattgttcgaagtttatcatcggatatttgtggtggtatgcaactatagaagctgttacatgttactgtatcatggatcatcgaatttaaactaaacttagcacttacatctgtttgtgttagatgggctgcatttaggtaaccagtccagcccaaaactgattccgctctgacccaagtgcaaagcgatgccaataggaataagttcatttaggtccctcgtcttaacatggagtcttataacgcctctcaaccataatactagatataacatgtcaacttgcaaaaccggtccactcaacgatcggtctctacctagcatgcttgtggccccgagaggattatgaggtggactatgaatcttgcgcggggggcgggggggggggggggggg

SEQ ID NO: 63838 - DNA, 3846 bp, Oryza sativa
cctgcgcgacgccgccgccgacccagcgcgccgcgcccgcgcgaggctcgctggacagccgccgcgccgcccactgcccgcttgccatgcatggcaagggagcaatcaaaggaagaagaaaggaaagagaaaaaaaaaacaaggaagcagcaaacagctatggccgccggcgcagcctggccgcctcgccgccgcgcatggccgcctcggcgccggcaccgcctagaagccgcgcttggcagcctggacgctgcgcatggccgcctcgccgtcgtgctgccttgacgcctggccgccccgccgagcaggaaagattcccctgtgattttgcaaaaaggcccttgctgtttttggaaattaagcgcatgatcctctgcattggaatctttgcgtcttaaaccctgaactttctagaaagcacgcaaataaccctctgcatttgggatatttgtttcaatggcatcaagaatttgcaaatatcaccgaaatcatattctcgcataaaccccttgggcctgtttggtatagctccaactcttaaatataactccaggagttgagtctggagtggagttgtggagctgcctaaacccaactccacaactctagtacattttgtgagagagctccacccaactccactcctagttttggtggagctgaaactgtttggctgagctccagctccaggaggggtggagctggagctggagctgtgccaaacaggccctctgaatttttgacctcgacctcgcatttcaggtacctttattgctgatatatatgattatgaaatttaattatcgcatttacgattattgattatttgtgatgcttttattacttttaattaataccgttgtgataaaatgtatagaattgcatagaatatattggaattatttgcgggaatcttgtgaaccattatattgcaacagttgtgcatttttacctgaatctaattttgcgcatatatagaaaaatgacgtgcatcgcgaattagaaaatttgccgaatcttgaatatctctgatatatttattcaatgccgaaattacaatagagcaagacgctctatggtaccattaatccaatcacgctataggcattgactcgatgagtttgatctagcatttcaaactctcgccagtgcctccaagctactctcatgaatgagtacgctaaacgcatgagcgcgttagcatttagaggattatggtatataccttatctttcgtagagcaagaactataagcaagaatgggtatttttcgactatgattcaccaagcagatgacccagagagagtatggtaatatgatgcatcgcatttgcattgaataccgctgaaactcttaatgttctacccgaacgtgacgaaagttgcatgcaagtatcactagtacacatacaagaagtatgcctaactagttgataattgaattgcgtaatgttcaggatagtgttcactagaaaaaattgtcttccaaaaccaactagcacagttgatggcgagttcaacacgagtagctagcttggtgcacttacctcaacgaaagaggaggaaaatgggggagtagaacacaggtcaaggtgaaacaatctagaactatgaacattaaaggaaaaggacaatcctaatagcacgctcatcatgaattgagggggaaagctcctagcctatttgcatggctatggacgaagaatctcctatgctatatcggatcagccctaaaattgatgtcaggataataaataattgccatagctgtcgagcaagaagctcgctacgaagttaattgaatccgaagtaccggaatacctcgttgaatcaatatacttcgtcatcacttgttgcaattgtgaaatagaatattggattgaataaatgatctttgcccatgtagagcacacattttccccgcaataaagaattatttccagtataaaatagcatatttaaggcatttactattttgttgctctcttatagcacatagttacaatgctttgaattttgtgtaccacccaaacataaaagaaaaaaatgaattgtggtccgcgtaaccacaaataacactttaagagaaggaggtatttccagaccctatagaactggaaatattatgaccgttgctagcagcaacaactgaatttgtcggcttagaatgtaccacagtcatattacctgtggaacaattgtgcactttatagaagcatctattgtccgtcaaccccattgaactctctaaaaagtgtgatgatttgggctacaccctcttagcaatggattttcagccatttttggtcttagaattataggcataaatattacaactcgtatggtcatagcacatatatgcataattttcctaaatcatgaagatttgtgtgccagtatgcaccgacaggagatcaatgcataaaccgcatattgttctagcatccctaaactggattgcgaagaatatatgtggcttccatttggtactgtatggataaacgcgcttccgaagcagcaaacatcaagtgtctcttagacaccgtgtctgccaagactgatctagcaagatcatgtgaactccaatagaactcactaaatgatcttcagaagtccgcgaggacaatgcttgcattgcatttgatgattggtgaattggccgcacgaagtaccaaatatccgcataagcggactaagtataagctatgaattgcaatttttgctatatcattgttgtagtactcgcagtagaaaaggacatgtagtcctgaaagcagcagactctggaagcaaattcagaccatcggcatgaacatccatcctgcaactagtgctattgcatctgtttggtttatgtgcatatcccactatcataatacgttgcaaaaggctctctccgaaagtcggaaaccttttacggagatagttgtgaagcctaaattccttgacaaataagaattatttccaatcatttagggggaaagaatgtacccttagataggaaatgtcaggaaatgtgatagtccgggactaatgcatgttacaccacactagtgaatgcagtttgcataaagaattaaaactgccaaatcactttgtaaatacttttgtgatttcgaagattttgactaagttgcatgaacgaaatgcaccggaggagggtgataccaaagaaagtaaaggtacccctcgtcttatctagaggcctcgaacaaaaagaattggacaagaaactccggctcctcatgcccctaaagtaagcggagacgtctggtgaaatcagggcaagagggactatcatactcaaagtcacgaaaggtacctcaccgaatagaaggggagctagttgagatctggcaaacagtatggaacctcagaataggcgtaccgcaccttcccatgaaggaagaaaactagctgttggagtgcacattaacgctggtacatacccacatcaagaaatattaagcaaagaagaagaagcatatgaaaatgcatctccttgtatatgcatggatattcgcatacagtctcatgcaaccaatagaagttggcaatgagatcgattatgggcaatgtctcctttagacaacaaaactcaatggcagtcaaccaggagttgaataaatgaattagaagttgaaaagaagaactcaacctgaatattaacaagcattgaagatagaatcaatgaatgcatttcaggagtttggatcggacacttgcataatagtacatgaagaagtactaggtcccgaaccaacatagaaagaataaaccagaaaagaatcgaagaagcaaactcgttcgtgtgaatttgagtttaattttgaaatatttggctga

SEQ ID NO: 63839 - DNA, 1536 bp, Oryza sativa
tttgtgagcttccacaatactgcatcttccacactccttagtccttactgagtttgcatgccctgcagctcatccctaagggagaaattttccactaccgccctgttagatagtgcatctcaaatgtccctcacccatctgtgattgatcagtccttgttccacagtcaacctagttccgtcgacataactaaagagaacactggtggagaaaccctttgtagtcccggttcgtaacccccctttagtcccggtttccaaaccgggagtaccaatccgggactaaagatcgctatctttagtcccgggtgaaataaccgggagtaaagatggctcagccacgtggccggctgagccatctttagtcccggttggtgttaccaaccgggactaaagatcgagctgacctttttttttttttttgcatggccctgttgctgcatggtttatatatatatatatatatatatatataaaccatgcatatatatgtttcaatacatatatatgcatacatatatatatgtatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggattaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctgtccatttgccgcggaccaaatgagggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcatacgggaatccaatttggtatgtaggaagaca

SEQ ID NO: 63840 - DNA, 729 bp, Oryza sativa
tgaattctatatcggctattttattcccgaagtggaattttttctcctcctaagatgtttggcgtttcctaagaaattttgtgatttaaaattatgtcctagacttcatctaattattaagttcttaattatatctaaagtactaccggcaaattgattccttatggagatgactaagaattaatctataacaatctataagaattcatctaattatattttcattaatcctataattaaatgctaatatttttaaatattttaaatctccccctaatttttcctttcttttctctccctctctcttttcttttcttttcttttcctctcctttctttcttttcctctttttcttttctttccctcccagcccctttctccctcggctccttctccctctctccctttttctgcctaccgagaccggctggggaaagggaaaaaggcggcggcggcacggtttaccggcggcaacggcaacggcggcggcgcacggcggctgcgacggcggcggggaacgcggcacggcctaaaagggtgacggtggcgcggttgagatggggaggggggggggaaaattggggaaatggtgtggggaggtttggagatgaaggggggcttttataggactttgggggcaaatggccggcctaatatgatgtaaacggcggtgcacgggctcggaacgacggcgacgcgcgcggcgcgaggcaacgcgacgacggcgcg

SEQ ID NO: 63841 - DNA, 2464 bp, Oryza sativa
tctggatcagatctgatgacaagaatctagaaaactgaaggaatgattggattgaattgtaatcttaaacatcatggaaccaaaaatgctatggcactggaatactgggtaaactggtttggctatcggggctgttttggtatcacttcggcttgatgaataaatttgctttgtcgaaatccctataatgagtagtatttgctgttgccgaataaaccaactctgggacaagatctggcatgaggttcagtatcataatggtttcttcgtagtaacgcatctcatgaagaactcttttgtactttgaaaacggacatggatgtgtttttgtgctttgaaaacccgtttgaactagtagatgaccggttggtatttttctcgcaaattcccttagcccactcttctttattttataggggtataatttatcttctttattctaggggtataatttaccagtttaaaatttactagtttgaattgacactttattactgattcatgtggaatgtataaaatcttatctcttcatgtggatggcccaacaaattaaactaaaatctacatttgcgggttttgatgttaatgcatgaagtttgcgggtgacaagtggggttttctatttggtgcagacgtacatctgccacgcactttttttttccacaattgtttttttcaattttttcgcaacttattgtcacgtgagcctttttcccgtgttctttttacgtatgtttggtgaattttttaaatgtattttagaatttgagtctttcacctcaaaattcaaaacatgctattgaaaattttgaactcaaatttcaaaacattcatctcaaaattcaaaactctcaactcaaattttaaaacattcaactaaaaaattcaaacctggatatatcttgacttaaaagttttcaatttgagttgaaagttttttagattttaacttaaaagtttttaaatctgagttcaaagtttcaaatcttgagtttgagttagaagttttcaaatcttgactaaaaatttttcaaagagttgaaatttttgaatcttgagtttaaagttttgaattttagatgtaattcaatttggagttgaaagtttttaaattttgagttaaattgtaagttctaaatgttagaaagcagaaaccgtccggctagtcatgcataaaatcgttaatgacatcgctaatcaaatttgttacaaattccgattttcatggcagctagtgattccgctcatgtggatgcattcgttgacacatgcacatgtgatacgtgatgagcgagctctatttctagtgcgtaggcgcacgttagcctttttggcgactattcgacgtatacctattttgctttacacataatctgtgtacctcgtgtgaaatggttagagcaaattgtgttattttattacaaacataccaagttttaaatttaaaagtcgcttactatagttttttatgagataaatttaatttgatgacaaaattaattttgtacgagaaacttttgaataaggatagaaacttccactaggatttctttttacaaaaagttttttcattagaaaattttgactatgcaactacggaatgtaaatacccctaaatttatactttgtaaaagaagatataaaattttatgtaagatattacgtctattttacctctctcaagtactgcccttggtcgaatcacgtctctcaatcgtaaaactgggtatagagcttgctcctctctcccctctttattcattctctttctttgcgcccacatgtcgtttcagttcatttgttgtcctcctgctcctctcaccgcttgccatctcccacctctcaccgtggagctctcttatcacatcctgatttttgtcttaagatttataaattatttaataaattatttttagaacttatattaaatgttcattaatttacaagtgaagttaaatgtgggaaataaaatttcctaaatataaagtatggttggatttaatttttattaaattctccatgaataattatactctttggaattttctcggatttttcggagctcaattcctaattttaataatacaaagaacatttcagtaattatttaaataatacattaatcattaaataatctgattttaatcttgttaagtaatttaagtgttcaagtattttcaggattattcttgaaattattttagcattggaagtatttttaacaattcaaagatcatctcattgattaatttattaaattggaagtcctttgatgatcccttccggcccagcccaaaaagtctagtttccctccctgccgctacagtgtcgtcttccagctccagccagagccgagctaacctgtgcagccgcctcctcctccatcaaatccggtgcatccgttgcttcccttccaaaattggttgcaaaaacgaattcctctctatctcctctacctaatccc

SEQ ID NO: 63842 - DNA, 16740 bp, Oryza sativa
gtgattgctttggtgagttataaacactaaagtagatagtaattgcttagacgttttgtttaggtaattgttatccagtaattgatgcgtatcccacagtacgttgaggtgggtgtagaggtggtgacagccctcgagatcactaaagtcttccttgtccgggtacgtagtagagcgacatctgggaacagcgggttgccagtgcctgaagtactgcattaggattaaaaataagctttccctagaaacagtttctcactagtaaatcctctctatcctggcctatcaattgcttggtgtccttggatgaaccggaggaagtctgatcacacacgttcccttggattcgatacccttggaatactccgtaagggaagtgctacatcggtatatccgtgcgcttgcggattttatctgtaaccgtatcaattaccaacaagcatttctggcaccgttgccagggaacggttgctgatcatttccaaacccagttcatcctcatatcctttttcattttttttattctaccttcacccctgctatcctagagaagtattcctatcaaactcttctcgaccatcgtgcaacctctgtttgagctgtctgctcctcggggcgaattctatgagccacctccttcatcggagcccatttatacaactggctatgaaattcgtcccgagctaattagtatggttagggaaaatcctttttctggttttgatctaaaaaatccctaccatcatctgcgagactttgaacaagtctgctcatgccataagattcgtggcatgagacaagaaactgtgcggtggaaattgtttccgttctctcttcaagagagagcaaagaaatagtacacctctaccgttggatgtgtaaacggtagctaggaaaagctgcgagatagattctgtcttgccttcttcccagttactcgtattactgcccttcgagtagaaattctcaatttcaagcagatcgaaaacgagtcaattggtgcagcttggtccagattcactaatttagtacagtccggaccaaccctgtccttacctgagtatgtgcttctccaacatttccatacgggtttggataaggagtctgcattctatctggacataaccgctagaggatcattcatgcataaaacgccgtcagaaggaaaaacgatcttggatcgcattctagaaaatacttccttcatgacgcagtccaatgaaccccagctggaggcatccgtgtccaagatagaggaacctctaacgatcgagccatttgctgaaccgtccacttctgctagctcgattgatgagaaggttcctgagcagccatccgtcaagaatgaagaaattcagactccggattgtgccacaattatgttcagggacggttttgacgtagactacggcaataccctgaactattttagcaagaggaaaccacccgttcctttgtcacctcccgatcctatggaactcgggttcctacgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagtcagcggaagaggttaccgcagttcctcctcatgagtctaccaaggcccttctagaagatgaggtccccgacttcatcaaggaagaagcagatcccagtgagactctcgacctgccaatcatggaaccaccacctcgacctccgctagagcttaaacctctacctccaggcctacgatatgccttcctacacaatgacagagaggctcctgtcataatcagtgacaagctctcggaagacgagactcaacgtcttctcaccgtgttagaaaagcatcgttctattcttggctactcgcttcaggaccttagggggattaatcccgcgctttgcacccatcgtattcctattgacctcgagagtactccctctagggaacctcaacgacggctcaataatgcaatgcgagaggttgtaaagaaagaggtcttgaaactcctgcatgccgggattatctatcccgtaccatacagtgagtgggttagcaaagttcaggttatgccaaagaagggaggaatgacggtcgttgcaaattctcaaaatgaactaattccgcaacgaaccgtaaccggatggaggatgtgtatcgattacaggaaactcaacaaggctacaaaaaaggatcatttcctgctacccttcaatgatgaaatgttggaatggctggcaaatcattccttcttctgtttcctcgatgggtattccggatatcatcaaattcccatccatccggaggactagagtgagactatattcacatgtccgtatggcacctatgcgtatcgtaggatgtcctttggactatgcaacgctcctgcacctttccaaaggtgtatgatgtctattttctcggacatgatcgaggatatcatggaagtcttcatggatgacttctcagtttatggaaagactttcggtcattgtctgcagaatctagacaaagtcttacaacgatgccaagaaaaggacctagtacttaattgggaaaagtgccattttatggtacgtgaagggataattcttgggcatcgagtgtccgaacgaggaagcgaagttgatcgtgctaaaatcgatgtgatagatcagcttcctcctctcgtgaacatcaaaggaatccacagcttcttgggtcatgccggcttttatagaaggttcattaaggacttttctataattgccagacctctgacaaatttgctagccaaggatgcgccttttgagttcgatgacgcgtgcctaaaatcttttgaaattctcaaaaaggcacttgtttttgctccaatcattcaacctcctgattggaccctacccttcgagattatgtgtgatgcaagtgactttgctgttgctgcggtcttgggctaaaccaaggataaaaggacacatgcaatctgttatgctagcaaaattctaaccagagcccagttgaattacgcaactacagaaaaagagctgctcacggttgtttttgctatcgacaagtttagatcttacttagtaggagccaaggtgataatttatactgatcatgctgctttgaaatacctgctcactaagaaagatgctaaacctcgtctcttaagaaggattttgctgctccaagaatttgacttagaaattaaagataaaaagggagtagaaaattctgtagcagatcatttgtccaagctgcagatcactaacatgtaggaacagccaatcaatgatttcttaagaaatgatatgctgatgacggttcgcgactccaacccgtggtatgccaatatagtgaactacatggtatctaagtacataccaccaggggaaaatcaacgaaaactaaagtatgaaagtcgccgtcacatatgggatgagccatacctatatcgggtgttctccgatggcctactacgaagatgtgtgccaactgaagaaggacttaagatcatagaacgatgccatgcctcaccctatggtggccattacggtgcattccgcacccaggccaagatttggcaaaatggtttcttctagccaacaatgtacgaagattcaaaagaattcatcagaaggtgcacaagctgccagaggcaaggaggaatcactactcgcgatgcaatgccccttacatacaatttacaagtcgagatattcgatgtttggggtatagacttcatgggacctttccctaagtctcgcaactgcgagtacattctggtggcagtcgactatgtctccaagtgggttgaggctatgccgtgcagcgccgcggaagcgaggcatgccaagaagatgttcacagaattcatcttcccaagatttggtacccctagaatggtcataagtgacggaggttctcacttcattgacaaaaccttccgagacctcctacgagaaatgggagccaaacacaatgtggccactccttaccacccacagaccagtggacaagcagaaacatcaaacaaacaaatcaagaatattctgcaaaagacggtcaacaaaatgggaacaggatggatggacagattgccggacgcactgtgggcatatcggacagcatacaagacacccattggaatgtccccatatcagatagtctacgggaagccatgtcgactccccgtagaacttgagcacagagcatactgggccatcaggaattggaacatggattttgagggagcaggagaatggagaaaaatgcagatcgctgaacttgaggaatggagagaaaaggcttaccacaacgcaaagatatacaaagaaaggacgaagcgctggcatgaaaaaaggataaagatcaagaaatttaagccaggagacaaagtactgatgttcaactccagggttaagcttttcggccacggaaaattgcgcagcaaatgggaaggaccgttcgatgtcatcaacacctcttcacacggggcaatcacactctgcgacgacttaggtaacatatttaaggtaaacggtcaacgtttaaggattttccttgagccaaataaaactttagataaagaagtggacgttattgaattaattaattatgaaccatgatgatctcatctaacgcatgctcaaaaccctgtatagttgtcatttttgtgcttagaataggttttagaggacctagggaaaaattagcggccagccggacccaccagggtggttcggccgagccatggcggttcccaatcggtcccaatttcgaatgatggtctcccccgctcgtccttagtccgtttagatgcgcgtttgaaggtacaacgttcggatcacaccaaaacactccttcttcctcctttcctccacctttgcacactctcctctcctattcaatccaattccttgaatttccactcatatccaccaatggctagcaaattcctaatcccattcattggctcttcctccaattccatttacgacctcaccggagagccgaaaccggcgaatcaattgatcccgatggaacactacaccatggaaggggtaaacgttgtatgggctcaaccccttgcagctgtgtcaggctcccttgcgaatttggagccgatcatcgagctccctggttcggccgaaccaggggttcggccgaaccaggggttcggccgaacccttctcggccccaatcggcccccgttcagcagcgcgatccctctccccttgccatgttacaagaacaaaaatccagggggattcgcctgcacaacggccgactacgggagagctcggcttgttaaaggcacgatgccttttccaagatgacgggaaggccgcaccgcctcccgccgagcgctttgtgggcaccctcttcaccaaggcaggggatgaggtgctccacaagtacaccacacccaccgctactccatccaccccaaagggggagcgtttccgcattcagggagtacgaactcccggcggtgggtatggtaagggtttactccggcctttaatggcatcggagaaggagggggcagcggagtcccgtagccctccacctatcaaggtgaagcttcatttgacgccccctccaattgtgagggctcctggccaattccaagaggatgaggtgaaatcgccggagccctcaatccacaagctcgccgctcaagtgaagaaactctgcaaggagaacatagagcttagggatcgcaatgcggagctaggggtagaactcgctaaaattagaaataattttgatacccgtagtcgcggtttgtgcgctaagatcaagcgtgcattcatagtgatggaaaaggaaaataagtattatgctaattagatgtttcctttcccatgaataaaatagcagtaggtgcttggttttatttttccaatcatgtaagcacttgctacaaataatgtggctcattggtgttaaccccaatgtttgccaaggtttttttttgttttatatttaataaagtttaggtttttaataagtgtgggggagatatcccagcttctgacgtgtatacactgaaaattgctgaatatctgaacacctggaaggcattgaactctacagaaaattgcaaaggtattgggcaccatagtggttcggctgaaccaccaggttcggccgaactagtgttggccccaatacctcctagttttcacaggtaagcaggtgagcatgtcttgtatctgtatatctccaccatggtatagtactagagctgaaaattgagaaacaattggttcaagcataagtaagagataaaatttccaactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactggaagttggctttccacaaaaatatccattcaaataaactcctacattggactatgctttcttctcctggaaaagttcttggcaaaaaaagaatgacaaaagggggaaaggcatggctatgaaaaaaaagagaaaagaaaaaaaagaaggaaataaaatttgctctcaaaacattgagcaaagaaaatatagccatgccccctccacaatcatgccaagaaaaccaatttggagagaaagtataggaaaaaggagaatcatttctttattccatcattccacaacatatttcacttttccattttcaaccacaaataaagatccttgatctaggagtatgattgatgatcttcttgagtccatatttttggctttgcaatatatatgatgcaagtatgtcaccagtttatccctaccaagctccacatatcagccttagaataggggtaaattctggcacactttgccttggtgaggatccaaaagaaaatatacatctttgagagacaagagagaaaagtcaatataaggaaaagagctagtttgcgaaaattcataaaaatcccatgagtatggcagagaagcaagaaggactggaatcaagattgttccatttatcaattactcaagatggtaagatagccattgatatagttcacaagtgcaggtatgggtgtgaatgatttatatgcttaattcatatcatgaagaaattcattctacactaacctttactcagggacgagcaaagggctaagtgtgggggttttgttggtggctattaaatgccgattctataccgccaacatttgcataaagtacagataataaagcatccaacatagagataggtgcttaatctcacatattccataagtgttggtgtatatttttatgcagaagataaaccctgaagttggaaggaaaatcagactaaagtgaggagaattatgtatccatacaaagaggggtcatgaacttcatcgaaacatcagtaaatcaacccaaaactccaagaaatggatagaggaaggtccagggagtccaccgaccaaaggccaggccaggaaggcctagcccaggttcggccgaaccccctggttcagccgaaccctggtgatcgccgttgatcccaggttttggcatggacatcccagatcactccctgatggcggttgcggggcagttcggacatttccccatctcacaaccgtcataactgccctataaaaggacctcacttcattcactctcacacacacttccaagcttgagctgaattataagaggctctattgtactatattgtatactagaataggaagagagtagagtagaaggagtcggaagaattctggagttgtcggtaatcttctcctatttcttttattctgtttattactctgaattcattataatattcttcttgagtaatttagatttatcttgtgagaattatctcttggttagttcctaaatagcatacaggattattgttcactataatcaactaaaatatagtgattgctttggtgagttataaacactaaagtagatagtaattgcttagacgttttgtttaggtaattgttatccagtaattgctgcgtatcccacagtacgttgaggtgggtgtagaggtggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaactgggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctcatggcatcgccggagatcactagctccacgtcgttttgtccgccactcactcctcgctcatcaatgggttgccctccggcgagctctccacaccaacaatgtaccccaacgcgccaagcaggagatgctccctctcaatggatgccgccatgcttggatgataacgacattgcaacccccacgccgaatagggtctacaaccatgtaagttccactccttcaatcccactgtgttctatggtgaatattatcgacgtctagtttgcgatagtgatgcaccaaaagcacattatttcgagccacgattattttttttcgttgctatcgccgtgtgacgatactaactactcccactaaaaatataccattttttatattttatatatggtttgccaatatttcatgaatcacattcaccgattgattcttttaacgacaagcaattctcattgcattcaatagttaaaaactaactcaactcccattcctagaacaactaggttcaacaaacatctatgcacgataacttcgatctataagtaattttatatctctaaacctgacactcttgctacgtaattttggatgttttatatcactaccttcatgaatacgaaagttatttttaaactatcacaatgatcccgaacgcacgtctctgttttattaaccgaattaatcccatacctaaggaatacactagcaactggatacaagccattttttaactggcaatccacgtgctatactcagcagccataataattttagaaatggtatctaaactttcataatgtttccagtatttcatcgataatttattaacaaaacttatctttgctatataacagggtcctagcgtgccaccgcatatggtgcccaccgaaggcatggctttccctacatacgacaacgcatacaacttctaccagaggtatgcatgtcacgctggatttgacatcaagaagagccgtacgcacaaagcgtttcgcgaggtgtgttgtacgagggagggcaagcacgtgtcgaaggtcaccgatggtgatagacaacggaggagaccgtccaagaaaatggggtgcaaggcttttatgaagctgaggcacaactacgacggtggtgcgctctcatcggtggtgtatgatgtggtcgagctacagcacaaccaccctctaacgccatccccttcggcggtaaagcacatgcgtgcacataagaaccgcgacgacacagttatgcaatttgtggacactatgcaagaaagtcacgtgccgcaaagttgtatcatgggcgttctatctgatctccatggaggccaagacaatatccctttcacttcacgcgacgttgagaacaggtgatttttttaaattattccgtttcttggctttgtgatgttgctttcatgaaagtttcttttcgtgctttcttgcacgaagacacaaatgtggattgtaattaggacgttcccatctgaccgatgcaggaaagtagccaatgtccgaaaggaaaatgcgaatgacatcaacaagttgttggagtttttcaacgagtgcacgttgcaaaaccctaagttctactgggacgcccagcttgatgaaaatggtgtcattaagaacttgttttggagtcatgctagcagccaggttgaatttgctgactttggagatgcggtaacgtttgacaccacatacaaaactaatatttacgaaatgccacttgcaatgtttgttggtgcaaaccaccatatgcagagcacactcttcggatgtgccttgctcagagacgaaaaggtgcagtcatttgagtggttattcaacaccttcaacaagtacatggctaatttcccggctccgcgctgcatcctaacaggcaagtctatctacaaaaaactccctattgtcatccaccattaattttttccgtgtctccaatttatctacacttcctgtacgattgttttactgccatttacatcatttttttttcagatcaagatcctgctatggcagtcgctgtcgggcggtgcttccctgggataatacactgactctgtaggtggcatatcctcaaccgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaaggatatatgcgagactaaggtaaaacagatagggacgaggatttttatacaggttcgggcccctgaattgtcaggtaatagccctacatactgttggccgaagcaggtcgttgctcttattcatcataatcacaccagtacaatatttggggtagcctatctaactgttgtcaacttagcagactgaagtatcatcacgtagtcgacaacagggtagtcttcctcctcgaatccatgcccggcgagatcaaagacagcgctagattcctctctttggttccgcaggtaccatatggggttttcctaggcttatctctgaaatcgatatccggcgtcttgtcttggcatatgttggcttgtatgttgatcttgtttattgatctattgttccgtgtcccctctcctcctagggggccttgtatttatacccctaggtgtccccttgtccaagtagaactagggaaaccaatatggatacaatccgagtagtccttatcgtttccatgtagaactctagtcatccttccttatgcggaactcctcctatatccgaaggttgtttccgtataagacatggtatgtggtgggtcctgccgagatttagtcaactactgctaggtatgtggtatccataaccctgacagcagtgtcacacaccaaacattccgaaaaacacaactagtgtcagaagcaattcaaggttattgcagatgtcgatgaaggggtatttacatgcaagtgcaaacagtgggagcatacaggtatttttatagtataaactcgatatcgatgttttatgtacgtttaacattttcagcattccgttatcacacatcgcaatactttggtttaaatgctctctcctttttttggatgtaatttaggcatgttctgcacacacatgctccgggcatttgttcatgtacaagttgagaagatacccgctgtctacatcctaaagaggtacacaatgaaagcgaagagcaacgtgccctttgataggcgggatcgagagacaactagaccagatggggttcaagaaagttacaggacaaatatgatgatgattgaagcgtttggagttgctagggcggcgtgcaaattgaaggtagcgtttgacagggctatggctgttctgaagggattgcgtagtcaagtagaggagataccgcgtgactctactgcgactgttgacaccaatacgcaagatggcattgctggacgagttcaaaacgccgaaataagcagggagcccccctcccccccccccaaagtcaagaataaaaggaaggacccatgacccggatgaggaagttcaacttggagccaagggcaaaaagttgtgcacacgggaatgtgggtggtgccatctgagggatgggcattacgcaaatacatgcccgacaaacccagcaaatttcgacaaggtgatgaaggctgctaataggggtaagggaaagaggggcaggccacgcggatccggcaggggtagaggacgtggtaccaatgttggatgcaaagttagtactgcagtccctagaacaacaaggagatcaagcaggaagggtccatcactgcgaagatgtttagacgacgagtgagctgaagatgcagctgaatctgctgggtatacagatgacgatcaaacaaatgcagacgatgatttcgggagttatgaaaacggttccgcacgattacagtatagacactccaattttatataacacagtctatatgatacttgtctttttttttcatctatgaatctgtattttaaattcaacagtgactagttccatccttatttaattatatccattctcactatccatcgtcgtatgttcagtttgatcaatgtggttctagaaactaaaattaaaaacccatagcgtctttgcgcacgagcgacaccaaaaccgaagttatttttcaacttacatacttgatcaaatcactcgagttcatccaataagagaacaagttaaattttaactcctttcagattttttcaataccatgttgaacacacactcatatatggactatgtgagttaaagtataactggcgtaccacgactgaccatatgtgatatttctaactcacccactgaatcaactcagccaaaccaacaaacatatcatgactaaacgattcattctttattatcttttaaaaagcggcagacataacaccaacatctaaaaactttaacccttttggactatgggtaatgtattcataaaaacatatggtctatcatatgtaatggtttgtggcaaaaattaaatagacatatcaaaactaatcacgtttatggcgcttgaaccgggttactggtgactgagcatctcttggcggggtctggtcatatcgaaagttgtaaatgtcctcttgtataatatcaaggtcaccgccgtcgtcgatgaaagctgggtgcagaataatcttgttgttggggtcttccggcggatttagatcgtcaacgtcagaagggggggaagggcatagggtagacatgtaccccaagtcctcgcgtagatcatgccatcatcttccatcgatggcgacagcgggtaagggggtggcgacagtggaggagggcttgtcaccccaaactcttcggggagatcactctcatgctcatcctgttgcagcgtggcatcggtggtggggttgtgagtgggatcgacaaaatgtgtctttgtggattcggtctcttgtttatcacccatggttgagttggctgcgtaatacaaatgatgagccgggcagtttatattggggaaactgacaggatggttgattcccacatatcagggcaaacaatctcagcgattttgtagcgattcttgtttgcatgcatgcgcgatatatctggagtaatgtgcgcatggataaacaaccataatgccaccacagcatagcgacgtaaagttattaaataactatatttaaatcatgtcgtgtaaagttattaaataacaatatgtaaatcatgtcgtgtaaaaaaatcctctgatacgtctttcagcatctataggctcattccagttattttttaactttgccaacgtttacttaaattctccccatggccctatagtactcccgaaacaaagacaaatttttaactccttacatgcgacatcgaaaggcaaaacaattatctcaatcagttaaactataacttctcacacacggaacgtcttcatcaccgatcggtctatgcaagttaattttaaactatttgacctcatatgcacaatcaaccaccaccgattttaacataaacatgactctgtcgtacgggtggaccacggtaaaaatttaacttgttatctgcaacatcttaactcatcaccaatatttaaaacagttaaatttttactatcacattcgctctccctttgacatgcgaactgcaggtatcgtttgcgccacaatttccgtcagttaatttttaactctctaataggttggtttggttttggtgggctgacattcctcatttgtgtgtggcgccatttaaaccgtggcgcgaagcgcatgtgagcgccactgtgtatatatatatatatgtgtgtctatatatagacatactataccgcatcctaataactaaaacactccccctcacactagggatgaaaacggagcggatagtttccgtccgctccggacaaaaacggatacggataactttcggatcggataattctcggatagttcggatacagatacgaatacggatattttctcccggatacaaatacgaatatggtaccagggtttccgtcggatacggataataattcggatatccggtgaacagtgctattcggatatccgcaggacccatgagacataccccatttctttttaactctataaccttcaatatacctttatagattttaatagtagtttatctctaacactagtccatactattaatattatttaaattttaaaaaatatttataaattatacctcattttatataaaatgagctaattatatatgttgatatttgtttctattagaagttgagttggttttcgtgttccgagaaaaatttatttccgtattcgtgtccgatcatattcgattcttattcgtattcgagataatccgtatttgttttcgtattcgagctatccgtattcgttttcgtatccggtaaaaaaatatgaaaacgaatatggtataaacattatccgtccatatccgctccgttttcatccctacctcacacctcacccccaacccccttcccacccacccaccct

SEQ ID NO: 63843 - DNA, 94475 bp, Oryza sativa
gggagggagtgcacaaggacgacgcgacgtgggtcagtgggtgggagtagataaggacaacataccgcgctcggctcatcggctcggctcgttttgtataggtgtaggtgtctgttttttaataaaccggcatctatagtattggtaccggtttttattaatgaaccgacacctatagtgacttaaagatgttggttcttatttttttccgcgtgcggaggcggaaaaggcctgtaggtgtcggttttaaaggaaccggcacgtataaggcccatccctttgagggttcttgtagtagtgaatgcaaactgcaatgtctaccgctattctatttcttgaacccaaactcaaacatatctatgggctttgacaccacatttttggatggatcctgcagctttcgagcttctgattagtcctaaactcaagaataagtgctttgaattcatttcctgatggatcaaaggttcagcataggctgattactcttataaaattccggtggtgaatgttttatttcattgcttcacattcagcaaaaaagtttgttggtgctccttttttttactcagtccctagcaaaaaaataagaacaaaaatttcaacaaagaagacaggctctcaatatgctgcatttggatgcaactaagacagagccactgcatcgcccattccaatccaaaactacttgtgactgtgagtaatgaagactctgccccctaggtagggatgtaagagggccaacccatgaatctacttatatactacctccatattttaatttatgacgccgttgatttttgtccaacgtttgaccattcgtcttaataaaaatttttatgtaattatcatttattttattgtgacttgattcattatcaaatgttctttaagcatgacataaatatttttatatttgcacaaaatttttgaatgaaacgaatggttaaacgttggtcaaaaagtcaacagcgtcatacattaaaatatggagggagtatcaaataaatggtaacccactggtttttatgtcatgactcaacttgccgcgccttaagatgcaagtgggttgatctataaacccatttacagatcccatttaggaacccgtggattaccaactaatcttgtctataaatgggttcgtgggttgacccgcttacacccctaccccctaaggagcctggcccttgcctctcgtatccgacggggacactaccgcggatcaactgcttcctctgatggatgcgcagggcagctatgcagcacgcagcagatgtcatgcgaaaatgagcaatagtcaccgacgcactaacattatgtgtacctttgcgtcgcaggtaactgcagcttcacaccacactctttggcctttgctagttgcctttgtgagtatgtgactactcgagcttaaacatcagggtagcagatcattgaagagatctagcaagatgcctatccatttccagcattcctgatgcttcacatgcatatgtttttctttttttccaacatggacaaatgggatcacgacatgcattattttctttctggtcacatacaagtttgatagggagggatatatatatcttgtaggcaattttctcaactaaatgactgaaaataatgagcttggtagtttttacagatgcatggaactgattctatgcatttattgctccagattgttccaacaaccacttaataaaattttgacaggagaatacataagtgattaattagtcgttaactttatccttgtttttggacaaaggggcatgatcactagctagcataaccacgtgctaatctttgtgaaatggccaattttgcttactgacacagccacatgtacaaaggccttcagctttcctttacagatttggttgataaaagagtagtacaatgactaattatgtttcaatttcaaaggtctcctgattcgaccacccttgccctctactatactacaatagagttcactggctgattaatgagcagcctcaacatccaaaaatgcatcttaagctggagtcgtcggtcgctgcaagatttctgatgctggcaagatgaatgaggatcaaaggtgaggatagtaaaactactcaacagatagtatccgaccaagttgatgatggaagagcacgcttacaattctatggttagagtcaagtctcacatctctagtttcagcttcatccctttcgtttgctacaccgaacgatcttgcgaaaacggcaccagtgtgtccatccatgtacaatactcccaatgcttcatatgcctatgttttatgtcagcttggaaagatggaatggtttgcacctttcttttctctggtcttgtttttttggataggtagatatatgtccgatccttttcggagtggaaatagccagaaagggattcaactaaaatccaaactaaatccaaggtgatccttgaattataaatacagcttggttacccttgaagatgaagggcacgattatgtccgatatccagtcaacgacattatgaattgcttcatgctacctctcaggacattgtaattgttcaaacatgagttaattaatgatttattaatttacagaaaataaactcagtcacaacgtgaaaccttgagaactgaaaaaaaaaacacaaatttaatagcatgtgtgtaacaggacactcgaagtcagttggaaattaaatgacttttctctactcaatgatattggcaatcctactgaagacatgttgatcaattcagatggctgagagaccaccaataatattgctgtcgatgtagctggttaactgatttcgtcggtcttgttcacaaaagggcatgatcagttgcaaaggcacacgctccatcgttgtcatacggtccattttgctgacaacaatagtagacatgattttcactgattcgatcgaacagaaagtagtacaattaattattgccattaagaagaacttctctcacttttctaagtctgatatgggcgtcctctagaacagactacccgagaacagagcaggagccgacgtgagaattgccgtaatccagaaagaccaatagaaaaaaaaaattcagcaaaacaaaccacacaaactttccagtcatattgccaatttattcattttttttaactgaacatgttgccaattattcaccaagcattttctttttcaccgatccttaagaggcatcgcgagatggtcaattatagctattcgtattttcgtagtgttaaattacacacaaaagtagaacatggttggttctcccatggtccaatggacgagctataggataagctgcacagatcgagctgctgaactcatatggacaaataaacgcactgaactccggattttttcaggggaaaaaggaatcatatatattaggctgcaggcagacggtcctctttgctgagctgggacagctcgtgcgcagcaacacgccatcatgccgatctcccctgcaccccgaaaagtatcggagtactgtcagtcgaccacatcgtttctccatacagcaagttgtttcatcgaagtttgttcctcagcattgatattcaagtcgttaaaacgcatatataaaaattatacctataaattattattattattttgcttatacgttgaataacgtattatccgtatttggtcaaatgatgggggcaagtgtgccggcaaacaaccgcagctgcatgggcttgtcgatgccgacgacaagcattattccgaagacaaaaaaaatcttgatgatcttccccacatagcaccaccgcatgtccttcttccgacgactgcttcggtcctcctcccgcgtgtgttgtgttgttctggattctggagtgcgcgagtatgtgaggatgtgagtgcttgagctcaaacatctgggcaacaaaattggttctctagtgggaaattcagattggtacagttaatatttggaggaaattgggtttatatatcaaagattacagattggtatagttaattctgatgcattgtgttgacaacataggcgtgcttcgtcatgatttaactaatattgcagtttggctcacaccaatttaattacaaattcatcatgatttatttcaaatcaaagagagataatctttactactataaactgaaagatgagtaccaaaactatcttacaagcttcagcaggcgaacttcagtagtatccatccatttcctcagtgattgatcagtgcatgatatttttctttgatggaaatgatctgataataaacatcattaattgtcggtcgatcttttggtgatgtctctgtgcacattaacccaagcttagccagctgtatggcacatgttagaatttcaggcacaacatgatttgagtcttcgccatcgtgatgttcggtgatagtaggttctaaaatatcattgatcttatgtggaaatgctgattccactaagctacgaaggttcatgccatccttaaacatctcatcggttgggcactttcctgtgatcatctctagaacaataattccataactgtatacatcaccctcagttgagaccttgcaccccaagccatactctgcaataaagattgagcaagttagtaaagcatttgttggtcgaaaaatggtactcgattccatggaatggtatacttgccatcacctccgtgatagataatgtggaggtagtagaaacgaacaaataagaatgaagtaagtccgtacctggagcaatatatccaattgatcctctcagtccagcagtgcttgatgaattgtttaggcttataatgttgttatgaagaaactttgtaagtccaaagtcactaagacatgcaaccatttcatcatctaaaaggacattgcttggtttcagatcgcaatgaaccataggaggagagcatcgattgtgaagatagtctaaagccacggcaatgtctacggcgattcttattcttaaacccaaactcaaatgttttgtaggatttcgaccgagcacttttggatggatccagctttcaaggtttccattaatcctatattccaaaataagtgctttgtattcatttcctgatggatcaaatgtcgagcataggttgatcactcttataagattccggtggcgaatgtttttcaaggcctcacattccgcaaaaaagtttttcggtgctccattttggtcaagtctaaatactttgattgcaacattgcaagctccaaacttcaattgaccttttatgagaatttttacagtccaacaattggtacctccaggtactggtactgctaggtaccaaactaaatccaaccattaaatcagcaggggcatgatgggaaaaaaagaaaggaagcttcgactctgatgcgttagtgttcgtgaacttcttgtcaccaccgtcctagaatcttcgccactgcattagtgctcttccacggcaccggctccggtggcacctcctggccgccagcgccgccgcagcattgggcgttcttccaccctattccttgatccgtcgtcgccgtcgattaactgctaattactctgagcggtgccgaccaacatggagggatgaagccgtaaatctatgtatcgtcagataaactttatttgacttgatttgctaaccagtttaaatctagccttcaaatgtaattaatccctacgccaaagactgaaagtgatctgaatacaatgaatccattgtggagctgtgccgtgcaagttggagattagtgctctgaatccatgtacagagcgcttcatccatctatgagaggacaccatgattgaaaaaggacgagaggggaaaatcaagggagatggtaccgccatggacggccagggaaaaataaagaggaaaaaataatcaaggaagatggttccgaatcaagcagatggatctgtatcgctggcaagagagaagcgctgtgcggcgaggatgctggcagctgctcctcgagctcctgcatgccgtcgagtcgaggaggggtggggatggtgacgctgtgtcgtcgcgaggctggaaccagcgtcctcgggggcggcacgactggatctggaacctcccaggcttggggcagccggatctagtccccagttcctgctctgattccttctcgccttcggtggtgagtggttatgcccttgcctccggcaaaaaataccagagagatcccgactatgctaaacacgaaattccacttttaccctttggactagtagtaccaggcggggtgagcggtggtaccgcgaggtactcgtctctcgacagtcgtccgatcgtgttagatcgacggtctaaatttggtaccgccttagtcttgttggacggtaaaaaatctcttatacaccactccaaatgttcccgaaccaacaagattccttgaagagaaaccatttgttgcgttgtacaaatcgttgtatgagagtttattaaaatgcctgatcgaatcattgatgatgattttcttccgcccagttctgttcttctgaaggatgatggcaacacaagccaatgtgactataacgatggaagtgattggaattcctacactaagattataggatgtcttgttccttttagatgaaagttccttgcaaagtggtaattgtagcattggagaaattgcacacaactttttgtttccttggacgaacacattgcttgaattagcaaacacgcctcctctagggacaggtccctcaagattattgaaagatagattgagagtgtgtaaagatccaaaatactcaaaaaagtctgggatttcaccagacaagttgtttcgggaaagatccatctcattgatcccttttaagttggcaaaagatcctgggatgctcccttgtaggaaatttccctccaagtggactgattctaattcaaggcactcaccaagactagttggaatctcaccagataattgattattggagatattaagtgaattaagattagttaatccaccaatctctagtggtatgtgtccagtgatttgattctaggacatgtctaagccttccgaaagtgtagaaatggaaaagagttctggtggaattctcccatacaatttatttcttgatatatttagtttagttaaagttgtgcatcttgccaaactagaaggtatttgccccgtcaaatcattttcttgaagataaagtttagtaagttgccttagttttccaattgattgagggattactccggaaaacttgttgtaagataagcttaggatcgacaagttttggagatttacaattgtatcaggaatttggccagaaagcaagttattatccattagaaagatcgtgagactagttagtttttctatctccgaaggtatgctaccagtcaattggttttgatttagaatcaatacctttaggccttctgaaaggttggtgatggaacttggtattattccttgcagcttgttcctatccaaccacaaatttgttagttgagtgcagtttgtcagcgaagacatgaaagaccaatctccagcctcaagcttattgccacctaaatctaggtaagtcaagtcagacaaggatcctagagaagggataacaccggtgaaagagtttctgcgaaaatatattacttggagattcaaagcattggctaacgaagaaggaattggtccttcaaaccttcaaatattatacttgtgagtcctggaagggtgtagccaatgttcgtcggaagtatcccaacaagacgattggcgccaaagtttagataggtaagactcgagattgtgtaaagtcctggtggaacgatgcccgataagttgttatgacttagatctagtatttgcaacttagaaagattacttaggctctttggaatggtcccatctaatttgtttccggaaagcatcagtgtagacagtgaaggaatgttaccaagtgtgataggaattttaccggagaggaggttttcagttaaactaaggtatcggagtgacgaaagagcttgggagaatggaggaatggatccagaaagaccatttgatgacagatctatgtaagacgtggtagtgctattgaacaaagaaggtggtatctccccacttaggctattattttggagattcacccatataagtggtttgttactccctaaaagttgtgggatggtgccagtgagctgattgtgtggaatgaacagtgcagaaaggttggaaagcaaaccgatatctggggggatgtttccacgaatattgttggtgccaagaataatttgctgaagaaatgaacattgaccaatacttggagggatctcactttcaatggagttgctaaacaggtcgacaatctcaaggagggaacatgatgatatagtctccggtagctcaccagtgagggaattcatgcttagattgaggtatctaagatgtgttaattaaccggccaatctcaggggagatgtggccattgagttggttgccaggcatgtgaattctggagatgaaactgaggttagcaagacaaggaaatattgggccggtgatgttctgtgactcaagatccaacgcaacgactcgagatggattcttgacactacatgtaaccccattccaaatgcatattgcagaagattcatttctccaagaggctaatgctcctgaggggtcatggagctgggacttgaggcagaggagggcctcccggtcagcattggaatcgttgtggagttgagctgacacagaagaaggaaggcagcataggctctggaaatggaagcagactactagaataagaagtagcggtggcatcactaatggcttgtgaagtagtgatggaagagacaccatcttttcttgctctagcttgattaatttgtaagccacaacgtgcgatggggcaactatatatagcacacacagtttgagtcagtcagagatcgttcagccgtctgtgtctgacgtccaaactgggaaactagtagtaatccaactatgtaagcagacgatgtttctagcagtcttcaggtctatcatatacccattacttaggtggtgtttgaatttcctgaagacaaaaataaagatgaagattaagtatttcacacaaaacgaggtggtaataatgtgtaattaattgagttttaattattacaaacataaaaatagattaatctgatattttagaacaactttcatatagaaagttttcgcacaaaacacattattagtagtttgaaaagattgccataaatatccaaaactttatcctctctttacaggggattcgatcgcggccgggcagcgttcggaactatgagtttccatcctctcctctctcatttttgcaaaaaaacaataaaaagaatatagattaaagttgttttgaaaaaccatgttaatctatttttttgttttttaaattaatacagtattaatcatgtactactaagttacctcattttatgtgaagggcaaattaataagttacaatccatgaggtgattcgaatgtagcctaaatgtatatatatgcaaggcaaatttggttacagtaaatcgtgacttcgcggttttagctgtagaacaccgcgtgaagtgatttttggaagaagacactctcaaaagttggatatttgctggtggacatcccactcattaaaataataatttccggttgaagagtaaaaagaaataatgtgaaatatcaaacttgcccttgacccagatgctctcttatactctcttctgtttctatcatttgctctgtccctagctggaaggaggggatagagagagaagagagagagggagagatgacatgtgggtccattggtacttttgatgtttcacgtgatttctctttcctctttaaccggaaattgttattttaaagggtgcggtgtctaccagcaaatattcaacttttaagagtgtctttctccaaaagttactttgtgcggtgtcctataactaaaaccacgaagtcacgatgttctatagtaaaatttaccatatatgtagtatctcgctatgcggatgatgtagtatttttttctccgaaacgattaagttaaactcttttgttaaaaaaatccaatctaactagggctcaattcacagctgttatgttatgatgtgcttatttcaaaaaatgttgagaaaattataacatatagcaatctagaaccagatttaatcaatacagtgttacgaatttaaacaggagtgtgtccgaaggtctgcaccaccatatccatcacctcgtgttggtgtggtggaaggtatgcagtactgctaattgacatgtaggccccacatatcctcgggcccacataacaatgagcattctatatatgtagtactgcagaggatttggattggtgaaaggtttctttctctaaccaaactctagaggaagtgaacgacaactttttactccctatgttttaaaattcattgatatatagataatgaaatgtgatttatttggaacagaaatggtagcatagattttataaattgatgatttgttgatatgtagatagtgaacacggtgcatctgggccccaggaccagaaagttagttgcaaattcactgtcatttcattaaattatcttggccattccaccgaagacttggtatactgaagagcggccacttgagggagcaccaacgctattgcgcttcagggtcaggtgagtcgctggctaactaattttctcagtcttgttggagcacctgcagggatcacctagtggacgcacatgctcgatcttgttactccctccgtttcaaattgtttgacaccattgactttttaagtacgtgtttgaccattcgtcatattcaaaaaatttaaataattatttattcttttcatatcatttgattcattgttaaatatactttcatgtacacatatagttttacatatttcacaattttttttaataagacgaacggttaaacatgtgctaaaaagtcaatggtgtcaaatattttgaaatggagggagtaataattagtagccaaaattttctcagcccaagaatatatacctaatgagctgtttgatagaacggaataatattactcggttttgatggtacgaaaggagagtttaagttgactattcactactggagaactgatctttgttgggtcggcttaaaaccacattagtctcatttccaataaaaaccgggattaaaaatcatatttttccggttaaaaagcccaacgcacttttataatctttagtccagattggtgttattaaccgggaataaaaatcatttttacttccggttcaaaaaagcgtccagctccttactatctttagaactaaaattcaacacgtagtatataatccctcgtacttatcctttagatcgcaaactcttcctcctcattttttaactacatcctcctccctttcctcctctcttctctctctccctctctcctctcctctccttttctttttctcgctgctctctcttatcatctccttctctttttttcttgcagcgaacgacggcggtggcctgcgcggcgggcggcggcgcgaggcgactgcgacggcgcgacggtggattttgttgatttattatttgtgaacgtgaatttgttgatttgtgatgtctttggatttgtatatttgtcatgtgaattgtgaatgtggatgtggatgattttgtgatgtttatgtggatgttgatgattttattgttgagtttggttaaaaatcaatatggaaaaaaaacaatgaaaaaaaagaaaaaaaattagtcatggttagtgttatcaaccgggactgaagatgattgtgcctcgtgggagtagctaccatctttagcctcgggtatttcaaccgggactaaagataggcatctttagtcccggattcgcggtctcggttgcataccaaggaataaaggaggttgcgaaccgagagtgtagatgcattctctagtagtgaatctaacgcaaactcgacatttataagggtcgtaggacttttctcatcctatacagtaacttttctaactttaatctccaaacacgtgtttttcttccactgccaagaaacccttggtgctcctatcttgattgggctcctctcagagcaagtgttatggtagatgtgactaatatatccaaatttattcatatcatttactcataaattaagaggcaacacatacaatacgtcacctctaatacacacaaataccaatgtatctagtactctcacatcatttttgaaatttgtgtgaaggttagctcttgattaaggggtggttcatcatctctcctccacctcatcacctaatataatgtaacatttttaggggtagcatatgaagtattatagtgcgtgccctcaagcgggcatttgtagggttttcatgatgagtctatgttagttgggtgtgttggtttctaaactaggtgttcggtttttttctaaggagcgttatgagttaatttcatactgatccacatgtcctagtgcgctttggagtttggttaatttctgcgacaacaaatcttaactagaggggtagcgcgccgttggcgcgccgccgtcaagtaagcagtttaggaaaataacgaacatttgtatagtagttggagcaagtttgtacattaaagatttaaaatagagcggacatgtgtatggtagcatgtgaaggtttgtattttaaagatgtaggaagcgaaggaaaacacactgaaagaaggccatcagaaaagaagggagcgtaaagcggcaggtgtcggttaggacatcacacataagcatattagtaagcagtgataatttgcactgcatatatacaatagattttagtgctgataataagtggccagggtgcataggtaattagggtagcatagtggtgggaagggatgcatgcagttttgctgcatgaaaacatatgggataattcagtgctgacaaaagggcaactctactatagcacagctgataaaggtggcatttaaaggacatctattgttatcttgacgttgggtgccttgtagaagtgaaagatgcaaactgaatggagatgaatggcattggttgctgcaaaagttgcccatcctctctttaggttgcaacgatcgtccgatgatttatgcaggagcatggtgactgaatcactgcctgctgcttcaacctgaacgaagatagtttttttgcgtcccatgagtggctgaatgtaggtcactgaatattccttggtaaagtactgcaattggaactgcatgttatttttttagggaatgcatgaatagaccaatgtttgtctagtgtaagtatacttaccagtctatcttgcttcatgaatgtattgttcatagtcacaatatagaacttgctggaacgctggaggaactgcccgatgatgctgatgtagtttttaatgtcaggtgtgactgctgtattccttgcacaaaaaaacagagatcgtcgaagctatgtgtggtttcgcctgtgagcacacattgtttataagattgctatgtttaattggaaagaagtcatgaaataggtaaatatggctataaattctgttagtagacaattaattatatcatgattgttgatatgctaatagtgactcggatttgttctctgtactggtaggcttgtgtgataaaatctctgtggccagaatgcggatactgatgtggtgattttagaaggaaaagaactgagttatatgtgaacagatgaaaggcttacctgaattgtcggagctggaaggaatgtcagtcatcgactctgtccttgaatctgacgaagtctctgaaagatggtgttgaaatatgtcattagtgtgattggctatagatttgtacatataggtatatatcatggagcacaggattgtagacaaatatttgtgcacctttgtttgatgtgtgtgaaatgagcatggaagcatgcttgctggtaggcatgtcattgatagtgattcctgtcgatctctttggtgctgtcttgatttgtttcttggatgaagggatcatgggcagcttgctatcttttttcttgtcaaagagaaggacatttatctttgatggagtaagaacttgaaagcgaatgtattgaccagacagtaagccagtacggtgaacaaaggttttccacccttttgagatgaagaatgatcctgcaattttttctagttcgacggtcattggtggtgcgtgcggtgaaagcaatgttacagtctgtccatggtgtgcatggcagcctcgagcaatattgttcggcagccgctgttgtgaggcacaatgttagttaagaacatgaaagaaggtcaataggaaaagaaagcgttgctgttcttacaaaacgagtgcgttgtagcgaagtgaacttcaatataggtgatgtatgggtaggcatgattgaaaaacctgaaatgtatggtaggtggatgtcagaagataaaacagagcaatagaaggattaataggataacatctacattgtaaggtcaagaactgtagatctaatgaaaagggctctgtaattttggaaaggaaggaaacatattagtatcgattacacacagtataaatagagagaaaattaaacatgttagcttatgacagggcagcattaatgttaatgtggcgagttctacacaaggctgccattgttgctagtttttgttgagcaaaggacattggtagggtggaagagcagcatggctatattagggctgaaggagtttggatctggcatgggagatctattttgtagtaagaaaaaaaaaccagtggtgttgtctagatgttgtttgttggtggggaagcagaaatgctgtgtatttggaaggtgcagagagagtgaaagagggatgatagtggtaggaggaagaactaacctccaaagtggcgctcagctggcggtgggagtagaatcgaccttggttgatggcgattttttttgctctttggccggtcgctttgtcttctctgtgctagggctagggtggttgaagaaggcaagaagaagggataaggtttgtctgacaaaaaggaagcgtcgagagcatcgcatgggctttgtgggccttcgtacggagaggaagtaaatacatgggctttttggacctctgttttgtctgcacatacttatattagtggctttggagcattggctgagctgctctttgttgtagtgccgtagggaaagttcggttgagagcggcggcggcggctttttcctctgatgcatttgcgcagatctgaagggattgtgctgaccgcgcttgctttgtgcgcggtgagtatcgacgaagttgtgcgaggtgggacggcttggtagaaagaaaggaaagcgcacaggtgagtacgatctttcagattcggtttgtctgccattgctgttgaccatgaggtttgttttgttggtaagattgtttgcaatgtttggttagtccgtgctggagttagacgcgagaggatgtgcctggcttggccgagtgagagcgtagaaatgtgtagcagaacatttactattgtttgtgataattcgttaaggtctgggctgatgatagtaggaagcaaatgctaaggtacatagcaatctatatggaagaggtgcatttgttagttcctacgaaaaaagtcactgtctttctgccagtagaacaaattaggtgtgtagggagtaatacttggtgtattgtttgcaatgatagcatgtttattttaggaagaggcaagatgtagtttgctataatcaatactttatgctttgtctagctcataagaaatgaagaaaaacttaaaggacaatgtcttccattctgtaagattggaatgcaatatttttggttgtttgggcttgttatgagactgatcatctgtagatgtgtttgtgtgtgttttctgcaataactcttctagttggatatgtcatgtagggaggcatcagttatctgcctggcaatggacaatattagcaggatggagagtgctcctgctgttagcgctgacatggagtggtgtgatgaatttggtctaggcagtgaagaatggacaacaaaggttgaaattaagatcagaaatgtcgctgagcatgtgtgtcacccggaaaaaatggaaagattagtatcgtctttctgtgatgtacaaacatatagttttgatgcaatgaaaaaggagtattatatttgtggatttgctcgtagcattgaatcaatcccaaagtataaatacttgaagataaagtatgggacagagaatggagtctggattaagtttttcatgcttaatctagaggctataccgtacgttgatccagaaaaagatgttgtggctaatggtaaattcattgtatgattgtaaatttattatattggacaattgactttttttctatctatgatgttagtactaatctgtcatacatacagagaaggatcctgaactgtatgaagatccagatgttgtgagagaagcctttgaaagtcaagttaggctgcaacgcattgcaggtatgaatttggtctgcggcgtttaaatgcatgtcggaactacatatggaaactaaaagtaacacctgttttgttgtatgctgtataagatggtgaggaaagcagtatttcggccgatggctctttgtgcatgagcattgactctgactggagcctgaagtatggtgggcgttgaatagaacaacaaggacatcagaaagatcagttgtctatgaaagatgccaagaagccaactatttagtttattgtatatgatgtgctatataatatacaatgtagcctcgtagcttttgtgttgagtattagtatgctgtgccgtaacatgttagcatgtattacagcgtgctgtatgtaacatatgggttgtttgattggttagactgccgtgtgggactgttgtgttggatatatgcatacgtcattgtaagatactaaagtttgtagcttttgtgcacgatattagtatgggttgtttgtagctggagttatttcatggcctacgctctcttgtgtggctggaatctatctgtgtatcataatgttgcaaggctaaccgttgtgctatgttaatatcacttaggtatgtctgtgtgaactgcattgtcactctgcattagcacacgaatatgaaatctgttcgtatcttgcatgagaaactatatactggtcagggaagagaatgatgattgttctagattatatttcctggtctgtctgattttattcattagctagttgctaaccaatagagggtgctggcagcaaggccaagagggttcgatgtgccgtgtaggatccagaagacatggtcgttaatcagaatggaaaccatgccattctgctggtaggcaggagaaaaggagtgttttttgatggtagctatatagacaaggtaaataagagagaacgcttaggtagattatagggataaccatgtctttgtagcagcagtctagaacacacaacagtagcagaagcaaacataggcagcatttccctacgataacgaccatggacgaaagccatgaacaaaagaacttgattcttagcctaaataaaggaaggaggctccttctgcgctgtatccaggttgatggcctatgtacacataagcaaaagccttgctacgcaactgcatgtggagctgttatttgctgcatacaagatggaaaagtttgggggtcaggactgtgtttccatattgtatttgcaggtaaataatgtgtgttgtgagtggtaacctacacctgtgtgtctactaaggagcatccttgaagagcttcttagcacttggatgtaggagcgcaggtttttccctgttgaggtataaggacatgttagtaataatggaaaaagggagtgaaatatagatgcaagcaacttttatgtaagaaccttttcttggctgtggctgtagtagctgatgttgcggctgtttgcggaatgtcctctgcatgtttagctgtttgttttgccttgtagaacaaagaatgtttaggtggttaggtctaagcttaaaggaaagaaaagcaggaataccttggactcaggagaattagtgacaacagttgtttcaggagcatgctctggatgtttgacctcatcctgcgcacaacgattggccttgcaagattatgtatggggtgaaaacctaaatagggtggcaggaagaacaatatgggcaggaaaggtaatgacaagtgttgtaccttaatagcagtgtcaacattggtgctaagaggctgcatgtggcacattgaaacaacgatgttttttttctctggtgttgaagaacttggtttgctggttggtgtgctctgtgtgggagtaccaataggtgactttgttggggttgaagtgctgtgcccttgctggacgagctgttgtgattcagagcttgtttggctttgctggggccctgtttggacagaactgctggagcttgcggatgcaatagctgatggttcctgggaagaacccggtggcataagcagcagtggctcatttgaagggccagaggaaacaatgctgttaacctggagagattcttggcttcttttgacagtatcacgtgtaaagctgacattccatgtaaatgtgctatcaacaagcgctgcgatctcagctggaatgtaatcactatctggtggattgtcctcaatgagagattccactgatttttttatgaggcggtgtgcaactcttccaaaaaggataaatgtagcattggagctggcatcaccggcgatgagcactactttatatctacatgggtaatatacatgtgtatattaatgtgtgcagcacaattagtaagcatggaaaaatctggaatgaggtgtggtatgaaccttggatctggtattcctatgttagaacagcttgagcatttgtagctagaaccgtatggcttagaagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgtttttgtgaggattgagggcaagtatttcttgaatagttttttcctctgcagtgtcctggttgtaacctgttgctgggttatcaacccagctgattggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcagcgtactaagaatctatgcatgcatcaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgaacacaatcattaggctattgtcgactggcctgtatgtcctattcgcatacctcacagtaaaggagtcaatatagtaaaccttttgttccttaagcaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtaaaaaatttcaagcatcaagcggcggagcctgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtgaagacaggcttcctaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtactatacactgtaaaattctgtctcctaaaactgtgactaatagccttgttccattgcataacccaattgattgattaagatttcgtagcagcattacaacaacaccttctttaagaacaagtttatgcgttggaaagttagtagcatttattgaattcagaaactctagggggtataacagatcgaaatctggaatttgctcagagctttttgatatggtatcacaacttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaaatcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagttcgtgatagatgcattgattatagcctgacgggatcctttaggaataactgggagtatttgtttgaaatcaccacctaggacaataggctttcctccaaaaggtataatagaatttgaagggcatgtctctgataaaatatctcgtagcgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcgattggtattttaaaccgagaatgagctgtcctacctctaggcaataggagagatgctacccctgatgaagcgacagcaagaacaatcttgttttgtgatctaagttttgcaattattgtattccagagaaatgtcttgccagttccaccatgaccagacacaaaaaagaaaccaggttcattagcgatagcacgagaacaaatagtgttaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacatcaccaacagaacagtaaagaaggactgtcacaaaaagttgtctaagctgcgctgaagacgcagtcactatggcctcatcaaaaaggagatgccattcattatctccttcaagaagccctcgtgcctcacatgcctctctatacgtgccataaacaacaccatcgtatgtgcgaacatcagcatagctttgagcacctttgacaatcattaacaacatcctaagatagtaaagctcgcctgcagttggatgcacataataaattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcacaggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcaccgcaaggaccatgcatcataaactcgctaaccaattcatatcctagccggtcggtgtcatagtcaggtatttcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctatgaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatctgcaatttcttgccatttggaattacatgtgtatgtgacaaaaaggtcaggaggcccatagacacgacatattgccatcgcatcttgataattcatgaccatatatcttcttcctccagtgaagctagcaggaagtatgacacgcttgccaactgaatctccatcagtgacacctttatcaattgcatcaacaattccatctacagactcagagcgcagctctttttgatgatcgatgaagtactgtagcctatttgtttcaatagtagaaaatatatcaacatcgatttgatcgctcaagcgaccatagcatgtgaaaggatttgattcatttagtctgtaatgcatttcatatctataatattccggcatcgtgacatactttttgccaattccatcatagttactgtatttaatgcctaaatggaatccgcgttcaccatatggaaataacaaaggatattgcaatgccatataagatggatgcaagggagaaatctggcgcaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgccgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcatgcagttttggcaattgtatgcgtcctcctttgcaacatagattgtaaattatttttctttttgaaatagcagatgcactcttgaccctctcctggtaccagaacatggcacgacaatacgggcattcatacgtcggagggccatagtatgatctgtctgggtatgatgctgccacaaaagcgctggacaatgtcaaaaatagtctcgtgtaaaaaaacaatacattacgtgcacgtattcagaacagcggccgaaccctttagcaatcggatatactccttgtctgtccgggaggaactaccgttggctcgtgcagtgcgatttgctgcgaacaaagacagtaaaacggcctatgaacctaaactgcacgaaaaaaaacaagcctaccatcacagacaacaaaaagagcataccatccacattggccaaaggaacggacggatccatatttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaacaatataaaacgaccgaaagctctggagcaaccacatgcagatttagacagcgatgaatgcaggcaatagaaacaaaatactaaaccaatcaaccataaataaaggacagaaagattaatagcgcgggaatacctttagcaaggaatatgctcgtcgacaggcagaatccactaaaacgcaccacgaagcgaacacacaagctgtgaacagaggcaaggaagaagacggaacagagctgcagagaacggagcatgatcagtgaataagaatgtaggaagcaaagcataacacaaggccaatgaaaccagcaacaaccaaaagtacctgctaggtcttagaagcagcccgcacacgtgcaatggaagatgatcaggaacctttaaaggtccattgcagcccatgcagatcgcctcccctaaatggaacaaaaggtgcagggtcaatgctagcaagaacagccgcgcagtcataagcaaacaaacaagagagaacaaacataaaacccaaatgacagaacggacaggagaaccacacgcattgatccaggccttaccacgccataacgaaaagttgaacaggagcaaaacgagtgggagtttctcgagcaaggaacagaacagtggagcgaagaaaccgacgagaggaggagaaaccgaagggaagaaagaaagagaaacgcaagtagtaatatatacagacaaagatagaaggggttctccgccgagctgcagcaaggaagcaaacaatcatgtacacctgcacaccaaacacccacaaataggaaccaaacaaatggctagctgagatgacactgccccacctatcagcgatataagtgcagcgcacctagctacaacccaagaaaacctgaccagagattagctgtgttcggctgagggagctgggaacgcgcacagtacttttcctccgtgcacgcttttcaaactactacatggtgcaattttttataaaaagtttctatacaaaagttgcttaaaaaaattaaattaatccatttttgaaaaaaaatttagctaatacttaattaatcacgcgctaatggatcactccgttttccgtgttcactgtgcgcgctgggaatggatggagccgaacacagcctaacagcataggctgcagaagaagaagactgcatggaccaagccgaatgaaccaagcatccaagcggattggacatggcccaggacgcagaggaacggggcgcatacaccaggaccacagcgatgcctgatattgacaacccacgcaaacgcaccaatagcggagaagccatcacagagtaatcccactacaggcgcggtctccaacagcatatggtcctagaccgtaacacacaggttcagaataaagcagacccaccggccagagagaaactgtgccatggacacagcgcacacgcgcaccaagcgaccaaagcaatctgacacagcagctaaggcaaacagcatagacctgttccacgttaggtacgaacaggcagaggccatgcggcccacacggcagccacaggcaatctgtggaccatggctacctcaaaaaacaaagaaatgcaccacgcaacgcataacaccggagaaaacaatggcaaggacacccaccctaccctgcgcgcggcgcaatgcaccgcacacaaaccaaccaaatgaggccaccacacagggaacaacacgtggcggacgcaacgcagagaaccagcggacgagaaaaaggaaaatgtggcatgccaaacgcaccgacgcacgatggtcatccaacggcggagaacgcgcgcaacgaccgcgctccaaatccacccctgggctccggctggatgacgtgccaagcaacggcaagggccacgacagcgtaaatcgccgcccagagcagccatttccggcgagtttgtatatagaagattaggcatactagtcaccaatctgtagcatggactattgttagcctcgaatttgatcttgtatgctggataattcgttattttcccattttgatggcttgtattaaaaacactagtacaaaatgattttttgcagatagtccataaggggtttacgtgtgcggcatcgctacccgcacgcactaaagggtcagcgaaaatcactatttttgcgtgcgggtggcacacccatacgtgaaaatcggatgatcgaaaaaaaattccgaaaacgcaaaaacttaaccatagcaagagacacttcttcgtgaggggacatgtcctagtaggacatgtttactatatgttcacatcccttcttcttgctttataaatacgtacgtgtaatcatccatatacaaacgtaccaagtgaatacaagatttgatccctcttgctcaatctctctccctcccgcaattccctacaacaaaaaatgtacaacggcaaaggcatctgatcgcatgatgatgtgtcccacgataccgccaccatgcgtggattagacgtcactaaaatcaatccacgcgttaatttggactaatcgatgcgtgcgcaccggttagattttgtgttttgcattatgcacctcagttgaattggtcgttggccaggcagaagactttcaaaagattaaacccacaaggatatttaccaagacaatcaattattgattcatagctttaccgtgtagatataatgctgctacggaaatgagagatacgacgtggagatggacatacatcgactttattagaacagcgcatttcctccgtttaaaacataacaaaaacaaatctaacattggatataatccagtactcttcctattctagtattggacatgatgacataacctatcttacatagggataaaaaaggggttcctaacgcgcgcgtacgtgccgcgaacggaactcgcgcgtacgctgcccgtcgctaacatgtgattagcactaataataacgtgatagtgctaatcataattagtacctaattttttttttccttttttctaatagattaaaaactttcaagttagatttgaaaactttcaacttaagatttaaactttgaagttaaattttgaaatctttcaatttcaactcgaaatttaaatttggaagataaattttgaaaaatttcgactcatatttaaaaaatttcaactcgaaaattgaaaactttcaactcagatttaaaaagtttcaacttggatttgaaaagttccaactcgagatttgaaaactttcaattcggatttaaaaacatttaactccgatttaaaaactttcaacttgagtttttaaatttgaattatgaaagatatttttttattaaaaatatcttataatagaaattttgaaaacattcactacatcctaaattaactaagatgaaaatggatcgtatagatgcatgcatgcatgtgtgggaccgaggtgcatacatgcatgtgcagttggcttgccacgtgcgcgcgagataagcatctgctgcgtctgcgcgaattagcatttgtgcaaaaaggggcagttgatttaactacggtactaataaaatattagcatgcatggttgacgttgaatgagagcctatattgttcaatatttgaacgtgcacaattggttaaggttaccttgttttcttccaatcataatagtagatggttataagtcaccgccatacatactgtacttcagtttgacctagagtcctagagagacgaccactcactatccaggatgcatatcgtactagcaataatttcaatccaaataggtggctcatggttgattataataccttcgtgcttaaatgaccatgtttctgactacataccttggacaggtacttaggaattatttagttgggaaaaattttttaggtttggttgtcacattggatataccactactacagaaaaagtaaaaggtgccggttcggaagccctaataggtgccggttttctgaaccggcacaaaggaggcggcactgatgatacttgtcatcggtgccagttctagaaccggcactatatggtcctaataggtgccggttctaggccaaattgtcatgtggctgtcaaataggtgccggttcgcggcgcgcgtgttaggaaccccttttttatccctatgtaagataggttacgtcatcatgtccaatactagaataggaagagtactagattacatccaatgttagatttgttttgttatgttttgaacggagggaatgcactgttctaataaagtcgatgtatgtccgtctccacgtcgtatctctcatttccatagcagcattatatctacacggcaaagctatgaatcaataattgattgtctttgtaaatatccttgtgggtttaatcttttggaagtcttttctgcatggccaacgaccaattcaagtgaggtatgcatgattacaaaacacaaaatctaaccggtccacacgcatcgattagtcctaacgcgtggattgattttagcgacgtctaatgtacgcatggtggggtgggggtatcgtgggacacatcggctgtatttagatctaaagtttagatccaaactttagtccttttccatcacatcaacctgtcatacacacacaacttttcaattacatcatctccaattttaatcaaaatccaaactttgcgttgatctaaacacagccatcattatgcgatcatatgcctttgccgttgtttttgttgaagggaattgcgagagtgagagagattgagcaagagggatcaaatcttttattcacttggtgtttgtacacggataattacacatatttataaagtaagaagggatgtgaagatattataaaaattttggcgtaccacatcggatatacggacacacatttgaagtattaaatgtagactaattacaaaacaaattaccaaaaactgaagttatttcggaacggagtaagtactatgattggatcaacatatgttggtgcttgcccattcaatttatccttactctttggtgttgaaataaggttctcctagccggtgttcggctctgaacgagttgcatgtcatcaaatcgccctctctcactcgatctggtggctaacctgatgattctgaagattttcggacggggaacatcgaactgaagaacaagttcagcagaacagagcaaaaacagaacaaaacaagataaatttttgcattgcgtaatgccgtgcagcttttcgttttttttctctatttattcacctccatatcaaagaagtctgttacatgtaaaacatgacaaatgaaacagctagatctgagagtccgtgccatgcatcccacgatctgtttccagctcggtcacaaccgactaaaaacacggtagtagctgatctgaataatggttcctctggactatttccagtcagcctattacatgcacgatgagataactgaaaaactaaaaatgcagctatacacgaggaaatatgaatgctcaagattatcccaacattgccatggctccgacgtgaaagcaaagcactgccaaaatagaaagacgtccgtatatatgcactcatgcatcaagtcatcggtcggggtagtggactggatcaagtcagcagtccacgggtcattgccactctactgtccctagcaagacattgacctcaaataaatatggcagataaggacttgaccgacgccctgacctcaaataaatatggcagataaggacttgaccgacgcccctctcgagccctttttacttatatgggtaaaaattttgacgtgtcacatcggatatacggatacaatatttaaagtattaaacataaactaataataaaacaaattacataaattccgcccttaaaatgcgagataaaattattaagtctaattaatccgtcattagcaaatgtttactgtagcaccacattgtcaaatcatagagtaattaggcttaaaagatttgtctcgtaatttacacgtaatttgtgtaattgtttttatttttaatatactctatgcatgtgtccaaatattcaatgtgacagggtaaaaagacatactatacaacccaagcataactatttttttggataattgataaaagtacaaaaatatataaacacgtgaaaaaaatcgtatagtaggtaagaaagaaaattttagaactcatatctactatattatcacataattctctcgcaacaacttgcagcgtaccatctagtatatatataggctgcagtgaatttataggtgtatatatttctcctcgccgaggccccaaaccacagacatatggtgctagttcaatgcccatgtttctgatgatcctgcttcttatcactggcagcctggttcgttcggctgccatctccgaaccttcgattgccatccccgacgacggcggcgccacgacggtgtttcccggggccagcatccgcctactccatcgatagttggttgtaagtgccttcctttccgtcagagagaatttatctatagaaactcttgcggaccgttgcgcgctacagattagtcgtcgtgtcggctcaaacgacggtaagaactaacaagacgcttaagaaaggcgatctttaggttcactacattcaaatagagaaaatataaatataaaaatatatataatcaagataattacgccaccggaaaggtaaatatatacatctagaccgttgttcatatgcacctcaatctcctggtcgacatgtgtacaaatggctccagtgcaaccgtgttccatcatgttaccttcccggtggagttgctatatataggcacagcatatattaggtaccatcaaagattgagcagtacgcactgctgcattcaacactccaattgctagtgtggatgttgatgccactgcatattagcccttatttagttttcaatgttttcctcaaacttccacctttccatcacgtcgaaactttcctacacacataacttccaacttttttcttcaaactttcaattctagtcaaacttccaattttggcatggaaccctaaatgacacgttgaaggagacagcttgccttttgagtttttttttcctaacagctttgacttttcagttgttcaccgttgtgctgattttcttcagcaaactagcctgccactacagtcgatactctaatttatgctgattttctattcttttacactaactttgcacttatttaattatatatattttttattttcatatatatagatagatgtatccacatatccatgttacttacggattctgtaattagtttttctattagtgcctgaacaccccatgcaacatcctatataatacccgatgtgacatgctaaaacattacacccctcgatctaaacaccccctgtgtctgtgtatatatatataatctcatcttcaaactcattatatatatagatcgagaaaaaaaaagacaaatacctgataaatttatactcacaaaactatcagaatttttatgttatttgttacaattaaaatataatgaaagtatttgtatatttttttctagatttttgagtgaaatttgttagttgatgtgcatggtatgtacacgagaagttttgtgtgcataagatatgttcccttctaataatatcccaacatatgaatttatatgtacaggattgcatgtgaaaaatcaatttgtgtagtacacgcgataagaacttttctaggtgtgaccaccctttagctaagtaatcttttcatttttagaacttttctaaaatatatttagaattttatttttattttggaccttctaaattctcttcgtgagcacatcaacatactccaacacatctgcaccctcatgccaagatctaccctattaatttacgtctaaactcacatcttgtgcagagtagaggttggacatgtcaaagacaaaaacggtaattaggtggtaaaaaatgtaattaagaatagtaaaaataaaaatattggataattggttcaaagtaaaactatgataataaaatataacttgaagtgtaatttactcaaaatagaacaatatgaaggaatgaaaacttagatctggaggagccgaagctaatctcgtgcgcggctggaggcatgcatccgccaaacgctctactcccaatatactcccttcatcaaaaaatgtttgacgccgttgactttttaaaaaatgtttgaccgttcgtcttattcaaaaaatttaagtaattattaattattttcctatcatttgatttattgttaaatatacttttatgtatacatatagttttacatatttcacaaaagtttttaaataagacgaatggttaaatatgtttaaaaaagtcaacggtgttaaatatttagggacggatggagtatatatatgttgcaatcgtcctcctgggcctcaaattaagacaagagtaaattggatatgatcatagatatatatgatcatagatatatataaatgccaggtaatacgtactagtagtattatagtttcaaaaacaatactgttaattaactaatctgacttgtggctacagaaaaatcgaaaactctacacaaactctctttttctccgtacttcggcaagcactcgcggtttattttcttgtggaattttttagtaaattcattttaagttcttatcatgcaatttgcgtgtatttttaccaccatagtaagttcctgattctagcagtgaatcaaattaaaccagatttttcggttttcgtgtgctatgcaggtaccaacgacccttacattgttaccagttgtgctccttcacatcgtgcttaccagtgcaacaggccaccatgtgtccatatcgttcatgcgagcaccgcggagcaacgtttgccttaattatgtacttcctcagttttataatataaaatagtttaggttttgaataaattaatgcatgaattcatgtatgtgttttaatgacatatacaaattcatataaatgttagtgaatctagacaggtaaggtaagagagaagtttaaatgacttatagtgtgtaacaagcgtgttgggagtacgtataggtcccggtatatgcgaatttctgtacctttttatcttatgtatttatatggtcctattaagaagtgtcttttgttcgtatgcgtcgcagtagttggcccattgtaatcggctagatggatcctgtaaattgttaatgatgtacagtgtatatatgaagaaaataagattaatttcaactgaggctgtttcttaaatgctttttatgtactaacagcatttgtcactcttcacattatgacgatgcaaccagagtatgtaatcgatcaattcatgtaggaagttggtgctctgatccctccatttcttattattatacattttaatttttacctaatcaaacttttttagacataactaactttattaaaaaaaattagtaatacatgtaacatcaaattagtttcattaaatctagcactaaataaattttagcagtacatttgttttgtgtttaaaatcactgcaacagaatcgacttgcgtagatgagcccccatccaacttccgctgcgattatattgataaaaaaaaagactagcatggtaaaatcaattttcgcagacgggcctcttaactacctcgcctaccactagccaaccagaccagcatccactctctcttccgtaaaatatctttgtattctttcccccatccctctccttatcctctctgctacacctatcttccacttcctgttctctccacctctccgctccacttcctccaacggcaagtggtagcgggagcagtgagctcgagacctgtcagcgaccatggggtctggcggcgagattgtgagaggccgttgggtgcggaatccggcggtagcggatccggtgggctctccccatcccgtgtagatccaaccgactccgctccctcgtcgtgcgttgatccggtaggcatgggcgcatggcctctcccactgcaagccgacatgcagatccgccaatggcagcaatggaaagagatgtcaggtagggtatcagtgataatgacaatagttgccggataggtacacgcgacggccgctaggcacgggagctgcatcccgcttctagctagggttttggattttttgggaattcttttttagctaaaaattctttttgcaagaggatgccctaacagagagaaaacaaacggtctgttttgatacgctctctctcgtggcccgatcttctggtgagagggataactctcgctttgatcgagtgcgacgtttgcgatgtggctaccatccagaataagtctaggacgccgtgcaatcgctacactacaaacgatgtcgtaccaaccgtgacgcgcggttgatcatccctgcaatgcaaacgagagaacactgcaagaacaagataagatgcaatataaatattgcgaataggtgattaagcacaaataaatagttgcgattgaagtggtagatctaatcgacccggcaaatcaacacaccaactattgggggctctgaatctatagtcgccgactaatcgagcgaggactagagacaaggtgaatggcacttggcaaaattcaactaaacaaaacccaaatgtttttgaggatgtacaaagctatttatagaggaaaataaagctagggttaagtgctaattcgtggaggtggagggagacacttccgagatgggcctagtctattacaaggcccaaggcccaagttcggtttcagcaacaatactgtcttattttggcgattcccgttgactcgagatgaatttggacatgagaccagatgcgtttgaaaggtagcgagataagctttccacgaagtccaagatcacccaaatcggagttggcatgaaggtgctaggtccgtttgaagtcagtgctatctccggaggctgaactggacttggacttggaattatcattggagcgtgtgaagttatgagcgtatccgatgaagtgatgtcctcatcatcctccccttcttgaattggagttgtcctcgactcaatcccatcttcttgattgtgtgcactctctcgtccattggccatccttggaggtatctcatcgtgaaaaacatcctcatattcctgcaaaaggttagtaatagcgggtggcaaagaatataaagtactaggagcagtagccaatgtgagtataggatctttgcaaaatagagcatagcaagaagaatctggctgatctagtgcacaaatattatatttagaagccaacaaagcacccttcaacttaatttcattctttgtggtacttggttctattttactagttgaagcaggatgtttagcaataatctgattttcacttttcgctttcttttcacattcaagtcttgcaaaatcatctttcaaagcagcggctggagtcatagaatgcaaaacaactcttttaccatcgaacataaatttatatgtattagtcctaccatcaaaaacaacttctctgtcatattgccatggtcgccccaaaataacagaacaagattgcatatgcacaacatcacattcaatttgatcatggtaggagcctatagaaaaaggtattttaaccaaacgggttaccttcatcttaccacatgtattaaaccactgaatatgatacggatgtggatgtggatgggtagtcaagccaagcttcttgaccatctcttcacttgctaaattgttgcaactcccgctatcaataatcattttgacggtatggcctttcacaagaactttgctttggaacaaattgtgacgttggttttgctcttcacacttctctttagcactaagtgctagcttgacaattaggctaggatactgatctagcgactctggatgcaaatggactttctcgatgtcatcattatcttgtcctcctgcgtggttagtggtagctaaagcatattcatcatcacaatcactagcagaagtatactcaccatcagcattcacaaatagagctcgccgatttggacagtcacgtgcaatgtgtccaatgccatggctcctatgacatgtagtatcacgggtacgtccagtggaaactactgaagtttcactcttggctggagtctgaactgaagcatttttgcttgtttcttgagcatgggatggcgtggaggtaggtggtgtggaagaagctggacgaacggcagtagtagattgacgtggtgttgactgtcgtgtagaagtagcacctgcaaaagaactcctatgcttgttgcgtccctgcacttctctttcagctttgcaagcaaaatggaataatctattcatggtattgtattctttatattcaagaatatcccgaatttctctcttaagacctccatagaacatagaaattctagcatcctcagtttcttgcaaatcacagcgtgacaaagtaatcatcatctcttgatagtatgtttctacagaattgggaccttgtcttaaaagttgcagtttatttaatatgtcacgagcatagtaaaaaggaacaaatctagatctcattgtacgtttcatatcatcccatgttctaggtctaagtcctctaccacatatatcattccaccatagagatgcaaaggaggtaaattcactactggcagctttaactttcttattatcaggaaaatcatagcaggagaatttttgctcaacagctaactcccaatctagatagacagaaggctcaaacttaccatcaaaagaaggcatagtaaaattttaccttagataaaggatcatctttgtccctaactcgacgttgtcttctatttctaacactctcgtcttcctcctcatcatcagcaacagattgctcttcatcttcattgtcatatctttggtgtcgatgggcagtggcacctgcaccttcttcacctgcagcctcaagtaaaccaatgcgtcgcacaatattttcatgtccaatattcatattctgaatgttttcagttaattgtttatgtgattgattcattttctcaatttgatccactactttcaccaggctttcacttaaggtttttaaatgtttatctgtgctttccttgtatgatttactattacgcatcaactcttcataccaattttccatgcccttcagtttatgcgctagattctccagtgttggttcatcggaacttgtacctgacatcgttagcaagcaaaagaaactcacaagaaagtgtcagttcctaacaatctatatatatgtggaggttttgaaggcactcaacactcaagcatataccaaattcttataatattctcaatgaatgcaaaaactactgtggctggttcgtggcacaatgacacgcttgatgagtggagcgattgcaaagccgaacctgtaaaggttactagtatgtggatcttggtaggcttaactatatcacaaggaatagcataaatcaaacagaaatgtgaaattgaataataatccaaagtactagttaaaattgctggcgtagcctagactcaatcttagcttaagcaagcaaatgatcacagtcggacaatccacaactcgctatagtaagcaactctctccaagattccaacaaaaaaaaaattccacactttctttttctggttttttttctctttttttttctttttctgattttttcttttttttccttttctgattttttttcccatcgtctaccatacagccgaaatatttttttttcttccatcaccaaacattagttttgagccacgcaatttcattcagcttttgctttattgagttttgatccactgtcgagtcaagtgctggtttaagctctagattagtcttggtttgagtttgcaagtgtgcgtcgccaccgtagagaaagttgcgcagaagattgataggtagcagattggtttgcgagctgaggttctgttcgcatctgagacgattattttgttatcggttgcatgtaccagataattagggaaattttgtttccttgttattccctccgagattttatcgtgcaaccaagtgaaaaaaaaacccagatatatttaccatactttaaaccgagcaattttactgcgcatgtgtttccttgatggatcagctgcttatttgattaagtctctccttgatttcatgggcatgcatgggagaagttaattctgtaccgaatgttagagcctagctttcctgtacgtgcttgcagactagcaggttttgctatttcgttcttttagtgtgagtttgctgggtggtctgtaattttttttttttgcccagctattttgtgtaatagctgtcgtttgttaaaaaaaataaagaaaaggcagaaggtgcaaaaaaaaaaaagagaaaaagagccccaccaaaaagaaaaaaatcagaaaaagaaaaaaaaagagaaaataaattacaaaactaaaatcctcaccaggcaactaaagctctgataccaactgatgacgctctctctcgtggcccgatcttctggtgagggggataactctcgctttgatcgagtgcgacgattgcgatgtggctaccaaccagaataagtctaggacgccgtgtaatcgctacaccacaaacgatgtcgtaccaaccgtgacgcgtggttgatgatccctgcaatgcaaacgagagaacactgcaagaacaagataatatgcaatctaaatattgcgaataggtgattaagcacaaataaatagttgcgattaaagtgatagatctaatcgacccggcaaatcaacacaccaactattgggggctctgaatctatagtcgtcgactaatcgagcgaggattagagacaaggtgaatggcacttggtaaaattcaactaaacaaaacccaaatgtttttttaggatgtacaaagctatttatagaggaaaataaagctagggttaagtgctaattcgtggaggtggagggagacacttccgagatgggcctagtctattacaaggcccaaggtccaagttcggtttcagcaacaacactgtcttattttggcgattcccgttgactcgagatgaatttggacatgagaccggatgcatttgaaaggtagcgcgataagctttccacgaagtccaagatcacccaaatcggagttggcataaaggcgctaggtccgtttgaagtcagtgctgtctccagaggccgaactggacttggacttggaattatcattggagcgtgtgaagttatgagcgtatatctgacgaagtgatgtcctcatcatgtttggttggagggagtttttaggagggattgagagtttagagggatgaggctattaactattttgtttggttgggcgacatggtaattttggtgggatgggatggggaattgaggaatgaactccctccttttcaatacctgggtaggggcaggtaattgggagggaattcctcctttacttcgcctaaacaaatatcagccatccattttcattaatgatctaatctccaactaaactccctatcaatttccaccacctctaccaaacaagagactgggatgaaaaatcaaattcccatcttaatctcaccatcaattcccttgtataaactcccaatccccttccctcaagttgccaaacaagccgaaatggtaagccgctcgcgtagcacagcctggttacgcaaattggtttactctctctagctaaaggacgtgactagacagctaccggtcgttggtttgtcttatccagcaaccattccatccggtataaatcccccttcaacttaaatcacatattatttttaagatatatttgtatcattgtactccactcaaaatatgtgtcaaaacgagatccatactgaatatattcaaacattttattaatttaaaagtaatttattacatgttaggaagtaacttctatattaccaggaaataacttttacatcttatacatgattaattatcattagttacttcatcaatattatttacaatccatcaaaagttttatcttcttttctcatactacattgaaaacaaaagtgaaaaggaaaaaacaatcaatgcttaaaatagatttatagaaagatacttcttaaccatgcaaaagttacttccaattaacattgtagttactttaaaaattgttaaacttacttgtgctgattaaatttaatataatttaatttctagatatatagagtcatatttttattcctacaacgaatttacttctaatgtcgtgacaaagttactttatttttgttttatgttacttttataatatatgtaaattacttttaggctttattgaatttacttttatatgtcttaaaagtaatttagatatattataaaagtaatttgtattttttcatcaaaatataatcatgtgagatcttgttataaagatttatttctacgaacataacggtgtaatcggatcgtagatcggatgagtagtttaagagaaaattttatttgaagcataggtggttcctatttgcttggactaatattatattttcagtagagtaatggcttcagtggtgtcacgctgtaggagtaaaccgagaggcttcttggtgtagattttgcactaattaaagtgtgcaacatcaaacattccagtgatgagtcacggtagttagtcctgtttgcctccttagcaattgtgtggcactagctaagctattattatcagtgaaaaatacattctacatctcgttatgctggtcgaatcgaacgcatacgaaaaggtttcgatttcagcactggtatatatgatctcgtcgtatagttcgagcagacgaagagcttcaccccaggccttcttctccacacatttgcctgaatgatctgtttcagcaacagcaatatctgcttttataccacctgctattgacacttgtatttcaagttagtcatagagccagacattctcgatgctttccaagcctatatatattaattacagtatttaattagcatctcagtggctcagtgtcacagcattgtaaatgatacttctatgacacaaagcattcttgctcctatgatagttttatctatggcattcatataatgatcatgccaaatcataataaataatttgagtttattgacccgaaacaacaactgcatacgtcgaaagacgtggttactccacagtggttggaaaagaagtaaagtgtattaatttgagaatttttcttggggatccccctattacatggccttatgagactatttatagcccttattacaggatcttactactagggttttagttatacaggggaatttacatggttacccttatgaaagggatatttacatgggtgcatagtgtaattgaggttcatagacctctgatgggtcgtcgggcgatcgtcggcccaatcgcccctaggattgatgagccggaaaaggcttcttcggccctcgcgggggcgaggttgctttggtgaagtcgtctcccttcggcatatactcttcgccctgcatccttcgcgcaagaggcctctagcttggcagagtacccgcgcgatccctcgcctctcgctgtccttgttccatagtcttcgccatggggggacttcgccccgactaactttgacgtctcggacttgaatcctcactctttacatagctttcggtagattttggttgaaaggcctcgtgccataccgccaacaatatatatggtgcggacacgctataagtacatacgaagcctgaaaacaataaaattttaacgagcattttgctgacttgtcatgggtcagggcaaaagccaagtgttgtccatctggctccatcgcgctgtcgagggccatgtccaggtacaagttctgtgttaattatatgtatagcaaaaaaatgatctcttgacaagttgttgatgaagttttttttttttttatggatcgttggttattatttttagtacaacaattaaggtggcttcatctcatctgtggtacacatttcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatatcaggcccccccgggatctttagtcccggttggtattagatcgtaactttagtcccggttggtagtaccaaccgggactacagtcccacccctatatatatgtcttcttcctcctccagctgcccgagtaagcttcaaaatttcttcaaaaaagaggggaggtcatgccaaaatttctattgaatttattttggtgattaattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaagatgaagttgaagacgacaatattccggactttgctcagtatgttggatttgaaggaaatcaaacgtgcgaggaggaaatagctgctgatcgtaacgacgttgcggatgatcttggtcagatgttgcaggacgccagggaggactgcgaaagtgaaaaggaggcccaaaaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccttgtttgcaaagcactacgatacaagattagacgggacgatccaggagaagttgacgggcagctaacaaagaatagaattcctgctaaggtgatgtggtatttccctataataccacggctaaggcgtttgttcaggaacaagggaaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacatatcttaagcactgtagaaaggttgtatacatgggtcatcatcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatataaagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatatttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcatttatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagttccttacatcgaggagcacttggctctagttcacgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagaggccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggaaatatcatatgtatgttaattagagtttttaacatttaatttactagcattcatatgctaattataattgactagaggattttttaaagttttaaatcacgcaagtggcaatttcatatgttaattagagtttttaacatttaatttactatcattcatatgcaaattataattgactggagagtttttaaaagtattaaatttaatatatttttaaaactattattcatatattagagtttttcacaatttaatttactatcgttcatatgctacttatatatgactattcgaatttttaaaaggtttaaatcatgcatgtggtatttacatatgttaattagagtttttagcatttaatttaatataattcctacgctaagtatatatgatgattaaaatttttattaattttaaatcatgcagtatgtacatacatatcttaattagagtttttaccaatataataatatcattcatatatatgctaagtatatatatatattggagtttttattaattataagtcatatatttgcttattacgatttatccacttaatttattacagacaaaaataatttttcgaagtaattgtcattaatctttgtactttaaataatgttaaggcattaacttctattttataaacacatatgtaagcgaaaatcatatgcagtgctataatctttagtcccggttcttaaccctaaccgggtttcaaaagaatttcgaaatagcgggagtaaagatcttttctttactcccggttgttctcaacaaccgagactaaagatttagtcccggttgttctcaacaaccgggagtaaagatccgggggtgtatatattcctggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcatcctcgccgccgcctccgcctcctccgctgccgccgcatctctggggtgagagccgccgccgccagatctcccttcatctcgatctctccgatctcgatctctctccgtcgcgccgcccgccacgagacgccgcgccacgacgacgacgcgccacgccgacgccgcgcctagccgccgccggcacgccacgccgccgtcttcgccgccgcgcgcgcaatgccgccgccggcacgccacgccgccgccttcgccggcgcgcgcgcaatgcggccgccggcatgccacgccgccgcgccaaccgccgccctgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgaacacgtcaacgtacgttgccgcgagaacgtgaatgagaacgagaacgatcgaacgaacgagagcgagaacgagaacgatcgaacgaagataagcgagaacgagggaacgaacgtgaatgagaacaagcgaacgaacgtgaacgagaacgagcgaacgaacgaggacgaacgttaacgtgaaatgcaatatatatatatatatatatatatatatatatatatatgttacttcgcatttatcataatacatctttttatatcttgcagaaaagacgtgttgtcggagtcgtccgtcaagcctgagtggaagagctagccctagaaggaattagagcagtcaagtgacgtaataatataaatgattgttatatttgtaatgcaattaattaagattattagacctgtaattagacttatcatataagattgtgtagtgttctaatattatttgagttttaatataagattattttgttgaaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattaggtttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtatgatacaatcgcggagggaagcagccagtactagaatgaagaagaggggaacgaggatccaaaccagtacttgaacgaggaagggaacgtggagagggatgcggaggggaaccagcaagggcacgtggaaagggatgtggaggggaaccaggaggaggaggctagtggtagtcaaccctccattggacagaagagggcacgtgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggatgagttcgttgcatataagacaggtgaacaagggcaggcgatgatggaaagaaacaaagaaaatgccgccaagaagaagtaccatcaccacttgggttcaggaggctatagtgtcgcgatgccgaagtgggagcagatggaggctagcttgattgagaggggtatcgaaccggcaacagccaattggccgaaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgaggtacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccaacaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaggcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaggggccccccagctccaccgcctgcccacataagggcaacgaagaaggcgaaagttgacgccgccaagaacaaggacccggggtacgattgcacgcaagaggagcttgacgcttaagttgcatcagaagtcaagagacaattcgagcctcgaagtccagaaaagaagattcctatagaccccagtgtcaggaacttcttcaggggtatgtctgcacctgtcaaggaggccatcaagctatcggactatgagcgaacgctgaagaaagcatcttctggaaattccaaatcagtccctcagcttagagagcaactaaaccaggagatcgagccgttggtgatcggggaagacatgacgatagaagaatttattattgacaccggtctaactacggatcaattgctaggagttgaaccaatagaaaaggcggaattgaaatacatgtacgaactcggtaaaccgcttgtcaagcccgagctggtgcagtccctacccacaaaaatgtacaagttccatcagctgtacatggagatgagcgccaccggtagagagatgatcggagcgaggatcagggacccagacttcttgcaaggagatgatattctctggatcaatttcaagggaatctacgaagtataccagctggatgccctcgacgtctctattatgagttgctggattttgtaagtatatcgtttagttataattcttaattactacgtctcctttaattaattaggtccttgtatataagtagactatataaaataaaatactcccttttatcgttgtagaatggtgattcaaagggcccgacagcggagggttttcgatactggattcatcgactctcggagagtaaacgtcgcaatgctcgaccaatatccgcaggaaacagaggacaatctcgtccatctcctgaaggcgcagcattacaagacgttcatactgttgctgtacaacacagagttagtataattttactgtcttcctacttaccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgttttacaaggttttcgaacttatagataggtactggcataagttcctctgttaattaagaaattcttattatgttaattatttctattacgaatcatatctttaaactccatgtagggcttggtatcggttccgtcatttcgtccacggcaactggagtgaaagacttaggcggaggttcaaatttcctgtgagtacacatgctctacatttacatttctccgattcaaattaatacatacaagtgtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaattttcattacataacgatttcttgtttaattactaatcaatttcatacattcatatagtttattcgcatgagggataacctgatcacacacaaggaatttatcgcggcggttcaagaacaactcatgggattcatcaacgaagaaatccttgatcccaagggtgaattctactacgacagaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtacatatgtactgaaccatatatacatataatataatataatataatatatatatatatatatatatatatatatgtatgcatatatatgtattgaaatatatatatgcatggtttatatatatatatatatatatatatatatatatatatatatatatatatatatatatatatatataaaccatgcagcaacagggccatgcaaaaaaaaaaaaaggtcagctcgatctttagtcccggttatttcacccgggactaaagatagcgatctttagtcccggattggtactcccggtttggaaaccgggactaaaggggggttacaaaccgggactacaaagggtttctccaccagtgctcccaatccaaattttactttggtttttgctcttgtttggatgaatcttaatgtcaactcatcactcatgcatataaggattttcggtcatcctcctggcctttgatatatatccatgggaactactggagaaaggctctgtagtctcggttgggaaccacctaactacgaatctgggactaaagatagacatttattctcaaatcacaataacattctcatcctcaaatcacaaattgaatgaacaaattattctcaacaaacaatcatcacatatcatctcaacaaacaatcgttcacagattaacaaggaaaaaagataaaaaaaaaggaaatacgcatgcgcgccgcccccccctcctgggcgcgcgcagccctgacggccgccgcctaccgtcgccacgcgcctccccagcccgaccaccaccgaccacttctggcagccgctgccgcatcttccacggccaatcccgcctgctccggcgcacacaggctgccaccgccgtgcgccagtctctcactccttgatctaaggcagaagaagataggataagaatgccgtaaaggataagagagagaggggagatgagaggataagaacggtctgctgagagagaggggagatgatgagtttggaggataagccctagggattatatattgtatatggatttttagttccagttgataataccaacccggactaaagatcgatgtttagttccgattgataatactaaccgggactaaagatcccaggccccctgagaaaatctgacggtaaatgaaccgggactaaatatgatccttagtctcggttggtaacactaacagggactaaagatcatcttggaacgatagagttttaaaccgggacaaaaaaattatctttagtcccggtttctattcaaacctagactattgtggtttttggtcgaccggggaaatatggtttctccagtagtgtcagttgcagatccatatacatacatgtaccatgggagggcaaaactgaatagatttgtgttttttagtccatagcaaatgtgtagttctatttgcacatatccccatatataaatcagtttgtactacttcctccatcccagaaaaacacaacctaggcaaggatgtgacatctcttattacaatgaatctggacaaccctttatccagattcgttatactagaaaatgtcacatccctttctaggtttatttttttttttggaacggagggagtatgtcataaatgttgagcttcctctgaaaggactcttaatttcgaattgtaacaagtattcctttgaaattgtgagctaacaaatttgttttatccctcgcacatgaagttggtttgaacatgagatttggtggtgacatactaatacctatacctgtttagcgatttttgcatgtatttagaacttgaaaaatgtccaaatacccccctaaactttatatggtagtccgtctagcatcctgaactttaaaaccggatatccaacaccctaaactttaccataccatccatattaccccataagatggttttggatgatagttttgcatattttggaagcttaaacaaataattttttctaactaatataacatatttggatatcatcagttataagttatcaatttatttttatacagtagtgtcatactattattatgttgtaagtgagagctaataaggagtaaacagaaagatttaagtcaaaattttaatatatatgtccaaagcatatgacatgtgatcaaactcatccaacttatataaacggtattataaagtttagggggttgaatgtcctattttaaagtttagagtgctttacggacttccatccaaagtttagagggtaatttggactttttccttagaacttatatgtcaggttttcacttattcgatggttttcatcatctattccccgctttaacacatgcatggctcatatttttctcccgcacacgtagaattatttcaaatttatatttgaaattaacgtatttgcatataatgtctattttgttattgttgatatattatgtacgaaagaaataaaatgcatccatgcatgtatcgaaaagatcagcatttgtcacttgtgacaagcgtgtactttgtgctagtacagatcgagtatcattattggacttatatctaaaattaatgcatattatcatgacattcactttgtgcttgttgatacattatacacgcatgaaaagaaactagcgattaatgtacaaacgttgaagaaaatatcaaaatatggtgtttacagtaaaactgtgatcttcagtcctcacaataatataaaaattcatcacccataaatctgccagtagacccacatagaaatgtgctacgatcttgggatgccaccacaccccgctgggccatcagatttccaccgtagctgcttaagtgagtacatttctcaccactggtggcaattgaatatctaggaacatatgaggtctacagcggttgctggtaggctggaatgccacacttttgtggtacaattgcacttttgaggatgcatatatgtttttttttttgaaaagcttagacgtcaagagcattgctggatatattggaagggaatgattggtttaagtacaagaacaaggcagatctctggtgagagccttgaaacatctaggaccacctaaaaaggaagccagacaagaacaaattacaaaaggtctatattttcctttatcaagaaagctacttgggtcgctgattgcgatctttgctggaaaatccatcggtttcgctccagccaaacatgccaccaagtggttaacagggttcctatgattttcttcttttcacttttaggcccaatatgttccatctccactaaaaatagaatcccaaaaattagttagtaaccacgtatgattggatgggcccatggttggtaccgattttttttttaagaagcgcgtggatcagatcagatcagatcactcccctgctgtgctgccatttctaaatgccgcgagctcctgccactgtcacataaacccaccggccacggtggtattgacgaatgatttcacatctaatgtggagaaatagaaggcccagttgatcctctacacggccgtgtcatgaatctgtaggttaatatcgtaggcaacatgttaggatgctcttgtttcgatccgtcgcacccgatgaagggcagttggtgctatggatggagggaaggcggcacgggagacgggcagatggcggggatggaggattggtgctgatcccatggaaaaccataaccgaaaccgacgaagttaatacggcagcttgggtgcagcgttgtgctctagttagcacgagaaagaagactgcgcgagaaggggtaaaaggaagtgggcaaaaaaaaaaaggcccaaatcctaaatgggattggccttgattttaggtgtaggtaaattttgggaccatgattgaaagtctattggaggcctaatgttaaccaaagtctcaaaatttagtcttcagtaacatatttgggcctttcttggagatgctctaaagttcctctaaaatcattctaaagatatgctctaaagttcctctaaaatcattctaaagatatactccctccgtccctaaatatttgacgccattgattacataggaccacataagagctgcaagtagtcaatgtgtcatcttttgctgagctggcagcttgcataacaataggtcatttcgatgtagacgttctggttaagaatatcatcttattgaatcctatttacaagatggcagtcgggctaaataagaaaataagaaaaaaaaatcaacgatcaagaaagagaagactctaaatatattacgtttagctgtcaactgaggctgagccactgcgtcgatagattcactccaaaactgctcgttagccactgcagtctgcagcatacagcagccgccgtggaagctgaacaagagttatcgcggcacactagtattctgctatgctactgcctactggcttctatgcagccacgatcacaggatgtagctttagacagacccttcgttagttgcttttgtgagtatgtgactactcgagcttaaacatcagggtagcagatcattgaagagatctagcaagatgcctatccatttctagtcgtcccaatacttcacatgcctatgttttttttttttttggatcaacatggagaactggtcagagacaagttccaatatgggggatatgtcttataggtaactttctcatctgaattactgaaattagcgagcatggttgtttttatagatgaatggactgcttctatacatttatagtagatgaaactatttattgtttcacatacccctccgacttattaaaattttgaccggtaaatacacaagtgattaattagtcgttaactttctgccaacttggaatgatggaatggtttgcacctctcttttctctggtcttgcttttggataggcagatatctctactattaaaaaaattaaagatgttattgccggtactttggtacgtcatttgtgtatgagtcggttttcaaattcgttaacttttggaaatacatatccgtatttgagacgtttattaagtccgtttacatttggaaatacagaagaagagccgtataagaaatccctttaaaaaactcgaatgctaacttaagatgatcggactctaactgcagctcatgactttaagcgaattctcatggtgaatttcaccttaattaaaccgtataataataataagattaaaatagccttcacccgtcgcaacgcacatgcattttttctagtctatatatatgtctaatccttttaggaatggaaaagagattgaactaaaatccaaaccaatccaaggtgatctttgaatcataaatacagatttttaacccttgaagatgaagtgtagatttatggccagtaaccagtcaacgacattattgcttcattctatctctgacaacatggtaactgttcaaacaggagttaattaatgatttgttaatttacagaaaattaactcagtcacaacgtgaaaccatgacaattggaaaacacaaatttagtatatagcatgtgtacaatagggcaaattcaaattaaatgacatttctcaactcaatgatattggcaattctactgaagagatgtgtttcccaataattcagatagcttcctcttgagggagcaccaatgctagtgtgcttgatgtaggtggttaactgatagcctcatcattgctgattcgaggaataagtaaaataacatatttgcaaatgaaaaatagtctatgaataaaacttttatatacgtgttcttaacgatctaaaaacaaacgctgaaaaataaaccacaataaaaaaaaatcccaaaatcaactctaaatttatgattgaaaatttaaattttggctaataagtataggcataagcaaaaacatgaggccgtttgtcagtcttgttcacaaaagggtgtgatcactagcaaaggcacatgctccgtcatcgtcatacggtccattttgctgataaaaatggaagacatgatttccactgatttgatctacagaaatagaaagtagtacaaatatttgttgccattaagcagaacttctcccactgttcaaatctgagatcagcaagaggggcagaggagcaggggaatgtgtcctctggtctacccaagaacagagcaggagccagcgtgagatttcccctgcaccagaaagaccaatagaaaaaaaaaattcagcaaaacaaccaaacaaacttcacagtcatgtcgccaattatttcttgggaggaatcgtgtgatactcggatagagcttttcctactttcatagtgttaatatttacactggaaactagaaccaagttgattctccaatgatccaattaacgagagttctagggtaagttgtgtacagatcgagcagctgaactcagatggcaaaatagacgcaccgaattactagctaggtgtgtgcttcctgattctaattggtgattgctctttcggcacaaaaaatgggatggcaacctgattgggtatctaggctgtatgatcatactaggctttcaagaaactaacttgactaagactaatgaattcgtatatattcaaagttttctgctttttctgtcatcaccattgtttattgcataaagtttccgtgtgcctctgaataagtacagtggcataccttaatttagctagaatagttcacagtacacaaaattattgatattatattcgtgtgccgttccatagaaaatcactcctatgcaattgttgcatgggccatcaaaattttgtgatcaatgcctttggaatagactgcataacagcatgggagaaccttaacagctgcattgcccccatgttaaaattgtagtgtgtacaagtgtaactacaaaatcgtaatcatagtttatttggattcataaagagaatcttcactacaacaactggaaagatgagtaccagcacaattttactagtttcaggaggtgaacttcagtagtatccatccatttcctcagttgatcagtgcataatatttttctttgatggaaatgatatcatagtaaacatcatccattgtcggtcgatcttttggtgatgtctctgtgcacattagcccaagcttggccatttgtatggcgcatgttagtatttcaggcacaacatgatttgggtcttcaccttcacaatattcggtgatagtaggatctaaaatgtcactgatttgatccggaaatgccgactccacaaagttgtgaaggtccattccatcttgaaagatttcatcagttggttgctttcctgttatcatttctagaacaataattccgtaactgtatacatcaccctcagctgagaccttgcatcccaagccatactctacaatcaatattgtgcaagttaataatattcattagtcagtcaaaatatgatacaattttgcatcacttccttggtagagctagtggaaacaatagataaaatacaaataacaatgaagcaagtgctcacctggtgcaatgtatccgattgatcctcttaatccagtagtgcttgatgaattattgaggcttataaagttgttgtgcagaaactttgcaagtccaaaatcactaatacaagcaaccatttcgtcatccaaaagaacattgcttggtttcagatcgcagtgaaccaaaggaggagtgcatcggttatgaagataatccaatgcagtggcaatgtctccagctactcttacccttgaagccaaactaaacagttttggggggctttgactgcatggttttggatggatccagctttcgaggttaccattcgctctatactcaagaattagtgctttaaactcgtttcctgatggatcaaaggttgaacataagccaattactcttacaagattccgatggcgaatgcttttcagtgcctcacattcagcagaaaaactattgggtgctccattttggtcaagtctaaatactttaattgcaacatcgcgtgcaccgaacttcaattgacctttatataccaatccaaatgttcctgaaccaacaagacttgttgaagagaaaccatatgttgctttgtacagatcactgtatgatattttatccaaacgcctgaacgaatggttaatgccgattctctccggtccagatctcttcttcagaaacatgatggcaacacatgccaaggtaatcataacaattgtactaactggaactaccacagtaagaatataggatgtcttccgtttggctgacagttccttgcaaagtggtaactgtaacattggtgaacttgcacataacattttatttccttggatgaacacatcgctagaatttgcaaacacgcctcctttgggaacaggtccctcaaggttattgaaagatagattgagagagcgtaaagatccaaaagactcaaaatattttgggatttcaccagacaagttgttttgggaaaaatcaatctcaattatgcctcttaagttaattagagattccgggatgcctccttgtagaaaatttgcctccaagcgaactgattccaaaacaaggcactcaccaagattggaggggatctcaccagataattggttgttggagatattaagagaattaagattaatcaatctaccaatctccagtggtatgtgcccagtgagttgattataggatatgtccagacctttagaaagtgtagaaatcgaaaagagatctaacggaatgcttccattgaggttatttcttgaaatgtttagctcaaccaaatttgtgcatcttgctaaacttgaaggtatttgcccagttaattcattttcctgaagataaagttcaatgagctgctctagtgtgcctattgatcgaggaatttctccagaaagcttgttgtgagataagcttaggatcagcaagtttggaagatttgcaattgtgctgggaatttgtccggagagcatattattacccatcagaatggcagtgagaccagtgaggttttctatttctgaaggtatgctgccagtcaactggttctgtactagattcaatatctgtagtccttttgataggttgccaatagaagtgggaagtactccttgtagattatttccacccaaccacaaattttgcagttgggtgcagtttgttagtgaagacatgaaagtccaatctccagactcaagcttattgtcacctagatctaagtcagtcaacatggacaaggatcccaatgaaggaataataccagtgaaggagttgcgtccaaaataaatctctgtaagattcaaagcattggctaatgtagcaggaattggtccttcaaactggttcccatgtagtatgaaactagtgagtcttggaagggtatagccaatgttggtgggaattctcccaacaaatcggttgtcaccaaaattaagataggtaagatttgagattttaaatattcctggtgaaataattcctgataagttattataacttagatctagtaattgcaaattagagagttttcctaggctctctggaatggtcccttctaagttgtttccagaaagcatcaacttagacagggagagaatgttatcaattgagttgggaatctcgccagagatgtaattattagttaagcaaaggtatcgcagaaccaaagatgtttttgagaatggaggaatagtcccggatagaccattctgtgagagatctatgtaagttatggtagagctgttgaagagagaagggggtatttccccaacaaggctattattttggagattcacccatacaagtgttttgctacttcccaaaagtggaggaatggtgccagtgagctcattgttaggaatgaatagtgcagaaaggttgggaagcaaaccaatctccgaaggtatgcttccatgaatatggttattgctaagaataatttgctgaagaaatgaacaatgagcaagacttggaggaatcttaccttcaatggagttgctatacagattgatggtttcgaggcgagaacatgacgataaagtctctggtatttcaccactaagtgcattcacgctgagatttagatacctgaggtgtgttaaacggccgatctcaggtgaaatgtggccattgagttggttaccaggcatgtgaattctggagatgaaactgaggttagcaacacaaggaaatatttggccggtgatgttttctgactcgaggtctaatccatctactcgagctggaagccctgtgctgcatgtaaccccatgccaatcacacatcgaaacactggaatcatttctccatgagcctaaagctccagaggggtcatggagctgggacttgaggcagaggagagcctgcctatcagcattggattcgttgtgaaactgagctgacaagcagaagggaaggcgcaagttcaggaaaagaatgaaggctagcactagcatcggtgtgatgggtttattgagagctaagcgaaacatttcttttgatggaattgatgcttgaagactgaaccataacggaagggttagcatctatatataggacaccacgtatgtgtttagttcacggcaaaattagaagtttggttgaaattgaaacgatgtgatggaaaagttggaagtttatgtgtgtagaaaagttttgatctgatgaaaaagttgaaagtttgaagaaaaagcttgcaactaaacaaggccgtttgcatttgaagtgaacgttttacagttccaccattgttgggaacttcttttgcaactagaaccttagcaaatctatttcaaaatgtagacgtaattaaattgttagaacctggacctgtgagattaatttgatgacgtatgtgaacactggcgcatgatatggtgccagtgcagacaatagcatataggacgatctttcgtggaatatactctgagtcccaaaatgaatgaatttctatggtttaaaatttatccgaataaaacttatccacctactccttcatcttatccgattacaaacatccccgtttcttaaccattttattatctgatgctttaatttcataattttttcttacgattacactacaggcgcacaggcgcacacacattactacgcatgcaagattatactcacacccccctccccgtaaatactgccctagtcttttgagcctaattagtctatgattagccataagtgttacagtaacccacatgtgctagtggcggattaattaggcttaataaatttgtctcgcggtttccaagcgggttatgaaattagttttttcattcgtgtccgaaaacctctaccgacatccggtcaaacgtatgatatgacagccaaaaattttcttttcgcgaactaaacacactctaaaaaagtggatggaggtctatctgataaaaaataatgttctgaaaggctaaatttcattcggtcaaagaagacggctagtataccattggaaaccatcgcttgaccttgttggagtcttgagactttgaagttataccggtcgtcctgacgtccatgtcgtggattcaattgtccaagctgatagtgtagctatcaaagtatcaatgctttcttctttttcccttgtacgtattgatgccgttgatttttttaaatatgtttgactgtttgtcttattcaaaaaatttaagtaattattaattcttttcttatcatttgattcattgttaaatatatttttatgtacacatataattttacatatttcacaaaagtttttaagtaagacgaacgatcaaacatattttaaaaagtcaatagcgtcaaacatttagaacatttaggaaggagggagtagtatgcagctgtcactgcttgcatattttcctatacgttagtactatgtttgactgttttttcatttccacacggggcactcgtaatcaggcccatctggagtcccgtgtacggccgtaaaagttcgagccaaaaatcatgtgtttcaatttaaatcattaggttcaaattaagatatctttatttttgttacttaggctgtatatttagatatagaggtgcaaaattttggcatgtcacatcagatatatggacacatatttgaagtattaaatgtactctaataacaaaacaaatcctatctttctataaagttaaggcccactaaatcctaaagctcaacatgcaaaaatgccaaatcatccactaacaattattacatttcaaacctcatgcaagcatgctaatttattaagttataaagatttaaaatgcaaacatcttaattaaattctcattccacataattcatataatatttcaatatatctctccatcattttttataatatcctatatgcctatatagtgcatcctcacttaaattttagagctttaaaaatccaagcatgttaaatcatcattccacataattctaaaaatatctctccatcattttgtataatatatatatacctatacaattcatcctcacttagttaatgctatttctctcttctctcattatgccatatcacctcaattgtttctatccctccaatgattaatctatgatcagaattatcttcctcattttcttctctcgtaaatccacatcattatacttttacatttagatcatcattctatatactatttaaattatgataaaccacatcaacttattgaagtttctgtcgtctagctatcttacacattatttctatttattattaacataccaaactcccgcagcaaagcgtgtggtttcatctagttacagaatccgcctgtaaaccaagagaagaatttattaagcctaattaatctatcattagcaaatgtttactgtagcaccacattgtcaaatcatggcgtaattaggcttaaaagatttaaaagattcgtctcgtaattaacacgcaaactgtgtaatttgttattttttcgtctatatttaatactccatggatgtgtcgagacattcgatgtgatagggtgtaaaattttgccaggtgtaacaccctgaaaatttgaccacaaaaaatctaaactctaaaaatacggatttttcaaaaactttttaaattaattgcatcatgccgatcttattcgcctattttatttggatttgatcttgaagtttattaattgtgagtaaagaatagttaattaggaataaaccttaaaaaaaacaaattggtaaaataaatataaattaaaataaagattagttgtggataggaataaataaaatattatcgcgaccatatttggatcaattaaatttaaatacgatggaataagaattaaccctaattaaaaattcaaataaattatataaaaataaatatgagtaatattaatctagggagaattcattagttgagataacacaaatattgagtaaaatgcatatatgcaaaaattaggaattgtggaatcaaatttatatgggaaataccctaaaatcgggataaataggaaaagtcactattcattgccccctaggtgttcgaccgcgttccctagccctagcccctcctctgccgcgttgccctcgcgccccgcgcaccgtgcgccgctccacctcccctctaccatcgccgtcgccatcaccgcgcgtgccgccgtcgcctcgcctcccgcccgtcgccatcgccgcctgccgccgcgccgacgtcgccgagccgccccgagcccacgccgacatcgccacccccatgccgtgagtgctgtcgtcccgttgccgcgtcgcctcgagccccgcgcagccgtcccttcgccgcgtcgccgcccgtcgccgtcaagcccgcgccgcgccgcgccgcgccgtcatatcgtcgctgtcatgccatgccgtcgtgtcgccgcccatcgcatcccgccccgagccgcgcgccaccgctgtcaccgtcgccatcgatgtcccgtcgccgcgcgcgtcccatcgccgctgccgcgccgcgcgccatctcgtcgcctcgcgccgccgtcgtttcacccttccccctccttcccctctctttcttcccctctcccctataaaaaccccggcccaatcccccttctccaccccactccattccctcctcctctccctcttccccttctccacgtgccgccgtcgttgcgccgcccgccgccaccttcgaagccgccgcgccgtcgccccggagccgccgcgccatgcgtcgccgccttgcgccgccgtcgccgtcgtcgccgccggtgagccgtctcccccctccacctcgcgcccaccgccgtcgccgcccggggaagcaaagagccgagagagagagagagagatagaaagaagccgggagggaggagagaaaaagaaaagagaggaaaggaggaagtagccgggagagaagaaagaaaagaaaggagaaagaaaaagagaaaaagaaaagaaaaagaaagggagaaaaagaaaaaaggaaataaataggaaattagagggagattagggaagtttagaaaatttaaaataattggaatttaattatagattaattatagtcgtagaattgcaaaatttaatataaattatggattattcttggcaatttctataagaaatcgattcacggtaataatttagatgtagttaataactaaacaaatagatgaattcttatggattattatagattatttatgggtaatccctataagtaatcgattcacggtagaaattcggatttaactactagggattttacccgtgtattatatttaatcatttagtcatagactaaattaaatcgtataatatttctaggattccgtccaatatttagctcgcgatagaaatttctaacctattatatggatataatgctcgggtagattaaattaaaaacttatgataacaaaatatttatacccgcaaaatagtttgaatcgaaattgggtttgccttagttcgcgaataataaagttaatataaagaaatcgactttcgcattcgactttcatttggattcatttggatttttatttgaattctaaccgaattcaaatcaattttcgcacgtaactatagagcccgagggagttgcggatccaagcgaaggtcaagacccgcaagacattgagcaaggcaagtcagcactattccttgatcatgttgatcccaattgtgaaattgttttgtttacaaataaaattgcatgcaatgatgaacatcctacttgtgattatgccatgccttgattattgtttgccccttattccttcgtaaccatgtttacgtatgagtccctagtcaactataacaaatgcttagaaatgctattctagaatcatgcatactcatatttgtcaaatgctatatgcttgggcaattatctttgggaaggtaattgagatgtggcatgtggagacatgagcgccacattgccatgatattgaggacatgatttgtgaaaggagaaataaactaaataactgttttcgattgggcagacggaggatttgggtggtatctggaaaaggctagtaccgtccccggtcaattaaggaccgagtcatgaagttaagcatgaaacgaccctcgtacaaccgcacttctcgtatgggtatagacctagtggagtagatagccgagcggaggcagtatccctgcatagatggttcagccctgagtgaggcaggtgcgctatggtgggacagccgttgaggtagggccgagaggcgtgccctacatcggtgtcgccattggtaggactgccatgagtgtgtgagagagggaacttaacttgagccataatttaatatgtatgtgagacttctctttcccgggagcgccagaactcctctcactgctagaaacatggacgcctagagtgcatgaggatttaagttcatggagcgggtactgccaatgcgaggttatctaaaggctttgccgtggcgcatctcatgtgttgggacgaggctcatgtgttgggcagtcgcggagtgcgggtaaagtgtacatccattgcagtgtgagtaaaccaaatctattcgaatagccgtgctcgcggttattgagcaccgggacatgtattacacttggctagactctaaattctttaacttgtgtgggatgggatattgcatgatgatttttatgccgatggagccacttcctgagaggcaggaatatggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttagtactcacccttgcaaatataatcagaagcgggagatgaagcttcggaggatccctatgcctactaccaggagggagatgaagacgatagcgctcagtaggtcttagttacggtcgttggctgtggcaatggcgtgccgctgccttaactccgctgccttacctacttctgtttttggaatgtattccggaccactcggtccgatgatttaagactgtgcctgtgggcttatgatgtaattcgtactagactctcgtgtatgtgcacttgatatttcagctatgagttcgtgtgtaccagactacttgatccagggaaatggtactgattacacgattgattcctgttataaaaacgggggtccacaccaggggatctgaacagggccttaaagtcctatttttctgcttcattgaatctacggtgcatgctagctagccaccaacgcacaaagaattcagtttcgtgtacgcgcaaaagaattgcacgtcagtatattagaagaaaaatagagttttagttatacaacgcaaaagaccagacaggcccttgcctggtacagggtagagtcctctacgaaggggaaagcggaaaaagagctaaggaaaaccactgctcctataaaaaaagggagatgggtagaaactaccctacgttcccaataggtccccaaatgaagcggtaaccactgaaggatgtactccaacatcgctgagaccggtaagagggaggagtcgaaaaccctggcattccactctttccacagctgctaggaaaccaggaggactagagagtcaaggctcgtacaaagatgtgctggcatgggagccctggccgacggccaccagaactgaagagagcagccctgggagggggcaaactcatgccatccgggggaagacaggacaaggagctagacttatcgtgcgaaaacaagagcgaactatcggcacctagtttatcaacacgtgatgcatcagactcctgagcctcacatgggggcaaccttaatttccagtaccagccccactcgcctcagatacagtatcggccaggaggatcaccacagccccagtatttgcctcaatacaactagctggatcaaatacaacagcacatccaggcggcgcctcagtagaagccttgggcagatatgatagccgatgtgatgagggagcaattcgggctcaagcccaaggatagtgggagcctgtatcggcatccatacccagaatattttgagagagtatcattactgaaccgatacaaggtcccggaatactcgaaatttttgggataggacaatgtgataacatacgaacatgtcagccgattcttagcccaatgcggggaagcatcagctaccgatgctttaagggtcattgtttcctctgtctctgtcaggatcagccttcacatggttctcatcattaccatacaattctgtacaaagttgggccaacttggagaaatagttccataaatacttttatagcggaattcacgagatgaagttgtccgatttaacgttgatcaaacataagcatgacaaatcggttcaagattatatccagatgttcagagatatgaggaatagatgctttagtttggccttgacagattcccagcttgctgatctcgctttccagggcctactagcaccaatcaaggagaaattctcgacccaagaattcgagagtctagctcatctagttcagaaggtgacggcacacgagcaaaggtttcttgaagctagaaaagcatataaaaaggggaacaacattttttgaccgggaaacagtgggcgaagcccccacgattgattttcatttataaaagcagaaactgtacaagaagaggatgaaaaacattagtacatatgtctctgaaacaaaagacgattaagaccctgaggtagcaatggctgagtgggcaagaaacaaaagagtagtcacgtgccaatatgtcaaggactccggaaaggaggaaaaatttgattttgacatcaccaaagccgataggatcttcgatttatttcttcgggagaagcaaatccacctccctgctggtcatgtaattccatcggctaccgagctagggaagagaaagtactgcaagtggcataactcggggtctcagagcactaattagtgcaaggtcttcaggcagcagatccaatccatgattgagcatggaagaatcaagttcgacgaccaaaagaaatccatggaaatcgatggcaatcctttccctgtcaacatggtcaacactggcgaagggatagccgatagaagaagctaccgtcccaatgctgctacgatcatcaacatgtatcagaggaagcttgagagatagaaagaggagagttatggagacagcaacaacttcgaccctcattgggactgcgaattatttagattctgctggaacggagggatgaggctaccctcgaaggaagattgcccggggtgcagtgatgccgacgagaaccatgtcagcagttcaagccgatttcaccccgggaaagaaaatcggtcgatgcagaggaagttgcctgttcatcagagattgggaccggtctatcaaaattctgtacaaggggaagatggggaggatgaagctaggaatcaacagtggtgtccctctggtattttcaccaaaactcagaaaacaagggttcaaaggatgaggagtagggaacggttccaagaggtttatgaggaaattgaccatcggctgaagaggaccaagcaagaatggcgcataaagagtaaaatcgttccagccgatgaggtcgacgccgacaaggcaaaacaggtaagtaaaggaaagaccatcgaatcttcatcggttaacatggtgttcgtgttaccagcagagtattgcgccaagccagcggatgcagaaatactagaggaatccctagcaagattgatcctatcacccgagcaggccgtttttgagaaaccggaaggaactgagcatcggcacctgaagttgttatacgttaaaggctttgtaaacggtgagccgatgtccaaaatgttagtcgatggtggggccgcagtaaacttgatgcgatacgccacattcagaaagttaggaaaaagcgcagagaatctcatcaaaactaacatggttctcaaagatttcggtggcaacctgtggacccccgtttttataacaggaatcaatcatataaacagtaccatttccctggatcaagtagtctggtacacacgagttcatagctgaaataccaaatacacatacacgagagtctagtgtaaattattacaacataagcccgcaggcgtagtcttaagtcatcggaccgagcggtctggaatacatcccaaaagcagaaatagataagacagcggaattaaggcagcggcacgccattgccacaggcaacgaccgtaactaagacctactgagcgccatcgtcttcatcaccctcctggtaataggcatagggatcctccgaagcttcatctctagcctctgattaagtttatatttgcaagggtgagtaccaaccgtactcagcaagccaccacatcaacaatgcacatgataggggtatttcaaaggatggctatggttcttttgcgcaaagcaagttttgtaattattttcacaagcctaagacctagcattgactgatcaaattttagtaccagtgtttatatttaaacaacgacggttctgtccaccatccattgtgatcccaaggatagcttctcgccattgagtcgtcatggttttctgaggacgtccaccttcccccttctcaggaagtggctccaacagcataaaaattcatcatgcaataacccatcccacacaagttaagaatttagagtctagccaagtgtaatacatgtcccgatgctcaataaccgcgagcacggctattcgaatagatttggtttactcacactgtagtggatgtatactttacccacactccgtgactgcccaacacatgagccttgtctcaacacataagacgcgtcacggcaaagcttttcgataacctcgcattggcagtacccgctccatgaacttttcatcctcatgcactctaggcgtacacagtttctagcagtgagaggagttctggcgcacccgggaagggaagattcacacacatgtattaagttataattatgttcaactcatcacatggcactcctatcaatggcgacaccactgtagagcccctgccttacacatcgagaaaccactatgcatggatactgcctccgctcagctatttactccgctaggtctatccccattcgagaagtgtggttgtacggggtcgtttcatgcttatcttcatggctcggtccttaattgaccggggacggtactagtctttcccggataccacccaaatccaccgtccaccccggtctaaaacaagtgtttaatttctttcctaatttcacaaatcatgtcatcattatcatggcaatgtggcgctcatgtctccacatgccgcatctcaattacctttccaaaggtaattgcccaagcatataacatttgataaatattagtatgcaagattctagagtagcatttctaagcaagtgtcataattgactagggactcagacgtaatcatgtttacaaagatttaaaggtgaacaataatcaaggcatggcataatcacaagtaggatgttcatcattgcatgcaatcttatttgtaaacaaaaaaatttcgcaattgggatcaacgtgatcaaagattagtgatgacttgccttgctcaaagtcttgcgggtcttgaccttcgcttggatccgcaactccctcggtctctataattacgtgcgaagaacaatttgaattcaattagaattcaaataaaatccaaataattcacacaaaagtcgaacgcgaatcaatctttctaaattgattacaaagttcgcggaaccgctcatttcaaattgttgggtcattttaacctaagtcattttgtgatttgaaattacgtcctaagacttcatctaattattgagttcttaattacatctgaattactaccgcgaattgatttcttatagagattactaaaaataatctataataatctataagaattcatctaactgtttagttcttaaatacatatatgattatagtattactttacaaatactagattttagttaatcctataattaaattctaatattttaaatatcctaaacctctccctaatttcctatttatttttccttttctttctctcccctttctttttctttcttttctctcccctgtcggcttctcctttcctctccctctcttcctcggctctcggcctaaccgggcggcggcggccaccggacgcgaaaaaaagaaatgggggggggggggggcttaccggtggcggcggcgcaaggcggcggcaacggcgcaaagcggcgacgcacggcgcagcacgcggcacagcacggcggcggcgaggcggcggcgcggcggcacaaaggcggcgacgcgtggaaaaggagggggaaaacggagggaatgggtgtggggtggagaagggagccggggtctttttatagggcgcgggggactgggcggctggcccttatggcgacgcggcgcgcggcgcggggctcgagacacgatggcgacgggcgaggcggcgacgcgacgttggcgcgaggtggcagtggcgacgcgacggcgacgggacgacggcgctgcaacgggacgggcgacgacgcggcagcggcggcgcacggtgcgaggcgatgccgatgggtgacgacgcagcagcggcggcgcgcggcgtgaggcgatgggacggcgcggcagcagcgacacgacgggcgcgcggcgcggcgacgggacggtcgtgcggcgacgggacgggcgcgcggcgcggcgacgttggcgaggcgcggtagcggcgacgcgacggcggaacggggctcgaggcagcggcggcacgtgcggcgcggcagcgggacggcggcagcgacggcgacagcgcgcggcgcggcagacggcagcggcacggggcgcaaggcggcagcggcgcggggcttggggcgatgtgacagcgagcggcgcggcgcgaggcacgaggtgacgcgacagcaacggcgacagcgacgcgacggcgacggcgcgcggcagcggcggcgacggcgcttggcagtggcggcgtcggcgcatggcagtggcgggttagggcaagagaacgcgatcgaacacttatggtgcaatgaacagtgaattttcctatttaaccccattttagcccatttattatttaaatttgattctataattcctaaattttgcataaatgaagtatactgaacatttgtgttattccaaccaatggattcattctagattaatttattccatcttttatttatttctatcccctcacaatccttatttcaaattagaatttaattattcctttaaccaatctaatttcagggttcattcctaattaactattctttattcgtgatctatgaactccgaaatcaaaatccaataaaaatagtcgaacaaaatcagcatgattcaatttatttaaaaagtttttgaaggcccatatttttagagtcttgatttttgtcggtcaaattttcaggatgttacacaacccttcagaggccaagtgcgtttcaaacgtcgagctaaccatcggcaacaagacaatcccgactaccttttttgtcatcgatgggaagggttcatacggtctgttgagaagggattggatccatgcaaattgttgcatcccttcgaccatgccccagagtttgatccaatggcaaggtgactagatagagatcatgctagccgacagccaattggaaatgaagagccccaattattgctttgagggcatcgtggagggttcaaatttctacaccaaggatactgtagatgttctagatggcaaattagggcaaggattcatgttggccaatgatctggaagaagtagacattggaccaggggataggcctaggctgacattcatcagcaaaaaattaactcccacattcagaaccaagcttattgagcttttgaaggaattcaaagattgtttcgcttgggagtactctgaaatgcccgaacttaccgatcaattgttgaacaccagctccctattaaaccaggatatcggccattcaagcagccaccaagaagatgcaaggccaatatgtataatgatattaaggctgaatcactcgattatatgatgccggttttattagaccatgccgatatgctgaatgggtttccaacatagttccagtaagaaagaaaaacgacaaacttagggtctgcatcgatttccaagatttgaacaaggctacccctaaagatgaataccctatgccgaacgccgatcaattagtggatgctgcttcaggacataagatcataaacttcatggatggtaatgctggatacaatcagatttttatggccgaagaagatgttcacaagacaacttttaggtgccctggcggtatgggcttgtatgaatgggtcacaaagagccgtgaatggaaagtatgtgaaaaaatattacccaagtatttggctcaattcgtgatcgactaagctatgccgatgcattatatccgatgtgttaccatcgcctttagatggccaataactgttttacactactagaaaaacaatttttcatggcgttggtctatgattttcgctggcggaaaaatgccaaaaccgccagcaaaattgtaacgagggggtaaggggtaacgatcgccagtgaaaatagatcttcgctggcggccgcgttatacctgccgccagcgaagatatgtctattttctctggcggtcacttaggtgcactaccagcaaagatggataattttcgctggcggttgtgttatacagacaagtagggaaaatacaattattttttctagcggcccacttaagccaccgccagcgaaaatagattttcgctggcggtataaggaccgcttgcatagatgaaccaccatctattaatatggaccacgcggcccaccaccaccaccaccaccagtccaccacctacccgccccctctctccagctcccctccctctcttctctccctcgcgtctctcatccctctcttctccaccgctgtcggctgctctcctctactctctcctcctcccaccccacagtcgggggcagcgttttcggcgtggcgacgacgacgcgaggcaggcgtgtggcggcgacggtaggcgtgcgggcaacgacggcgtcttgggtgtgggcgcggcggcgctcgggagcgggcggcggctcgcggggaggccggatctgccgccgccggccgcgaggtggccagatccgccgccgccgggccacagggaggccggatccgcctccgtcgaccgtgctcctgcggatgatgtgtaaatcattttgatttttttccttttctttttccatgttgttccagatgatgtgtaaatcatgtttgatctgtgctgatgatgattttgtatttcgtgtttgaatttggaaatgagcagcgaatctagatgtgaatttgaaatttgaaattaattaatgaattaatgggcggctacatgggtattttcgctggcggctgggtagctgcatgcgggttttttttttgttccccaaatccattttcgctggcagccaaattaacacagccgccagcgaaaatagattttcgctggcggccgtcttaagccaacgccagcaaaaatggttttttgctggcggtcaataaccactagcgaagatcttgattttcactggccttcgctttttagcggctgcaaatcccgccagcaaaaatccaaaatggccgccacgaaaaatggttttcgtagtactgttatcgcccttagaccaacataatcctttctttttatataattggtacccactaaaaatcattgattgctataaagctcaaaatctgtgaggccacgtcatcatctaataccagccgtccgatcaattaggatgagcactatagaccatttgatctttcctgttctcctcgccctggcccaatcatatgattcagccgagcccaaccaaagtctcgctaagcagttggcccaggtgttgatactctatttctacgtgctgtgcagggcaacgtttcagcttcgtgaaaacggcaagggcatctattacggctgtaatggccagttagatctcagtatctcacactaatttaccctgaaggtttccttttctctcgcctcattacacatccttaaattaagtcaccgtatcatcgtcaagtagatcttgccaaatcgaaccatccgcctaagcctacgtctaatctcattcccagtgtatgtttttcatacctgttcttcgaccatatgacttcatccaattttccggcttcctttctttcaatcattttaaggttccgttaacactacaatgattcgttctttgttgttccatatgttaatgatgcaaacatcgtggcccatatgtgtaagtccgaatacttatgggtgcagcagggatcgactgttctggcatttccgtatgagggttgtctctagccaatggagtccgctcgctttactcatgtcgagaaggggatgggaagcgaggaggctgaaaaaagaagaataagtttgacattacgtgatcgataacgggagaaagattgagttgcaaattactgatgggggcggtactggtggcttcttcttcttggaggccaatttcttcctcttcaaatgtagaaagcatgtataagttgaaggtataaccatagtaagaaggaggaagcagtaaaaagcaatactggttggcgtttcggggggcttgaagtgttttgtgggcttggtggattggctggagatgttggccccgccactctcatttcgcttacatcagcagcagcatcgtcgatggcctcatccatttcctcgttctccaggcactcctccacgtccgggtctatggtcggaaaatcttcgacagcggctgccttctatttctttgtagttttttctttggggggagatttggcatccgacggcttggccctttttctcctaccagtttcaataggttcacgaggtagaccatggagcaatgaagatttcctcggagcattataaccgatgatggagtgagcgagccccccaccgttcggaataatccccgcagcataatttatgggttccccgctttggccaatgtggggaggtaaggagtctgtggcctgcaaaacaaaagaagagattgaagagtcagtaaataagtattggcatcggttcagcaaaatagtttgcgatagaggaaaaacgcttacttgcgggatctgatccgggaacatagtggtcatatacatcgaagccgattggtggaagaggtgctttttccactcgacccgccagcggtcaaaggttgcctcctgatcagggccagctcgatattatcaatgctgcccaatggcggccctggaatattcagaagtctatccatcatgagagccgatataattaccctctagattggatcttgtccacaaagaacaagccgataggtagctgacccagtccaagttgtcttgcagcactcataggatggtaggattcatacaaaatctggatgttgcgaccttgatgaatgccggcggggaggatgcagggagaaatagctgttgacaaaaccatcctagactgctcaaacctcacgtgattgatttcctcaaatctgaaatcggctgggagttcgaagtcttgggaatgctcgtaggcaaaccagatcctggagttctttggaaatccatcatagaagttattaaaccaatcaaagagtagttcaaccgatagatctgacccaagataagcaaaggccacttccccaaaagacgtgcatcggtgagttttaaccaggttcccttcatcatcttcagtaggctcgagggttgggaagctcatcatggttagggccgatcttccagacactttaatcgtgtgaaggttgagccatgtctgcaaaagccaccaagggtcaccagtgccgatgacagagtccacggcaatcctggccgatgctgagcccaaagattgatacagggctcccaagagatgtttgcccaagggaaactgccttttctctgcaagggcttcggccagatgctactagttggaggtagggccacagcttgggccacataacaggaacttttcggccagaaagcttaacttttccttcagggtaaccagaccagtccccgtgtttgtagtgataaaactagtccaaccacctatactcttggtcttataggaaaattggcctttagagttcagactaactgagttggctgccgacgtgacatccaagccagtgatcatgactatatctaaaagagttggcgtcatcggcccctaaccaaataagaaagcattgagggtgtcggaccagaaataagttgcagccgatagcatggattcatctctcttcatatcggctaaagtaagaagcagacattgagaaatccctagttcgtcccaatgggcttgcttgtgtgtcgatagtctcttatacaagtctggccatgtcttgacattggcagctggccaggacttgaaagtgttggtccaatggattaggctagggttggtttgtctaaaggggattcggttggttttggcattgaggaactgagtcgggtctgagttgccggttgggcccagaaagaactggttttggtggcacggattggggattgcaacctaatgggaaagatgctacagtagaaaaaaaaagggggaataaggagtcaagattgctatgaaagaatcacgcaaaggaaaagaaagaaccaggagcagttttagccgataagcagttacctcaggaaactcagccgccgaaacacttgagggattgacggccatcaccggaataccaagcgccgtcgaaaggaacgcctatgtagtcgccgagaaaactgacggaaggagtagggtgctccgttgactgaaggcaaaagaagcggaagggacaccgtggaattttttcgagaaggtggttctatttaaaggaggacgcggcaccagccgaaacagaaaagaaactctagatacaaactgaaacggaatctaacaaatctacaacatccctaacatcggggacttgggggcatttgttaacgaccaaatttggtgaggccatgggctggatccaaagccagaatcgaagctgatgtggatgaattctgtctaagaaaagcagagtgcgtgtcggctatgagcagcataggctgccgtatatatatcagctggtgccaaatccaacggagataagtcgatgcaggcagcctcggaaagacaatcccacatctatcatcagggttagtcaaagtacttgataggcattgccacgcgaggattgaagtccagaaaaaggcaattgtatctattaattaggatattttcagtttccttacggatatgtttgctaagagtccgcctaagggacttgttcgtattttaaattgtaatattgatagagtcgtgtccagcaaggacatgtttgtactttgggtataaatatgacccgacaccttgtaaacaagggacgacggttcaaaaatacattggcgcatcaccacccttttctattttcattattttgacgagtttttactttcgagttgggctgcatcgagttcgatctccgacgaagaggtaaagcttgttatggcggtttgcattctcgggattagtgcttacatctctatgacacactaatcctgtctatgtaaatcatcgagttatcatatatgctgtataatctagatcgatcccgtcatctaactccatcggctagcctctatcatcgaaaacggccgatagatatagatatcgatattgagctagattacatagtgtatctaccatcttgaatgagtcttcatcgatttgtttaaatctcatgtttcttttcacgcttaatgctgcattggttaggttcgatattttaagtgatgtcttgaaccgttttctctagctttttcaatgaattctaatagagatagcatcggggtttcagccgatcttacctggtttagttgtcttgtgccttatatggttctcgatcttctaaatctgccctttatattaagatcttgtttatttgaagcatatcttgctctttatcagtcttccagtccatcttacttgctatattgatctgcgttttatatattttatttatcctggtatcttagtataaggttgtatcggagtactagccgatacacattgggtttgctctattggctatgctgtaagaattcacaatctctactttgagacacatttagatattaagtaatttatactatctcagcacatcatctgatctatcccaatcacttggtttaaatgtatttcattggatagactgtgtattgctgacatctacagccgatcgagtatatctaataatctctacgctttatcttccctcactgatctaatgcaagttatgtcagcttggctttgaacgatatgtcatcggcaatccagccgatcgttggttgcaggatcaaaccaactggcacgctcaaaatctgaaggcaatctctttggacctacactagagttaagtagatctctcaggccagtgcgtgtttttcgcgtcaaaaagcccataatggagacctttttctctatcaagtcgccggctcctcgaaccgtcttagagaaaaaggctcctccagctgccgcgtccaggtggtcccagacgtgggagtgagtccattgtaaaaattttgcaaaatcagccagtcgtccatcccaagatgaggataggcgaccatatattcctgaagtcgttcccacgccccattaatggactcatccctcgtctgctgaaaacttaggattctcccacgaagggcgttggttttgcccatcgggaagaactttgacaggaatgccgttgagcatttgtaccagatgttgatcgtgacacggttggcataaaaccactgtttctcttttccaaggagggaaaacagaaacaatcgtagcctgacggcgtcaggactgatgcccttcactatgtatgtgctgcagatctccaggaactgttgtagatgtgcattggcatccttattaggcttagcgcagaacgggctagcatgcgccatcgtaatgaggctggacttcagatcgaaatccatgtctcccatgttgatttgcggcccagtggccacgttgttagcgaagggagcagggaattcacgtagggtcttgtcagccatagtcttgaatgttggtggcgctggtatggctggtttttgtgtcggaagagttttctgcggagcaacgacttgcggcttgatgctccgaaagaaaacttctggattctcctttaaattttttggcaagttgaaactagtcatgcactaccctgtttccacaataaaagtgaaaacaactaaggttagccagcaaaggacagtgattctacaagtggtaaatataaaatattagtaacggtaatctcgtttatgaatcttccccagcaacgatgccagaaatgcttgttggtatgtcttaatgacattactagaaacataattcccaacagtgacgcagaaatacttctggtatattatggttatagagtttatccgcaagcgtacggatataccattgtaggatttcacacgagagtattcgatgggtagtttatttgtttaatcccatgggaagattataatagagagaaccgtactaataatttatatattacttgtatcaaccaaagtctaagcaggggttaatataattcatctggtcgagtgacactaagcagaagcattcatactcttactcatgataatctaagctaagtggaaagaatatagaaagatcatattcctatacttctaggatgcatactgttataaaagctagtcgatatagcggaatgacgactaaccttcctgatcgcttcagtcatagatcactcaagacacgccagatgacgacacaggaacacacgatatttgttaacgaggttcagccgaagcctacatccccggggctctgattatgggcgctcctccccaaccaatatagctcctagccgctacgagtccatggcctcgccgccatcctctccctgcgtgtctacgctacattgtagtcgccatggttacattgtggtgccccccctctctatttaagagagatgtcgtgttacagagtccgactctaactctacctcctaacacctattacaacttcaagtccaactgtaatcaaatagaactagtatattcgacacctattctaaccaaatccaaggccagaaatgaacttgtgagagtgcgcagcccggcccaccaaccgtgggccacctaagtcacattgggtctgctcaaccacaggcccaaccggagccacaactttaggtcataggcctacacaacccaaaagactagtttgatgggtgaggatcgaccccaccttttaagtcgtgcttccccatcatcaattaccgatgtgggactaaacccaacaatctcccccgtcacaacatcaggcccaacaatctccctgtcacatcacccatgtgacccgaagacttcttacctgggcctcgggcctaacaatctctcccgtcacaacaacccatgtgaccccgaagactcgttaccggcctccccaccatgtgacccatagaaattgttccgtgttctaaaccttgggctttaataccacttgtgagagtacgcagcccggcccaccaaccgtgggccactcaggtcacattgggcctgctccaccacaggcacaactagagccacaactttagttcctgagcctacacaacctaaaagaccagtctgatgggtgaggaccgcccccaccttttaagtcgtgctcccccatcatcaattagcaatgtgggacaaaacccaacaatatacatattatacatatatcctagttatatcattacttagctaataccctctttccgatgccctcctggtgcttctagaagcaacccttaattgccgagtttcttacgacaatccatcatgaccatacaaccgaggctaaatacggaggagtaccctcccctggaaattaacttaggactatatacacgcgcggaggaatacccgtactgagctgtcaccattagcggcccacctcgtttctgcagcatataaccccaaataatgatctccaataatctaaacaccatgcttaaattaccagatattactctaatatcaccgtcatgacatagagtcgtcgtagatacgatcattatacccacaccattgcatctcctggataagctagcatcataatgaatataacttgaacatatagtaaagttggtatttatatactcggaaagtaatacaataccaaagtagtataaagaagaatattctaataaaagtgcaagtcttacaaaagaaggaaaagcgactagagccatacctgaattcttccaaagactccgaggactgaagattctattctaattctattccactatactctagaaactatactaaacttgagagatgaaatgaacttcttgcttgaggtgtgtggagaaagtgagaaggtgaagtccttttatagcctcccaatgacggttgtgacagttggaatggtcaaaaatgccctccaattgtcattgggatgcaatcgtggacatccacgcaaaaccctgcatccaacggtggagatggtggttcggccgaaccccctggtttggacgaaccatgggctggtgcaatccagcctatttttggctggcagcctcctggagttcttctctttgcagacaagtgaattttcacccaattgatcatgtcatttctgagttcttggcccattcattgataagtctgattctcgacatcgtccgattgattgatcacctgttttgatgtcgattctcctccattttatggtcattctctgcaagaggttagtaatcctagtgctagtggaatatttattatttaaacataaatatgcattgcaagcgtaactagttctcctttattttggtagtattgacggtcgaaactgatcgctaatgaccgccaacagtgttaccaactaggtgtaaagatctgtatgatctttagtcccggttggtaacaccaaccggtgctaagatctcaggggggcctgacagcccctgacaacatgtgaaccgggactaaacattacatagtcccgttgcgcctataaaccgggattaaaaaccgcttttagtctcggtttttagtggattttggctaaccgagcaaagatgtttctccagtagtgaattcatatttgtttgaagcacatatacctacacattgtgataacagagtcgaatacaaaatataaacgatggagatcggatagaatcgtacagataagaacaaaatactcgttttttttttctcgttatcaaagtatctagctgtgtactctctctatctctctctctcttcttatatgcaccctataagggtcaatgcaatacccaacactagattatttggatttgtcccatatttaattattccacaatactaaaagagatatcggtaacaactcgattggaaattcatgcacaggaaaacgacttggttgaaaactgattgtttgaattattgagtccaatgatccacacggacaggataagtcgtcggtcttcaggataagtcgtcggtcttcaggggcaagtaaaatatagattgagtggcctctgcacttataacttctaaagataacatgcaaatgtgtcacatcatcagcaactagctattattatctagaggattattcaaattcacgtgtgccacatcatctcactcactaataattattatttaggatattttaaatatcatacaaatatgatatattattcataattttgttgtctttttagtactcaatatgtaattaatgtcaaatcattatctccacatcattttcacattatttaaatgtgtacatctatcatttctgtaatgtaaaatataaatttatccacagatccggtggcaaaacgcgggatatcaactagtaactagtcttaatgatagacactacatatatcagacaggtactactacacatctagagacatgtatgtctttttgctattatgccatacatgtctctttttttttcttattataaaagctgcaaaacacctcctaatttaccgtccatatacaacggaagcaggacttcgctgctgaccatatgacgacctcggcgataagactgcaatcccttctctcaaccttgttgctagtgttcctgcttctcaccggcagcaacctcctcctttcaagatcagcttctacgcaccgaccaagcccttgtaagttccttgaattcactagctacttgagtttagtaccatggcttcacggatcatgatacaattatttctcgtgattggtggacgtttgcttgttggcacaaaatatacagtactatatcaattcaatattttcttccaatcatttattgaaacacaaacacttgcatgtgttgtatctataagttcactagctattctctcgccgaattgcacacggtccagcgaaacatatttggctcgtttggttaatccttagaaggaagatattcaagggtattgagagagattaattctacacctcgataaatataaaattattcattttcaaatcctcttatttatagattgagtaaacaagtccttaatacttgtttggttactctcccataaggggattgaagggatttgaaggagatttattccgcttctattttagtgtggaattattttctcttactcgccccgaatccttctctcttaggggattaagcaaacaaaaccttatgcaaatactattggttcctaactgggatagggtgctggtttccaaacctgccttgggcgcatttttaaacctggattacgttgctgcaggagtaaatttttatttctcgtgcaggtaccttggaccccaccaatccatctcccatctgtcctggtcaagctccttccccgtattgtccccaaccgccatgtcacaacatgaatcacgcgccagccacggagcaacagggtgcacatttgccttaagtagcagatggtaaagggagcgaggtgaaaaacgtatatatattcagggaaaatttcaaaccaccccaaaagtcatttaacgtttgatgtttcaccctataagtaattttgttggaaaagcctcccaccacccagttttgttgcaacaatctttcaatacaaacgtgattaatcaaatcagcccgttatcactgatattgtgccaccatatgctaaactagccgagttaatcttgtctaggtgcttatattagaccactctttatgtttcactgtattgattttgttaatagctaaactcagtgcaataacgtttaagatctgatccgcaattatgtttgtgggaatctttaaaactttttaattttgacagctccttgtttatgaaaacatgttgatttggtcaaacacgtacgtactgggatggttttctggacacaacagtaggattttaggagggtagaaatttatagcaacataatttatgggatggaatatcaaatttcaagtgttttatactgtggtttttgtaaatttccgtatattttagttcgtgtcatcttttaactcgtcccacatctgtgatcgtctagaactatagtatgtagtagtatgtaataacttatgatgtattcctactaaggaaataatatttccattgcctgcctgctaatgcttttcaaataatcaatatatctatctatctatctatctatctatctattatatacatactaaaagtccattaaacttcctacaaacgctctcaagccgccacgtgaaactcctacaaacgctcctaggtcgccaagtggctctatctaatctaaccgtcgattttaacttaaattggtggacccaatattttagaccattagattagatttttacttaaatcggtggacccggtattttagacaattagattagatgtattttattttattttaaagaaactaattccttactctattacgtacgtatatgggagaaacacaactgaagtaaccaataaagcctacctattgttcgcgtcaaaagaaaaaaaagctgcgcacagaattactataaaatcaataagaaaaaaaaaccatacgtacttagcaccatgggaaaaaattgatgatatttaaaataggattttctatcatttaaagataaaatattttactctataaatttacgtaaatatcaccgttgattttcatttaaattggcggacccgatcgatgttttagaacattagattagatgtatccattatgtatacttcctaaaaatgctcctaatccgccatatgacatcctgcaaacgttcctatgtttccatgtgatgctctaataaattagtaaaattctactttgtctctctgtcctttaaaaaaaagttttgtttcggtatcaaattttgctccataaagagtgtaatttttggttacaaagaaactttttaatgctgcttcgtcgatttctacttcatttaagcacaaaactaataacagtagctccttctccgatgcttgttttcacctctccttattctatatgaagggtacaagtaattgtaattatttaccttttgtttaacttgtctttaactaactaaaataatatttttttagaaatgaagagagtattaagaaagatattaaaacactactatgatttcattaatatggagaaaataaggtgggagaaataaggaggcatctggttcaatggctaaaaacaacaaagaaaaggatgtaatagcactattgaattagatttagcgtatcattataaaactacacaatcaattttagggtccaattcttaaactaaaactacacttttatatggacagacggagtagaaaaaatagaaattaattttgagtcctccgtatataagacgtggggatgcgtgcccatgggtgaaatagcttctctccctctaggccttcgaagcgcaggggatggtagctccggtcaaattaatgtcgacaagcctacaagattgctctatgtcatcccgcctgtcgctggtcatcgtcctgcttgttatcgtcggcagcacggccagcaccgttcctcctgttgccagttcaatggagaactctccttccggatgtaagtgctttattctctagatcgagcgttgaattatttaaccagtataacagttaagaatattgaacacagaatataagatcatcaagtcgagaaataacaaatatgaatgcgggactaacgaacaatgatatataaaagtaaattaggtaaacaaagcaaaccagtcaattcgtcggaatcgacatgtttatcgtgcacttaagttattagtatttttctttcatgtgacgttatcaaacttttatgagaaaatccataaaatgccatcgacaaccaccttgatcccagaaatgccatcgacaaacacaacttcctgaaaatgccatcgtacaagcttatttctcccagaaatgccatcacaccgttagtccacaccgttagaacaaaacattttacaagaatgactaaattgccctcgctccaaataatactatcccaatccaccggtaaaaaaaaactactgctaatgcttgatgcgtcacatgcatggccggcctgcgtcgaaggcgtcggcctgacacgcggacagccagaggaagtgggagggtcacatcggcagtggcgaatgtctcgtccgcgttgtggttggagtcggagtcggcgcttcgctcgctatccctggaggaagaggaggagaggcgggcgagccccgcggcggtcatgctccagacgcgggcgccacagtaggggcagcggacgcgcggctcgagcggggcgtggtggatgacgaggaacccgcgcgtccgcgaccgcatgaacccatggtacgcgtccacgacgtcgtcgtacgcggcgtcggcagtggccgccgcgtgctcgcaaagtggcctggcacggcggcgaccgccgcgccgcagcagaagaagagcagcttcgccatcgccagccaacctcccccaatgcgtcgatgcctgggaccgtcgtgcggatgcctgctgccgacgcgccgccgccggctgctacctcctcaccacccgtcgtgtcaacgcctgggaccaccatgcggacgaatgctgccgacgcgccgctgcctaggggccccgcgccgccacctgggactgatgcgccgccgcctgccacctcctcgccacccgtcgcatcgacgcctgggaccgccgcgccgccaccgcctgggagccccgcgcctgctgccgacgcgccgccgcctaggaccaccgcaccgccgcctgggagccccgcgcttgctgccgacgcgccgccgcctgggaccaccgtgtcgccgcctgggagccacacgccgccgcctgggagccctgcgccaccacctaccacctcctcgccgcccgtcgcgtcgacgcctggaattgacgcgccaccgcctgggagcgccgccttgccgctgttgcccatcgggagctggaggttgaagtggaggggaggaatggtggccggcgatgggatggaagagaaggggatttatcctttgttgaggagggtaatttggtcattttgacaaaattaacagtgtctaacagagtgaaagtgacggcgatggtatttttgggacaaaatggctcgtacgatggcatttcctggaagtcgcgttcgtcgatggcatttcttggattagggtgtttgtcaatggcatttcatggattttctctttatgattagtcctgtttgcctccttagcgattgtgtggcactagctagctgttgttatcagtggaaaatacattctacatctcgtgatgctggtcgaatcaaacgcatgcgaaaaggtttcgatttcagcactggtatatatcgtatagttcaagcagataacgagcttcatccccttcttttccagtccacacatttgcctgaatgatctctttcagcaagaacaatatctgcttttataccacctgctattggcatagagcgaaaatttatcgatgctttccaaggctatatatattaaagtaaaaagtacgaattaccccccgaactatcacggtcgtccgaattacccccctgaaccacaaaaccagatattcttcacccccaactatgcaaaccgggcgaattacccccctgacccaatccgcggtggttttggtctacgtggcagtccagtcagcaatttatttattaaaaaataggtggaccccacctgtcagtctctctctcttctatctcttctatctctctctcctccagacggcgacagcggaggcagcggcgaggcgagcgcggcggaggcagcgagcgcggcggaggaggcagcggcgaggcgaggcgaggtggcagcggcggcggaggaggtgagcggcagcggcggggag

SEQ ID NO: 63844 - DNA, 17509 bp, Oryza sativa
ttaaattttttgaataagacgaacggtcaaacatgtgctaaaaagtcaacggcgtcaaacatttcgaaacggaggtagtagtaaatttattttgttcgtgccctcaaatagttataaatagattaagaatcatccatcatctacagagaaaacagtagaatcattacaaggatatcgtctgtcgttctgcaaaaaaatatttagataaggcgagaatattaattaacaagccaactaaaagacaaattataagtgatggtcacagaacgcaattaacattctagttttgaaatggttaaatcaacaattatattacaataatccatgtaatttagggtgtatactaattaacaaggaactttaacagggagtaatgcccactggagaagagattgcggtgaagaagctatatgttatacctggtcttgatgatgtgcagtttaaaaaggagtttaataaccttatgaaagtccaccatcagaatgtcgtaaggctagttggctactgctatgaaacaaagaagaaacatattgaacgcaacggagaatttgtattttctaacgttgaagaaagagctctctgctttgaacatgtgcagcttggaagccttgacaaacatatttctggtacgattttgctcaatctgcttaaaagtggtttcgaccatgctgtctcagacaattgagttatcttcagtgactttgtgcagatgaatcatgtgggcttgactgggacacacgctacaagataattaaggggatttgcgagggtttaaattaccttcacaatgggtccagcaatcctatttatcatctggatttgaaaccatctaacatattgttagataaaagcatgataccaaaaattgcagatttgggcctgtcaagattctttgcgacaacaaaaacccatatcacaagccaaattaaagggacactgtaagttgcaacctcatgattcatatttgttgacgtctcaatagaattatgtggacctttcacccggaaatgctacctagcgattgatcgctaggggtagctaacagcgatcagattagatttcctcccctccacctggtttccttttttagcaccgcattactttcctattctagtaaatttatgcaactaaagtttatacaccttaagtttacacacctaaagtttagagattcaaagtttataaattaaaagtttatatatccgatttaaatttaaatttgaattcaaatatttatatatatatagtatttctatacatctaaaatttatacacctaaagtttatagacccaaagtttataaatcaaaagtttatatacccgattcaaatttgaatttgaaatatatctgattcaaatttgaatttgaattcaaatatccgattcaaatttgaatttgaattcaaatattctttttatatatagtatttctatacatctaaagtttatacacctaatgtttatagacctaaagtttatagacctaaagtttatatatctgattcaaatttgaagttgaattatatctgattcaaatttgaatttgaattcaaatatttttcatatatagtatttctatacatctaaagtttatacaccaaaggtttatagacctaaagtttataagtcaaatattaaatttaaatatttatggtgtagtaggaagagaaaaaggggaggaggaaggggggagaggagggagcgttggagtataggggagggcccccagcgattacccgtccattagttgtcccccctttcacctcacccataagacaatatctatttatactaagcggtgtggatctagaaaattaaataagacatattggaacctcaaaaaaagggaaaataaaacattggtatcataacatgttattttactggtgccatagcatgttaatcatacttaaatcacagtgttaataattctatgtataataactttagctattgagtttcctaaaattaagtcatcgctggatcatcctttctccaatagatttccacgtgcttatactaccacctaagcgactgataataaaatatgttattctaatagtagttgatctcttcagtaatggcttagatcacgtctaccggtggtaatactagctagtagtagaaaacacacacacacacactatcagtagaaacaaccgtttaagtattcggttcattttgttttgtgtgttttttttataacgatatataatttgtgtttatatactatgcagcggatacatgccaccagaatacattgaaagacgccaaatcaccaagaagtttgatgtattcagtttaggtgttataatcatagatataattgctggaccttcgggctactctaaatgtgctgaaatgacttcccaacagtttattgaacttgtaagaaaagttccattttatcttatatcgtgaacaatagttattttagtataattaatttgtactgtatgcacgcatgcttacataccttctctactgtattgttcaattttgaaggtacaaggaaactggaagaaaagactgcatgcagcaacatcgaggtatgcatcgcaggaagcagatagcctacaagtgaagacatgccttgaaatagcattaagatgtattgataaagaccgagcaaaaagacctactataagcgatattgttgataaaatgaatgagatcgataccctaaaaatgtcacttctaagcaaggtatattatctccaaacttgtttggtttcgtactacaccaaaataatgccaaaatttgataatgctaagttttaattatttttttgactgaaaagttctaataattttgatacagtaatggtagaattggttattattgtgtttagtaatttgttaccaaaatattataatgtgatttaggtgtatatggtattaaaaaccaaaccaatgtttattcatagtacgatacccctccatcccaaagtaaactcttagtttttcctgaggagattcaggatagaggaaaaagactataatacccctcattaaatgtgatatttggggagttacatggcagctggggataattaagactaagtgaaaattaaatgagaggtggttggtgagggatgtactctctccggttctataataattgacgtttttgacaagattgaggtgaaacttgtataactttaaccatcaataagttttaaaatatttagtttaaagaaactagaacaacatatatagatttgcctttcaaagcactataacagaattaaacatgtatttatttattatatatattataatagaaaaataaggtcaaaaatatattttgtaaaccgtgtcattgtccaaaacatcaattaaaataaaactagagggagtagtgatctattgagacaaatttcagatgctaaaagtggccttttattttgggacgaactagaaaattttgaattgtttaattaatgcattatatatggtaccataaccacattttatagtcctacaacattagtaatatctctatggatcttcgttgcagagacctgagcctagggagtttcttgggttcgaccctctagagctacgcttcccattcgagactaacaaggcgatatcctgcgtactgcagctaacaaacaagtcagatgacatcgtcgagttctatgcaaacacaaacaagaagaagtaccaaatacacagggaccaaggagttatggcaccatggtctaggtgctatgtcatcgtaacgctgcaaccacaggggagcgcaccaccgaacatgcagtgcgacgatatgttctttgtacggagcactagggtgagggagacagacatcggctcacttgacattaatgtcactgagcagcacttggaaaaacagatgggtgaggttaagtcattgccgattgtctttgttccaattcctcagcctccaacaagtattgcggattaaacggcatggtttgaggcatcatggagtaacatcatcaatttgtgtcggcatttgatatgcttacaaatatttaagttgttcgatgagttacttttttggaatttcaaattcactactcgatgtgatgttcaaaatctcgtaaatttgtgagaacatatgtatcatgtttatctatgtaaaatcaaagtgttttttattcttattctgtgataaataaattggtatatatgattattggttctgatatttggagattactgttgtttgctaacaataagtcaagttggagataacttgtgctcaaaatatggtttctttgtttgattcatgtgtaggtgacttgatgcctcgggagagtattgccggtgatggatcgagagtcgacttggacataagacgacgtccggacggtcagatatcatgcgggatacttaggctagagttcaatgcgcgtggttggtgaagatttcatatggcatacaatggagatattgtgtacgtatgggatgcagagtcgaatttggaaggaatccaaatttggtacaattggagtttgtgaagtttatttcttgtatgggaaggtttcttatgaggattaagacttcttgtatgagtttggttcgtaggtatagactgtctacctcatatataaatagagagggagcatgaggcttcttggtatcgcttttgaaagcattgagtttagagtaagagagttagtgtttcgagtttagtcgagattttcatgaagagtgctgttgttgcaccttgttaacacggagagaagtaataaagttgtcatctacatatagagttcttcgatttgtgtttgctcgggttcggcggtctaaccggcgagacaccagcgatcagaccggcggtatcgcagcggtcagaccggcggattcaaggcagtcagaccggcaatggcaacagggagcagaggcgacttcagggcggtcgaatcgagcgttctacatcggtcagaccgacggcttccaggcggtcagaccagcacgactacttcggtcagaccgcgatctgtcaaatttgagggtaacttttaatttcgctaaaagttttggtttttcggtacaccaaccattcacccccctcgggttggcttagttcttgctattcgatcctataagtggtatcagagccttgttttcttctttggattttaaccgatctagagttttagccatggctaacaagttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcttctaactttgtcttcagctcagaagcactactcttctgaaaagggggaataaaagcaaggctgagtacagccaccgtactcagcaagccacaccaacgatgcagacatgcaaggggatacaaggaggggtttgtggctatttgcataaaggcagttgtaaaacactttattgagcaaaacagtaaaacggttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttctactctgatcagaggtgtacaactgtacccacaagacacagccccacgacacgtttccgtgcgccgacatgccaccacgacataccggaaagaggccgtgacaggacccttcgcataaccccctctaactaagcacaccacacctcaggtttcacccccactcctcgcaaggcagcgagcagtcccctctcgtgcctaggtgaatccagaagccgcatagaccgtcgcagggcccatccgaactccatcacgcccacccttgcctggatgcgtcagctagaggaaagctacactacaagcccagccgttgcccacgctggcttgtggtaagtacgataagtttttccagggcatcccgcgaactggtccttaactgccatgggtgcgaccagcaaaaccatgcacccacagcccaccattcagttgcattttagttggataattacgaccatgaagcatggccagatgtctcgagcacgcagctcattctgatactaaaaaggtctaatactataattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaataccctgaccccatgtaattagcaaaacatgcatatttatttgtaaacggtaaaacatttataaattgggatcaacatgctcaaggggagtgtgtgacttgccttgcttcttcaaacaatcttccgaactcttatccttgcgaacgcgatcttccgaaacgacgggaactacacgctggcacgcaaaatgaggaaaaactctaataaaaaccaaggtaacagtacatataaactaaacaaacatgtagagctcaattttagatgaattttgcaagttgaacggctcaattcggagttcgaatgaattagatatgaattttagaagttttgagccatttatatgaatttctagaattattcacgaattattgcgcaattattatttatttttacaaaggaaaaggacctcgctgacgtcagcaaggggcggccggcgccgacacgcgggccccacacgtcagcgagtcaaagggggagggcgcacggtggacatggtccacacgtggcctcgggtgcgcgtccaccacgtggacggcccagatcggcctgagccgattgggcggccgaggggagcggcagccaggggcacaggcgcggcacgaagccggcccggccgagccaaggcgcggcggcggcagggaccaaagcgacggcggcacacgggctgggcggccaccggcggcggcggcacggcgcgcgcaagcacgggaagcggccggccaaggggagaaagagggaagagggggtggagtgctcacctagggcggcgacgaggggcggggaaaggagggggagctcggcgtcggcgctcctcgggacgaaggcggaacggcgacccggcggcgttccgcgaacgggaaccggcggacggcggccggaaggacctggggaggatgggggagaggttaagagggggagagagggctcccagcggcatgaatcgctggtcggaggtgagaacgggcggcggatgcgcaccggcgcaaggggaaccgtgttccggcgggatcctggccgtgaaaagcggcggccgaggtgctcctcggcgctgcgaagcgagcggcggcgacagcgcgacttggggtggctaggagcggcgccaagcggcggctggagtcggcggcggcggtggaaggaggtggtgcgcgtggcgacggtgcttcggaggcggggaggggaaatggagcggacgccggggtgcggcacgacgcggcgaagccgcttgtggcggtcgcgcggaacgacggtggtgggagcggctgtggcgaccggctggagggtcgtcggcgagcggcggcgggaggtgcgacggtggcggggtggttttcgtgcacgggagggctcgggagagaggggaaaagggagagggaggtgcggggaatgtttttataggggaggggaggccggattgagcccgagagaggtagaaaccggccggcgacgtgggaggagagagagatgcgggaggcggcgacgtggccggattttgcggggagagtggggggaaacggcgcggacgtgggcgacgaccgcgtccacgcacgcgcgggagagggagtcgcgcgggagaggcggcgacgtgggaggatttggcggccatggcggcggttggggatggagctggaggtaggagatgacatgtggggcccacctgtcggagagagggggaggggaaaataggctagggaggaaatgtagacttgaggaagagagagagccgagcgggccgaggaagggaagcccagcctaggaaggaggaggggaggaatttgggccaagcccgaaaggaaggaaggggaagattattttcttttctttttattctaattggttaaatgaactttgtgctatttaaaattatttcttgagctccgaaaattcacgggaaatttcagagagtattttagggaacaaagaatattgcaaaatattcccggccaatgatttttaagggaaaattttaattctcccattaattcactcgaataaattgcttaaatttttatttaatttctaggaaatgcattattaaatgatttttaatcccgaacgaaaatcggggcgttacacaagtttactactaagccccatgttttcgatggttcggattttgcttattggtgtaataagatgcaatcttacattatggctgaggatcttgatatttggagaaaagtttctaatccttatgtgattcctgatcaaattaatactgctgctttaaaaactgaatttgaaaataattgcaaagctcgcaatattcttttgagtgggatttttcgttcagattttgatcgtgtttcacatcctcaaaccgccaatgagataaactttcaagaaacttcaaatattaaagaacttcatcgagatcttttcaaaaaggaatacataaaattttagatgaaacctgaagaagctttggatgacaatcattctaggttcaacaagattttgagtgatcttagatctgtagattctgcttatgatattaactactcacaatctaagatttctcgacactttttgattggtcttgacatgtatatttgggagatgaaagttacatctattcatgagtctattgatatgtccactctgactttggattcgctttacacaaaactcaaaactcatgagataaacattctttctcataaagttgattctaaatctagtgctttgatttcttcctcatcttctttggatgttggtgcttcttcatcaaattctactactcttactttgattaatgccatgtccgatgagcaacttgaacggttcgaggaggagaacttggttttagctgctaacaagatttctcgagctatgaacaatgtcaggaacaggaaaagaggaggtccaacttgttgcttcgagtatggagcacttgatcacatacgttcgcattgtcctaagcttgggagaggcaagaaggttaccaaggaagatgaaatcaacaagaaggagaagaagaagagtctcaagcagaggttaatccgagaactcatagaagcttttgatactgatgagtcggagaatgaagaagagagcaaaggtaagcaagttgttgatctagcttttatttctcgtaatgcaaattcagatgtggatgaatctgatagtgatagtgaagaaaagcttagttatcatcaattagaacatgctgctttcaaatttgctaaaatacttaaaacatgttctaatatgcttgatgagaaggatcatactattgagattctaaatgctgaaattgatagattaaaatcttcgattcctaatgatgatgattgcaaatattgtgaagttttattttctgaaattaatgttttgcgagatgtcaattctgttagtcataagaaattggaatctgagattgaaaagtctaaaaaattggagtcttcttttgctcttggatttgctttgcatgctcgtgttgttgatgaattggttttcacaaagggctttttgacaaaatacaaagttgctttttgtgcaagtactttgttaaatttttatgtccaaaaagggctaaacaaaataaagatgttttggtttctcaaaattgttctaagtgctttttgaatgagatgaaattgaaagatgctttaggacgtgctgagcatatggaaaacattgtgaaatctgatgaagtgctttcttgtcccaaatgtcgtaaaagcaaaggtgacatggtagattgtgaaaattgtgctaatttggaaaaagaagtttcttgtttgaaaagttctttgcaaatattttcttatagtaataaacaacttaacatgattttggatcaatctaaagtgactagttccaataggggtgttggttttgatgttcatgaccatttcaccaaaaatcaacctattgttttgagtgtgactgaacatggtgaaattttgacaaaaccaagtgctaagaaaacagtttttaagtctgctggaattttgccctctctttctgcaaatttaaaagaaacaaaaacaaatctttcaaaaccatctacttcacaaacttgtcgtgagaagtatacatgttctttttttttggaaaagatggacatttggttgtttttgtttttgacttgcttttgcgaaacgacgatggcaaaaattgggttttcatgcgaggagcacggccagaccgacactgaccagtcggtcagaccggctgccaggtctagttagaccatagggacactggcggtcagatcagcctcggggtgattttgcgtgtaattcaaatcggaattttgaaagcgacaaggtaagttttcagataagtctggtcctgattttgttagtgcttttgtacctactggttctactggtcgtgtgactcagtgttggattccaaagtttcttattcctaaccccaacacggaggccttgatatcttctcgttcataggtattttgatggcatactccccatgagcattcaatgttgagatgacaattgcttttcaaggtaacatcaacttacttttgaattgacataattttgttccactttcctcattattagcttttcatatgctagtgtttgaggtagtagttttggttaatttgagtgaatgtatgttaattcatgagaactttggtggtatcgttggcaattggatgtctttttcaaaatctttgatttcttcttgatttttcttcagggagaattgaggttaatttcagggagagttagtgctttttcatttatctttttggcatggtttgagggggagtttttgtacctcatggttttatcaagcaaaattagcaataagaaaaattgagaaaagagagctttattttatatatatggtatattcttgtgcatgctagcaatatattatgaagctttacttgtctctagtatagcttgtatgtattctagtctttttatgaggcttagatattgcttttaagggaaatgatgcatgacacttaaattctatacttgaattaagagaatttgcgaaattgatgctagcatatggtttgatttataaatgcttatatatgctttattgaattgttatttctcaaatagctttgtaattgctcattgttcaatagaataaaaatatctatgagagaaaaaaatgaataccgaatccttggaaacagtcttgacgacaaggacgtattcgatgtgagcaaaaataatgggtgccgaatccttggaaacagtcttgatgacaaggacgtaccaggaataattgagggaaaaaatgagcaaaaaggctcaagtaaaagttaaaaattctcttggttgttttgtgctaaagttaatttgagaaagtgtgataattgcaataggtatatatgtataatgtttattttttcaacctatgtgcttgtaaagatgttgcattataaatcatatgaaatcatgaaatttgattgttgatttgaacttaattgtaaaatatttggttcatgattatactttaatgcatgcttgctatattatagatgggttcatcttctttttataacacaacttgacgtgatgtgccatatgtatgctaagctcatgaacataaatgaacataattcgtatgcttgatgaaatcattgtcaaaagggaggagaagagaagagattgtgcatgtttttcgatcaaggggaaatttctttcttttcaaaagtaagagaagtcttcttttggattttgagcacgatgtgtgcttttgcacgaagtgtgtttttttaccacttttgtttttatttttccaaacaccaaaatatttttggatggatttgccaatgtgttcatcaagggggagattgtaaaatcaaagtgtttttcattcttattctgtgatgaacaaattggcatatgtgattattggttttgatatttggatattactgttatttgctaacaatgagtcaagttggagatagcttgagctcggaatatggtttttttgtttgattcatgtgtaggtgacttgatgcctcgtgagagtattgccgatgatggaccgggagttgacttggagataaggcgacgtctggacggtcagatatcatgcgggatacttaggctagagttcaatgcacgtagttggtgaagatttcatatggcatacgatggagatattgtgtacgtatgggatacggagtcgaatttggaaggagtccaaatttggtacaattggagtatgtgaagtttgtttcttgtacgggaaggtttactagttggattaggacttcttgtatgaatttggttcgtggttttaggctgcctacctcatgtataaatagagagggagtgtgagacttcttggtatcgcttttaagagcattgagtctagagtaaagttagggtttcgagtttagtcgagattttcgtgaggagtgctgttgttgcactttgtaaacacagagataagtaataaagttgtcatctacatctagagttcttcgatttgtgtttgctcaggttcggtggtctaatagtcgagacaccagcggtcataccggcggcatcgcggcggtcagaccgcgacggattcaaggcggtcagaccggtgacggcaacagggagcaggggcgacttcaaggcggtcggactgagcattctacttcggtcagaccggcacgactgcttcggtcagaccgtgatctgtcgaatttgagggtaacttttaattccgttaaaagttttggtttttgggtacactaaccattcaatcccctctggttggcttagttcgtgctattcgatcctacaatctcaatgtgttgatcatgattggacagctctattctacaccccccttagaataactattctacactccctcctatcctacccaaccacctcagcccaccccagccagctggatgcggcaacggtttccattgactgtgagcagtccgggagacggcgcggggactagctgagttctttcccccactttcccaactcacatctctcgttttccacgcatacgcttttcaaactattaaacagtgcgttttttaaaaaaaaattctatacaaaagttgcttttaaaaatcaaattaatctatttttttaaaaaaattgctaatacttaattaatcacgcgctaatggaccgctccgttttccacgtggagttgggttcccaacccgaagcagcgaacacaaccttagagcaagtttaatagtatagtcaactagtagctccaattcatctatagctaatctaatagctcgtccatacaatagttacatactacactattaatattcggtcctacctgtcatacacacactgcgtcttggagtccgtgctagagaagctgaccggatggatgggctgctgggctgaagagtacgtgtgggctgtgctaaccagatccaaaccattgagagtggactgcactgaccaggatcttgatcattaggataggatccaacggctattgtttatttgatgatgtagatgaaccggaaattgctaatatctacactaaagtggggatgatttgtataggtatataggatgttggaattttggttctgcatatacatcaagtggaaccaaaaacatatctagaccctacccagtgagacaaacaagagaagcaaagcagaacacataaaacaaaaaagaaactatggttctgtttgttttattgcataaaccagctctaccaaaatttctgcattgctaattttcaggggtgttgaaatatgtttggtctgaaacttcaacatattttcgtatatttttaacggaaacttttgaatctacgaatataagtatgcttggtttgttatcttagcaaaagttagtaatgacaaaaatttacagggttgaaagtgaagacaaaccaaacaggcattatgtatgtatgatggtgcacctaccaattccagtatgtcaacagagtagttcctagcaaccggtgctcagcatttcatttgggtagtgaatgttcaatatattcaaacgaacagcagctaaaatatactccctccatatatgtatgacactgttgacttttcgatcaacgtttgaccattcgttttattcaaatattttgtgcaaatatgaaaatatttatatcatgcttaaagaaatttgatgatgaatcaagtcacaataaaataaatgataattacataaattttttttaataaaacgaatggtcaaacgttaaaaaaaagtcaacggcttcatacattaaaatgaaggtagtattatatatgtagtttcttaatgaacaatacaacagtcagcaggagtacgcgacaatcttatgataaacaaagcaatatcaagaagtagaaaggggaggcatatgcacacaaactaatgcctcaacagcatttggccaatctcaggttagaatttgcgaatgtagatcccaaatgtttcgaggcactgctctgcacggccaaagaaaccaacgatgttgctactatactccaacggatcaactttaaacggagtccctcctccttgtccaaaaggtccataggtaccaccatttgtgaagaacttaagcgatgtaataacattcggcattgaattaaacggacctactgttccagaaacttcccttagaaagtcgtgagagccaagccgaatctacaaggaaaggagaaccgttagcaaactatttatgtataaaaagaaataattaattggcaccctatattactggacaggtattttaagattcagttattacttaccatttggctactttcactactagcacttccccaaggacctgaagtgtgattgtccccattaacttcactataggaaaattcgagggaatcaacaacaacagaactataaattgttatgctttctagacggtgaggaactgtctccatgacatattcgattcctccatttccaccccaaggaccaatcttgttgaacccagcctcatgagaacaaaccacaaaaaaaaattagaaatgaagaagaaaattaatcgagaacagacatacaaaaataacaaattaacttcttgcagtaagttagtaccatctccatctcctctcctcttcctccaattgtttgcacatcagtggtcaattcctcttcatcaagtactgtgggttgtttcggatgaaggtagacgccgattgcatcaatataccagcccgcacgcccaaagaagccaacaatactgtcagtactctttgttggtgcacagaattcagttcctcctccttgtccgaaaggcccgtatatatgtgttttgaggtattgaggaggaagtatatgaggggtagtttctttcagagttttgacgtggatggctcacagttttggaagggattacatcaatgtaagaattacttgcagaggttggtgaccaagaaagtgcatgatggtagtaaggttgatttctggggtgatacatggtgtggtgaggttcctttcaaagtggcctttaataagctgtttgagataagtttacatcagaaagctactatcaaggagatttggaataatggggattggaatacggtactcagcaaaccattgctctatataaataatcccccccagttgctgaagaagatgaagcggatcctgctgatgaggagttcttccaggagcaagccggctacgatgagttttagggtttcggcctagttcccaagtcgcgcctgtgatgtttggtccaagacctggcttccgcttcccttttgtaatgcagttgtgagctcgggatctgtccgcagcccaacatgactgtacctctactctataataaagagacctctgttgctgtgataatctgtcttcctgtgataccagcactgtttcctgggactggtatcgattaacaggttaatttggagcgtcacggggtagttccggtcggtactagttcggggcgtgacaatatataactctagatattgactcccttataaggcccaattccaatatattacagtgcaaagataattctcagcagccagtactcaatgtttccatttattaaatttcttttgagaaacgagacaggaaataataatgcaacaattataccattatacatacgaataagaatactctaaatcatgcaacaacatgtgtgtgaagatcaagcaatatgcataatcaatatgtgcgaacgtagaccccaagtgcctcgacatatgaccttgcgtgaccaaagaagccaacaatttttccgttgctctgcattggaacgtcaaatggagtccctcctccttgaccaaaaggtccatagctacgaacatttgtaacaaatgtaacagatgttacaacacatcgtgatgcacgaaatggacctattgttccaaaaactcgcaccaagaactcagaagagccgaacttaacctgaaaaggagcaaatgaagagatcatcgatcaagaagctagtacgtattttccacaagatagggaataattgatgagcaacatataaagattagcaaaatgggaaaaggttggatcactgactgtatggctcatcccaccaggaccaccccatgggcctatatcgtatttttgcccgttggatttactgtacgaaaatgcaagtgaatcaatgacaacagcactgcagatcgtcacgctttctaaatggtgaggtgccactgccacattgatgtccttaacaattccttcgcttccgccccatggcccaatctttgcaagccgatcctggattacaatccagtaaaccaaaaattaggaaaatattacacaatatatataactgaaaaaattaatactatctccgtttcaggttataagactttcttgctaaaaagtcttataacctgaaacagaggaagtagaacataagtagacatggatgggattttacgttctcgtccactcctgcatccacgttgacgcctatcgcatgcatgtatctacctgcatacccaaaaaatccaacaatgctactgttgcctttcactggggtactgaaaggaacccctcctcctgttccataaggtccatatgtatccttgctggtgacaaatgtaattgacgttataacatcagaacgtgaatcgacgtaggggccaattgttccataaacatccaacagagattctgaaggatc

SEQ ID NO: 63845 - DNA, 1436 bp, Oryza sativa
ccggtcacgtccggttgaacgggcggccgtgcccccacgccgcctttgtctccggcggagtgggggtaggtatgacccatcacgtcagagcgtcactcgaaggagggctaccacaagtcttcacttatttatgagggaatgacagggctgtcccccgtgtcaggcgggggacggcgctgggacccactcaaggaccggttgctgcttagcttccgggggaaggcacggattgaggccctgtcaaagtggagcggggtccccctcccatggaggggtaggtacaggcggtgcatgtggtatccccttgagctataaaaggaggaccttgcccaccgagacaagaggacgactctcagaaaacctgaactctaggagaaggaaagcgagagtgctctccagagtaaaggatcctttgtaaaactcatccataatcccaaacacaggagtagggtgttacactccatagtggcccgaacctgtataatccgattgtgtgcaagctagccggtagtcttaggggcgaacacgtgttttccaagaggcgagcctcagcccccggccgaactcacgaaaggggggtcttgcgactccccgccatcgaggatcttccctcgacagctggcgcgccaggtagggggagttgcgcgcttcgagaaaaagtcgttttcttccgccccaagtttctctgggccctagacgatcatggtcgaggtcctggaggtggaggaggaggcggtggcgtttatccccaccccgtccgggagtggggattccggcgaaagccgtggccctcgtcaccaccgccgagattctccaactccttcccgccgcgaaccttcgcggtgggaggatcccacccgttcgggtggttcggccctctccccgccccctggcggagggaggccgcgatgcgtcggggaacgccgccgtctcgtctacggagacggcggttcgccccgaggcgcgcttcaggcggcaggcgcccttctgcggcatcccccggtaaacccggtgccggagactcccgttcagcgctggctggacgacgtggccaacttagtcaccactgcccagcggcagttggccacgggtggccgatccgccgccacttatacgtcgcgtaccccggttactctctcctcgtcggcaaggaggagggcccgtcggtcggccacgatctcaaggcggtccacagctccaacatcgtcgggggcctcaggaagccggaggcgttatgacggtctctacgggaagcaggacgctcggatcaacatcaagcgacgctggaacgagtgccgagctgcccgcatgggggaaggcgcctcatcatctggagtgccacgctcctgttcacgaggcggccctccccccacgctcacccttggggggacaggttgtagggccttcgtggcgagtctccggaatgtccggtggcc

SEQ ID NO: 63846 - DNA, 1039 bp, Oryza sativa
ctatagggcgaattcgagctcggtacccaagcaccaccaccaccaccacccgggcggcgcgccgccgcccatgcccatgtacagcgccgcgcccatgggccaccccgtcgccggccacatggtgcccgccgccgtcggcacgccggtggtgttcccgccgggccacgcgccgtacgtcgtgcccgtcggctacccggcgccaccggccaagatgcaccaatgacgcgccatggacggacatgagcagcatttcttcctcctcctttcttgatgtgaatcttgatttgttctttgtgtagtcgccggctcatcgtccctgatcatcttgttcttctcacaatctcactaatgtaaacatacatagatcagatgccaagagtgcagggattggggattaaaggcgaataagtaaagtattttgctgactgtttgcaagtgatcatcacgtacacccggtgaaagcttagctccaaatgtggatgtaattagcagcggccttccgtacgtggtggcgccgatcgatgatcttgcaggggttgcaattagggattgatttccattttgctgatgtaaatttgcctactgtctcattggaccaaaacatatctctctctctctctctctctctctctctctctgccatatatatatcagtgttgatgaatggattggtgttttcctcatgttcatcctctcctcttctatcattggattaacgttttgtgttctggagcatctcatactttcagagaggcgacgtgggttcaatctaaattgtaatattatgtattctcgtgtttccatttaaattcctttgtgtctcattttggagctgatgacattacagtgtgtgcttgcttgcttcttgagtatatgtttcagcttcagtttttcaaagaactgaaatgaggaggctcccaatgcagacattgggtggtgcataaggacgaaccagaggcgttccaaatggtctgaaactctagaataccaggtgatccctcgcgttttgatgcaggatttataaatgagtatatgttaa

SEQ ID NO: 63847 - DNA, 613 bp, Oryza sativa
tagaggccctcggcattgatgacgcgcgcacaatgcttgccgcctcgccccttagcgcacgccgggtagccaagcgaggaagctgggccacgccgccgcacgcgcatgttgaagggagacgggtcacgccgctgcagtgtaggtggaggagaggcgaggtgggaggaccgtggtggtcgccggtggcgagcggaggtgctattgcggctggagtgtgagagggagtgagatgtgggggaagaatatgacaagtcgacccggggcatttttgacctttcatgttgtttatctctcctattcaatcggaatttaatattttagtgtatgcggtgcccatcaacaaataaccacattttgagagtgtcttcccctaaagatcgacttttgacgtgtcctagagttaaaaccacaaattgtagtgtcctacaacaataattgtcttttctttttgtaaaattggtttcacgtcattgaaagttttcgaatgttggtttgcaccatcgaaaggttccgttgcactttaatacttggaaactttcgatgccgtggaacctattttacctattttttatttattgattcccaaagctattcacataacgacatgcagtgg

SEQ ID NO: 63848 - DNA, 3017 bp, Oryza sativa
ggcggcggcggtttggggatgaggaggagcggcgaggaggaggagcagcggcgtgacggatccggcgatcgctccgcgtggactgcggcggcggcggatcggggatgaggaggagcagcgacgaggagcagcagcgtggttcggggatgaggaggagcggtgacgaggaggagcagcggtggtggaggatgagggaggcgagggagaagaggcttcgtgctcctcctcgcgttcgcccgcatctggctcctccctagggtcggagcactgcagcggaggtggaggatggaggaggatcagggacgcggcgatggtttgttccctcttcacttatgcttagtcccctgctctgccgatggtggtggaggtcctggatagggcggatatgacggaatcgacagcggcggagaggaggccacatcccggcgtccggttcacctcctccatgcggtggctggtgcaatccgagccatcgaggtgggcgacgatgccatcaaaggggtgggaagactggtcgttgccggctccatatccacaccagtgatgcggcggaccagatccaggtgcttcttgcttcttttccccacgaagagagacaaagagggagaagaaagggatgccagtgatgctgcaatgcaacgtctcctctgtgcgcctggcatcaaccccatcgatctgatcatcttctttctcctgttcgtcttcgttttctttccttcttttctctgacacgcccattgattttgcaaagatttcactgtggtgatgcctgctgagtactgttctcataatgcattcagacggttggtggtgctcccctccaaccgagtgaccgtcagcaggagagggcggtggcatcctgcggtggctggagcgacgactggtgctgctccactcccccaagttgagacctattggaggagcaggcggcagcttccggcggtggccaggcgtaggcatttgatcagagattcataatgtacacaacagtgcatcagatctttgttgggatacatacatctgttttgcattccgttttcattgatttgcaggtttcctgatcagagcagtagaacaccacctgcaacatgcacatactctggtgtttctctgcattggctatttttgccaacaagatcatcaacaccccaccctccaggtacaaatatgacccttcacatgctttgatctctctgggtgcctgcggtatgtttttcacatgcatccaaatatgttggtaactaggatttatttttggggatttttttcctcctgaatagagcagagcagctcgactgcctcttgtattgttttcattagtcttctgagaacatttagttgatatgctagcagtttctgaaattttctacctgataagtttctgaaattttgtagtagtagttgatatcttattagcttctgaaatttcgtagttcagcacaacacctagctgataggctaaacagtcctctgaatttttttaagaatacttctttgaatggctgaaagatggatggagaatcttcattgagagagatgtttttcagagctctgaatgtcattttgtccaagtgaagccattttaaaattttcattttggttggctggacagtttgatactctgttggcatcgaagctctgaaatattgtgaaagttgtggggtttggtgaggtcgaaggataacagctttggtgtaatttacaagcgcatacaaaaaacttactaacaactgcattaaggctgcgttctttcaggggagataggggggattgtccctcgttttccgcgcgcacgcttttcaaactactatacgttgcgtttttcgcaaaaattttctataggaaagttgctttaaaaaatcatattaatccattttttaagtttaaaatagttaatactcaattaatcatgtgctaatggctcacctcgttttgcatatcttcccaatcttctctatttccttctcctcaaacacagcctaagttcacaggtatattaacatattgtgtgcatggaaccatccactgaaaatatagtgccagatattgctgggaagcagtgcaaccagtccatagattagctgcacttgctgatcaggattatgaagcctaaccctgctgcttgcaagaatgatttcaagtggaatctctttatccagtttagaaatcagaattgaagaggtgcttaaattcatgctggagatgacaaatgcgtaatttttctatccatcaacacggcttgcccctctgctcgccgctggggaagattgatgcaccgacgaagtggcctctgccgactgctccctcaacaccagatccaacacgtaccaagcagtcacgccgacacattgtggatttagcttcatgtttccttctcttttttttttttgcctgtggatgtgtaattttttttacccatacagtgacatgttgatcatttactcctaatttggtgaaaatgttgatcgtttactcctaatttggtttctcctgagtgatccagtgaaaaatatacctgactaaaagtaaaagtattacttcacgtgaaaaatacacttgagtaaaagtattactacgttatgtggcagtatggttaaaatgtaaattttgtgccatttgagtttagtcgaagagtaaatctattactacatttgcaactctacctgattatacagaagtaatctatttactaagagaagatgcctctacaatctgtgtaagaagaatgagcagtaccatttatagaaccagtagtaatttttttactaagagaagatgcctgtgtaatatgtgcaagaagaagaacgagcagtaccctatatagaaccagtagtaatttttttactgatatgatatttttggggtacttcattgtaaagggaaaagcattgtctaccataaacccaattagtaaatttgttactcaaggaaacattgtatgtgtgggaaaaaaaactaaaaaaaagaaaaaagaggaaacgaacggtagttactgtgtgcgggcgaaaaaaagaaaa

SEQ ID NO: 63849 - DNA, 25426 bp, Oryza sativa
atagaaattcatatatattttaaggaattagaagagcgtatatattttagtccctcaaccatggctagggtcttattgtgatttcttaactacaaaactatttacttttggccccacatatctcaaatcatccacattacatccctagccttatgtccaaagtagggtggttttcaatgacttaaaaggtttattagggtctatatgtgctaatagtagaagacatgcatcatcatactaataaataacaaaaaaagcaaaataaataaaaaatgaagacaatatacatcatacataacctgtttctcctatatcttagatatggtttagctttaattcacaaactagaatgactcgtggtcacgacaaaccaccaataagctcagggatgaaatatggatggtttcatgagtcaagagaccaatagtgatcactttcatagttgagggaccaaatttcaatacagtctactctgcgttggaactatatccaaggtaaaacagtagagttcttttattaagttcaatctgttttcttcattaattggttcaaattaaactaacatattataagcataaaatatatagtgatcttgtaagctcatacaaattaaaagctaaacataacagcatgaaaagaaaatgaatgaaactaaacaggtaagaaaactccactaaaatgtgcttgaagtatgactacatattctatgacttaggctatgcatatgtaagttcagactctcggtgagtgaaaataagaaattttcataagaataatcagtaaatattaataaaaagaaaacaattgttgatgtattatgtaaaagtattacctccgtctcaaaataagtagatatcttgctatatataagcctatatattttgggacagagaaaacacttactacaatcaactacacgtactatgtattgatacttcctatcttggttcccgcttcaatttataaccttataagatagacacatttttttccctccaatccatgatttgtatatctacttcatacgatccgttgcagcaaaccgactatcatgccctccaatcaagctgggtttgctttctcctatcgtaaaatctaattcgagagccctttcgttttagcgctattgcgcgacactggcagagccgtccgatcacttgcgtcatcatggagtccatctgcgtgggccttgcagtcgcaggcgtggctttctggataaggatcgagatgaaaccaccccaaccacacatcacacgcaattcctgcttcatagagagtcacagagagagagggggtacagtttctcccccatgtcctttttctcttcaacaaagttttctctcaaattacttatccgatctacaatccgattacaccattgtatttgttacaattaaatcttcacaacaagatcttacatgattatattacgatgaaaaaatatttctatttgtaaattacttttattatatacataagttacttttatcatatatataagttacttttagatttgactaaattacttcttagacatataacagtaaattcaataaagtctaaaagtaatttacatatattataaaagtaacttaaaacaaaactgaagtaactttgtcatgacattagaagtaaattcgttgtagggataaaataggactttatctagaaattaaatttaatcaaaataaatcaacacacgtaagtttaacaatttttaaaagtaacttcaatgttaattggaagtaacttttgcatggttcaagttgaaaggagatactagatggagtacaaactagctaccactagctgtgtagtcacgtccgatgaaaaaaggcattaattaaagttactttctttttgttaaaagttacttctagaatacatgtaaattacttttaggctttattgaatttacttttatatgtctaagaagtaatttagtgaaatctaaaagtaatttagatttattataaaagtaatttattattttttatcaaaatataatcatgtgagatcttgttataaatatttaattgttatgaacacaatagtgtaatcggatcgtagatcggatgagtagtttaagagaaaaatgtatttgaagtataagtggatagtgtctctcatagatggagtggtagctgatttagacaaactagctaccactagccgtgtagtcacatccttctcctatgtctacctatctgtctgccagataaaatcaaaacatgcaacctttctatttggcattgttcctttttgcacgcaaaatctaaaccgagagcgctctcgatttaatgttaatgagcgacgcactcattcgtgagagaaggttcagtgctactagtacgtgagagaagggtcctgtgctgctagtacagctatgtgagaaaatgtcccgttgttacctgtgcacataatgcatatctatttgttttctttttatagaattttctctcaaattatttatccaatctacaatcagattacaccattatgtttgttgcaattaaatctttacaacaagatcttacatgattatattatgatgaaaaaatatttatatttttaaattacttttattatcggaaacgctatatttgtgatgccacaaatttgtttgttttgcagtcagatattttgactgttgatgttgctttaagatctgtgttatatattgccgtggcaacttacgttgcggctgtgattaattaaaacttagcatcttcattagttcaagctttaaagctattctttatataaatttataatgtagttacacaccacttatatcctacttacacgccacttacacatgtaattactatataattttgagacttacatatgtatttttgaaacttacattataaatacactaaatttacatatgtaatttatggacttacaatgtaaataaatgctgactattttttaataaaaaatatggtgctataaatatagctattccctttattatatatgtaagttacttttatcatatatataagttacttttagatttgactaaattacttctattcattcataatgcttttagttgattatttttattattgtttttagttaattctatattttgtggactttataaatcttatctacactttacttgcgaatttactctacatagttcttatttcagctcactcacaatataattatttctactacagagagttactccccccgttttataatgtaagtcattttagcattgtccacattcatatagatgttaatgaatctagatatagttctaaattaaagttactttccttttgttataagttacttctataatatatgtaaattacttttaagctttactgatcttaacttagtgaaatctagaagtaatttagacatatcataaaagtaatttatgatttttcaatgtaatatcttgttgtaaagatttaattgttacgaacacaacggtgtaatcggattataaatcggatgagtaatttaagagaaacttctctaagaagaaaaaaatacatagatatttagggtactagtagctttttttttttggaaagaagggtatctctctttagcagtatccagctacatgttaacccgtactacacacatcgtagataagttcgctggtgggagtgggtggcattggaatatatagaaacacaccggcatatttccctctaaagtagattagccaaaccaatgtctctgcccgggcaaattggctgggctagctactgccagtcttgtcagggcatctctttagcttagacttgccataccaacaaagctagatagttgctgctacaactagcaataaaaacggagcggatagtttccgtccactctagataaaaacggatacgtatacctttcagatcggataattcttggatagttcggatatgtatatgaatacggtattttctcccgaatacaaatatggatatggtatcgaggttttcatcggatacggataataattcggatattcggtgaatagtgttattcgggtatccgcagaagccttgaggtataccccatttctttctaactctataaccttcaatatacctttataaattttaatagtagtttatctcttaacacaagaccatactattaatattgtttaaattttaaaaaatatttataaattatatttcattttatataaaatgagctaattatatatgttgatatttgtttctattagaagttgagttggttttcgtgttccgaaaaaaaattgttttcgtatttgtgtccgatcatattcgattcttattcgtattcaatataatccgtatttgtttccgtattcaagctatccgtattcgttttcgtatctggtaaaaaatatgaaagcgaatatggtatgagcattatccgtctgtatccgctccgttttcatccctagctaaaacagcacctggccagcaaagctaattgatatggtgtggcaaaaagggcccttctgtagcgttcttttgtctttacagagcaaagccacaactctgtttgtgatttttaacaaggcagaagttgggcacgggacgccaccagagtcacactagcaatcactacttgaattaacagaccggtagcaagggcacggtcagagcagaggaatcacgctggtccggccgatctccatcgttttcgaggataacttttcactgtgctaaaagtttcttttttttttttttgtccttcaacctttcacccctgggttagtttttactatacaatcctacatttataatggtatttcattaccaccaatagatatgatgtattgatttacgatgctcttactttatttcacaatttctgtcacttcattctactatcagtaattacataaaagcttttcgtaagtgacatgacaaatgtaagttgttgttgctttaattagatggcgaggggtcctaatagatatgccagttctgcaaatgtcgtataactgtccaatgccaaattgcttatctgtattataaatgaccatttttccacgacatgatccattggaggtggtcaactacaagtccttgcatacccataaaaaataaaatatggcaaaggtttttgaaaaccacaaattcacatatttctagcactatacttggatataaaaaattgacacgatacaattatctttgatattaactttcataagcaacaaacatatatttatgatcaaaattacagagaatatgttgcctcaaactcactgatggcaccaattgtttaacatagagtacgaaagaaatgcagcatgtgtgtacatatctggaaacaaaatgcatcacatcctgttcacttagagcaaaatggtattgtataatgtatttgtcggtgtctactcctaccgcgcgtgcacactcgatcaacttggaaacactgaaagcaaaagatcgaacacctcacagagctaacacacacgaacagaggttattggcgctgcttgataagccacagattatcttgtttctctaaatttattcatagcaagaacatgtaaacgcgcagcgactggactcctaaaatggagaacacgatcagacgtgcgcttagcacgacgcaaggacacgaccacacgatcacacataaacagagaaattgctaaagactctgcaaaataatgagctatgctatgtacaacgatacaaccatggggttaactaacagtattctcgggcacataaggaacaaacaacaaatatcagtatagaggggcaatacagggagagagaattttacgaggacaaacaaaataagctataaactcctaggagcaaataaagagtttactcgttaagttttttttattgtactactttttcatgaatagttatatacattattttgttactgacaatactgcagccatcgactctggggctgtttagaacccaccccaaaattttaaaccctgtcacatagaacgtttgaatacctgcataaagtattaaatgtaggctaaaaaatgactaattacacagatatatatggattcttttttcacttctgtaacaagtaccctacacataacatgcaagaagattttattttgagaatgagcggcatctgaaaagaagcacatcgcagcatgcactagcgttgcgaccatcctgcaactctgagaggtttgggacaccttgctcattgacaatcggccatggacagtctaaattgtgatcgaggtcaaatccaagcaagagggagcggggctgcacgtatctgtgctaccaacctgtccaatgctcttgccccaaatttggcctattccacagcagagggtagcatttcgcaccctaattaaggtgagacatgaatcccatacaaagctagtggcacgccaagttcagatttgtgcagacacgagttttgccagataattcacgtagtccctctctggatttgggccaagacttcggccgggggttcctttcgtacatggagttttacatgttatttttatgacttgtggtttgattcctgccaattcctttaagtcctaaatataaatcatactgtggaggaattatatccaacaaagaatggctgatttctttcatcgaaaagcgaattattttcaacaatcatatcaacattcaacaattcacgtattactttctaagagtgaacccaccactaggagagagattatttctgattgtagcaaccaagatgaagaaaactccactgaaatttgcttcaagtacagactaactattatgcgagttacgttaggcatgtgtaagttcagtgattgataaatagcaaaaatctagaacagtgataaataatctaccctataattgaacaaatggttttacttatttactcattcatcatgtcacacatctaacggtgtaaaatcatcttatgagctagatcgaacgtgccagatgcacacgcgtgtcgctcctaatgccgcaatcacgggctcaccgcgcctcctccgcatcggcctctctcgagcagcacctcgcgcgcccctctcccgcaaccgccggacaccctcattggctccacaaatcacactgccatcgcggcgtcgccgtcccgctgctcgcacccctccgcccatcgcgccgaaccgcgccggagtcgccctccccagccctcagcgcatctcaccgatccacgccgccaggccagagtcgccgtctccgcccctgatctacgcctgggcgctcgcctccgcgcccccagatcatcttcggtcggagtcgccgggcttgtcgccaagccaatcccctccgccaccgataggaggtacagaaacctctgtccacccctgcctggcctctgtcaccgactctgccgtgtgggctctctgctcgcgcgtgctcctccacacatcccagcaccccgccgcggctcttgcccccgtcgcgtcggcgcactcctccggttattcccctccgccaccactgcctcctccgtcgggcctgacctctccgacgtgttgaggcactacataaggtgtccgatttgcttcctttttcatgtttgctatggttatctagatgctaattttgcagtagacatggggttgagctcacctctgttggcacggtatataagtcaatggaatgtccaatgacttatgaatcttcacttgtaattctggattgctttgggttttgggacttgcatttgccaaccaatgcataaatgcttcttccagcgttaaaatcagaccttagatgcaaatccactgtatccatactatcgagtacattatggttgcctataacccaatttggttcaccgatatatttctcaatgtcaatcctgtttgcatttttgggttcagcactctgtacttttcagttttcactactgctcgatggaaagaagccttcaactgcctgttagctgttagtttttacattctacggtgcaaggatccttggacacttaattagagcagcgtaaagaaattggattttgaagttcttttttgtgatgacaaatactaacatcttctctgaacttttgatttttgtattgcccttaatacaggcaggtaaaaaaacaaggagaagaactagcttttgtatagatatgttcatcacaattagctaacacatctgttaatcaaaatattttaactcttgccggtttaaccttacctcttgcatggagtccatggcataattcacatgattctaatatgtttgattcgaaaccatggcatggtgatttcagatatcaaagaaaactttaccatgttcatcgcttgctttgattccaatatgtttgattcaaaactgtggcatggcgatttcagacatcaaagtaaactttaccatgttatatccagctctggaatgacctgtgttcttatctcaaacagaagcataatatgtcgttacagctcagacctatatactatggttcatcggcagtgactcaatgtcatggatgtgaaaattgagaaagcttgacacgtgcttacaagaagaagatcccagttaaataagacattaccattgatctccggtgggcattttgtagaattgtgtccttactactatgatttgtaatgatgaagcgtgtacgatttgaaattaacttgttataaataagataaatgaggcgcaaaaagcaaggttgttttttctgcagaagccatttcaaaaggacttggattctgcagaaggacaatttgttgcccaacttagggagttatctgaggaaaaccagctctacagaattgattgctatctttttttttagtgcaagctaagaaaatggcttacacccaggtaagaactacaactaatatttgagctgattcttttttgttggtactcatgggggtaagtggataatatggacttcaggctcactatggtttggcatttttcaacacgagcaatttggaaaggattttatcagcatattttttattcaatccaatatatgttgttgatatatagttggagaagcatcgaatgactgatcatgaactgtaggaggtactaaaatggccttagaagaatagtttgttgtgccactgccatccaattttttatcatgagctgtaggaggtatactaaaatagccttagaagaatagtttgttgtgccactgccatccaattttttttttaccatgacaaattttagatatccgtacagatttaataaaggcatgcttcatgaacctgcactggaagcaattgtagcgcacaaacgaaagtgcttgttcaagaaaactaatttcatattctctatgtgggttctgccgatatgtgtgccgaaaccatgataagatggcaaaataaaggtggcaagaaatgaagtatgaactaaaaatttgaacttggattcctatatgcagtaacgcttcttcaagcagaacttctaggggaggctcttagatctaccgtatgttcctactgcaaatgggggagcaaagagatgaagcaccggcaaagctagctttgatttattattgtttattgagccgctttgtgaagtagctccttgcgttctaattgtgcttatgcccttcacaaattccatgataaggaaaatctcagtttcatgtaatttggcacatgtgcgtggatatagctaaaactgatgatttagatgacaaatcaagatgtattatggtaaacctttttgtgaagtttgttttccttgagtaaataggaaactttttttaaaatttgatgtatgttgttttgaaatttaagtcagaaatgtaattcaagtctgactccatttgcactaagaatatatgctcttaatcatcttattcttttacatcttgaatataattatttttctaatatgtatttgtacataatgtgcgttgcacgtgcatggttagtataatttttgtaattattttatctcattctatgcttgacaaaacatatatcttattttcgttgtttgatttgtattaccaaatatttccgttgcgttagcacgggcagaatactagttaatattagttgaaaagaaagaaaacatttgctgaggcatgaaatagacagataatctccttatttagattccattcaagcctcgttattattagtattagtgttgacaaccaaattatgcaatacaacaaattataacaatgtttagccagatttggaaaggacctcagcatactatcatgggtcggtcagacggtaggtatacgatcgtttagaccggcggccctcaatccgagtacgattaaggcagtttgtacgtttctttgcttgggcatgaggtttcttgagttctaattgatctataaacttaataggacatagagaaatatgcctatggaagaaagaccaatccctttatacgagctatgcctggttcgattctaacccctaaccacaatcccagctacacaatcgaatcgttattttgccttcaccattacttttaagtcatgtttctaccttatcttcaacctagcattagtctgcctatctttatcgatttgcaccacaaatcatccaccttgccacaaatcattcgccttagctacgagcagtgttgcattggggctgggtctgctattttgattttttatactcggttttataccaggagggatgggtctcactgcacagaatgggtgggaggggaggacaaaggaaactctgcttttccatccaatcggtactttgttggctggtccttgattggcgtgtacaattattttgtatctatagctacgagagtctgctaccgtttgtatatatgtttgccccgtaaatcttccgattacctacgaggcaggtggttatttccgtatcgatctaaatcagcctagagactagttttatgtctaaatcggttccgctagccggtttaatctgttaaacccatcttggtttagagttttctagattaagatgattggcgactctattaacacagtaaatctttaggtgagtccgtgttattagctagaaaggatgccaaccgttagtctattactttcttgaattaaaaggaaggcgctactcccttgattcatttatatatagtgtattttaatttaaaaagtgccccttaaaagattttcaccagtgattagtttgaatacaagtatgtgtaagattttcaccagtgattagtttgaatacaagtatgtgtattgcacaaaagttatacggttaaatttagtactttcacacaatgtaggttttagtgtttttatatggagatttactccggtccttatggtaccaaatcgttagatcaaactatcggaaacgatttggtactgtgaggtataccggtacctcggctcgagatacttttatatgtattaggaatgtactttaatttgtgaaaaaatagtggtcaaattttagttttcaaaactttcttaaaaaataaaatacgccatataaaagtaaacagaggaaatacttattaccaccacgacttaccatgcattgattcttgtatgctgtctcttgtaatatttataagctgcctggactgattttcctttctgtgcacgtccggtttgtcttactacctcatgatcttcatccatacctggaaaccaactatcacgtcatccaaagtaaagcaaggatatgcttagcttccaatcccccgtctgtgagtgaatctatcttccaaatgaaacaatgcatgctttgtatgtggcattgttcgccccgttcttttcttcaacaagagttatattaagattaagattttcgtagcacgtttttcaaactactaaacggtatgttttgtgcgaaaattttctatattaaagttgctctaaaatatcatattaatctatttttcaagtttgcaataattaaaactcaaccaatcatacgttaatatcacattgttttgcgtaaaaaacttaatctttatcttcatcttcagaagaaaaagaaaaagaacaccaagaatggttggcattggaaaacaaatacactgcacattcagaatctctcttactgttgtccagtcagcgtcggaggtatgggccgatgaccctgcgctgcaggccgtatgtcacccatatttttgggttctcgtatggaatctgcggtcagtagttgatttccgtggcctgggcttatgtaggaaagaagtagtagactgagctagaacctacgggcatgtgtaggacctagcagaggttccctgcagtttggaccgtcggccgtcttctatatctgtagcttgagatatgtatcgccgtgttcagttccaaaatatttcactaaacttttaactttttcatcacatcaaaattttttcacacatataaatttttaactttttcgtcacatcgttttaatttcaattaaacttctaattttggcgtgaacaaaacacagcctatgtatgtggctaggacaagagcgctagttgttgtcactacatgtcacgttaatttagaaaacaaaaaaaaattgggaatggaccgcatgtcatgtgtgatagtatctcattttacgtggttcatattgtggatttgttcaccatcctcattggaaacgattgttattcagatgagtttagattagtttccatgtggatgcatcactttaaatcttatatcttatagtttctaaatatgtagttctctgatcgataatagacaacctcaaaactgtagttttacgtacaacagtttgatatatgtagttgagtaaaatacacggccggtccctaaatttgtgtggtgttgtcacttagatccgtgaacttgaaaattgcacgtttaggttcataaacttggtttaatataccaccccggtccaaacgtcctttgattgcgtttgaccgccaacgtggcatgccacgtagataacacttttgctctcagcccctccgtatcacaacacgtcgcaaatatctccttgtagctatgtactgacaccagaataaaaaaaaatcctcaaattgttcttccatcttatttttctccttgcatgtatagagactgtggtcccaattatcaattgccattgctctgcgctccaaaatgaccttatccttgcacaacgggcacttgatcaacaacacctttttccggtgacttcaagatggggacgagcttggagaatccatggggatgcctagcgtgcaagacgcattgtgctgccttccgctgctaatccgaccgcactgtgccactgctaaccccgctgcaatgcgctgcctcctgttgctaatctcattgccgaggccgccacaaccgctacctctcggcctccttccgctaacctcactgtcgaaacactagccgatctaggaatattttggaggatttgggttgaaatacactggtcaagacaagttatgtgtgaaggtatatgtggagctgtggagggggctgcgcacaaaaatgttgccaacgtggcatgccacgttgacggtcaaatgtggtcaaaggatgataggaccggggtgcaggtacattaaactaagttcacataccaaaacatgcaattttcaagttcgcggacctaagtgacaccacaccacaagtttaaggaccggtcatgtatttcactctacgtagttttactaaatttacacatgtttgatttttcttcctctgtccaaaggttagttttgagtgatgtaccttctttatttacttccgaactgactttctatttaaaacatcttgtgacaaccaccaacccctattattatacttgtatatattattcatttttctcactttcccacctatatatactgatcgatcacagtgcaaggcctgcttcctctttccatttatctgccaaatgaaataattaaccactgctatctcttcattttattcaatttaattcctaacatgcacactacacagatcatgcaagagttttttatcttgggagtgggtggcattagggtcttgcatattgatgtgtatgttgctacaaccaacattacagtcattatgcgcgccaaaccggtgcggtcgcccagggccctgggcacatcggcagcaggccaagctaggcagcattgcattttcgtcgagttcaatggaggctacacggagtattggaggctcagaacactggtggagaaaccctttttcctcttggttcgtaaccccctttagtcccggttatccaaccgggactacgaatccgggactaaagacaccaaccgggactaaagatcgatctactaattttttttatttgcatggccctgttcgttgctgcatggttaattttatatatatatatatatatatatatatatatatatatgtattccatatatatatatatatatatacatatgtatatgtataaatacatatattataaattacacatgtataatttaaagcacttaacattttatgtgcatatatattaccaaaatatatatttacactaaagtaaatgtgtacatctataaacatatacatgcatgtatagtacaattcatttgctcgctagctagctagctatgacttcgacgccggcgttatgtcagaagaagaaggaccgatgttatgaattgtcgatccgtcgtagtagaattcacccttgggattatggacttcttcgttgatgaatcccatcagttgttcttgaacagccgtgataaaatccttgtgtgggagattgtctcttatgtgaatacgctatcattcgaaaaataatgacatatcaatatatgaaattaataaagagcaaatcgatacacaatgaaattttgaatggtttatatatacgtacatcgagctctcgtgtggtgtagatttgggttgataggcagtgggcatactcgcatacgtagtagctgcacaagttagttccttggtcctgctttgcacactacatgagaaacgacgagagatttaatataatatacacttatattaattgtaattagagattcaattcaatataattttggagcatgcatgtacttactggaaaattaaacctccgtccaagtttttctttccaagtcccgcggaccaattgacggaaccgatcccaagccctacatgcagtttcaagctatgattaattattatccgagatccgcataatagcaacaggaaaaatccccgtgacttagcaatagatggcattatattacctgtctatcagttgaaaaaacttgtcaaaagtcttgtcctctttattcattgagtcatacacattgactttgcatgcgtccaagtcgaaaagtaacaggacccagtggaatctgcaatatgcgagagatgatatatgaaaatgtacatgttatatgtatgggaaagaaatttgttcgaacgacagtaaaaactcactctgtgttgtacggcagtagtatgaatgtcttgaaatgctgctgcgtcaggagatggacgagattgtcctctgtgtctttctcatacttgtcgatcatttcgacgttgattttccgacggtcgatgaacccagtatcgtacaccccccaccatcaggccctttgaatctccattctacaatgataaaaggaaattattattgtttacatatatgcaaggagctaattattgaacgaaacaaattaatcgaactcaacgatacttacaaaatccatgcgctcagaagagagacgtcgagggcgtccagatggtatagttcgaagacatccttgaattcgatccagagaacatcttctctttgcaagaagtcggagtttctgatccttgctctttaacatctctctacccttggcgctcatttccatgtaccgttcatggaacttgtacatctatatcggtagggactgaagctgctcaggcgtgacaagcggtttaccgagttcaaacttgtatgccacttctgccttcaggattggtgcgcctctaatcaactgatccacagttagaccagtgtcagaaatgaattatgttatgccaatttcttcgccggtcaccaatggctcgagctcttggtttggttgttctccaagctgagggactggtttggacttcttgtaataggctttctcaagtgttcggtaatagtccaatagctttaaggcctccttgtttgttgtggacattttaatgaacaagttcttcacgcttgggtcaacaggtatcttcttttcaggtctccgaggcttgagttgcctcttcactttggaagccacgtaagcgtcaagctcctcttgactgcaatcgtgaggcggctccttgtttttggtggcgtcaactttcgccttcttcgttgcccttgtgtgggcaggtggtggagcttggtgagaccttgtcttgggaggtgtaggcggacacgatggaggcgaaggaggcggaggagccggaggtgatggtgcaggaggaggtggcggaggagatggcggagccggaggtgatggtgcaggagacgctgcttgttgcctaggaaggatgatgtagcgcttgcgccatagtataatggtgtggcttgtgtctcgtagatgcgtctcaccgtctcctctagggtagtccaactcgaggtcctcgtacgctcttcctgacgacgggaaaatcgggacggtcgtagcactaggtccgttatccgcaaatcgttagagacaatttaatttaaatacaataaataaataaaaatcagaaattgttagtccattacttccagaattcatacatttacatagaaattctgttaattacatctccgtagagaaaacccctgattaggaattccaacataaaagaaaataaaattacatgaccgctaaaaggctaaaaaggaaaatctatcctaaagctccagatgtcgcagccgtagaatcttctgtagattttcatttatatgtttcattttgggcgtccaattattttagatgcccactaatttgttggtttttgatatcactgcgtgtatggtggcagatttgcatatagcttaccttttttggcattgtgacggtaccttttttttatatgtagcacgcatatataaattgataaattttcttgagcactcgcggggcgtagccaaacgagtatttattttagtgccattattatcaacgtgtcatgggattttgatgcggcgcattgcattgcctattttaattttcaccacacctgtattactactagcatggccctgtaccatgaagcataaccgaagtgggcatttgtttgatttatggtcgactatcacgatgtcaccacttgttgtgcgtacatggattaatttgcaattggaaggaaaatgcacggccagagtatatggatgcatgcatgtgcgaacatcagattattttttatactgcactttatatatggtgcagcgagtatacactgttttaagcaaatatatgtatgcagatgattttgagattataattttcactccacttgtattactactagtatggctcgaagccgtgaagcgtaaccgaagcgagtgttggttaattttatagccggctgtcatgactcagcgtagttcgtgatttatccatcattttgtagataaacagatggaaggagaaaatatatgcatccgtacatctatttcctatctctgaccatggaaagaaaataaacgccattttattttaattcttgttagggaaatatggctgaacatatgtcaaaactagcaaatatgcgtgctaattaattagtatgttcaattaatttgtttatcactatgcctgtatcactactagcacggctcgaagtcatggagcatgaccgaagcgagtgcttatttaatttatggtgaagtatgcaaaatttatgtttagtttatgaaagtgctcaggggaattaaacgaatgcaaccatgcatctatttcttgttcctgatcatggaaaagtgaatggcgccctattttaatttaaagaaatatggccgaacacatgtcagaattagcaaatatgcatgctaattaatatgctcaattgattttatgcatcactattcctgtatcactactaacacggctcgaagccgtgagcgtgaccgaagcaagtgcttgtttaatttatggtgaattatgcaaaatttatgtttatatctgtgatttgtatccgctcgtagaggaccgaacctgagagcaagaatctcgcctaggcttgtatgcgctaacgggaccaaaacaaagggtatggtagaatgacatgaaaagagtatgcatgaaaaccactcctaggcccgtactcatctggccggaccataggaaaaagtgtgaaatcatgttaaaagccatcaaatgaaacgaacttccttgtctcatacgcattggctaagacgaaggacacaacaaagagaaaaaatttctttggttgtactcatgatggccaagcctaggaacatggcaagaacataattccttggttcgtactcattggccgaaccgaaggacacagcaaaagaatacattaacacgagcagagaaaggagaattgagagattcctcgactcgtacacaatggccgagcctaagaattaggaaggagcatgattcccaccttgcagcactcgtgttcttccagcgccgcaaagcgaatttcctggtgaagcagaagaactagtgctagcaaatttgccgtagcagactaacagcacttgggcgtagcgaactagcaatctcacagcctcaccaacctttctggaacctctcccccgcgaactctgcctctagccttgatcctctatttatagaggaggattagaaggggttaatttgctttatgtgattttgaacaggatcccgcgcgcccgcagagagatcgtggggtgtggttgtgggcaatggcttgactgcatgcacatccctttggctgacatgtgggcccgttcagtttgacgggacgaatgtgctggtatttgctgcatgcttgcatgattagtggtgatcgtgggtaggctaagggcttgaccacttgtctctttgctttcactgccgtgtgggccctttggacttgactgatttgttttctttagatttcagttgttagtaaatacatgcgtgtctctttttttatttcaaattttattttattattattttttttgcatgcatgactattctgtatgtcctatatttttactgcatatactcccatttaattgggcacctcaatttatttacttttatacacaccttggatatgagtcttttctttttttaaagaggcacacatatatattctagtgcaccattttctatcgagtggactgtcgctgccgcaaatttattttatacgacactcatcgcgtcctgacgtgcatattatcacggtggcttcctcgagccaacatctagacgtcgagataaaaatattggataatgtcatacacgaccccccctttaattgggcgcacatgtaacatgcatttttattgtaagtcgcgactatttggagtataattttttcactagctagctaaacatctattttggcttacattttaatttttttttgctattttatatggtgggtacgccttttctgaaaatattcggggcgtgactatttcgggtcagtgagaaaatcccacttcatggccatatgttttaggccaaatttcgtatgcggatatgatgagaaagctaagtattagcgttcgccggtccgacgaaaagcgcatgaaaaatatttgttcacgctacttatatggaacgcgcatatgcattcctattttaagccgaaaattattttagtccaatataagtgaattatattttatttcctggccatttattttgtggccgcaatttaattaaattacttcaccatctgtctcccaataaaattcttatttattattatatattttttgtaagcactatatttgagataatatattagtttataatttaacaaattatatttaggacacaagccaaaatccatgtcaacacttccaccaactcaacttcgactgctggaatcggcctgcagtggtaagtccctaaagggtccattgggatggccattcacgacgccaccttcacgtgatgagaggttggacgttagtaatcaacgtaagcaacaactggcggaatgtacatgtcaaaaatcataaaactacaagcataccttgattgataatttcttaaagggaatatgcagctcacatggtgtccgctgcgtgatttcatcgacggggcaagtggtttggtcctgagtttgcatggcgtccatgctctatgatcctacctgcctcgttgaggtgcagctgctacgattgcctgaggggctgactattacatgaggaatgtacagctggggatcctagcaccgatgtgcggccatgtgttcatccaccttccttgccacctcctcctgcatgcttagctcgtaactcgataccctgtacttaagatctgcaatcttcacctcagtatctctcttgttcctcatccgactcctgtacgtgtggatgtcctccttgaatccaatcttccaaggaaccacgcctttccctcgtgttcgtcttggatgctcgggagtctgcagggcgagtgacagctcatccttctctctatcgagtcggaacgtgccctgagaagatgcttccactgcgtctgttagtcgactggcagcttcgcgtatctgatcgctgaacgccagggagccatcaacggggttaagcgttccaccatgagcatagtaccagaacttcgatcgatccggctatttagtggtggccggttcgatacccctctcaatcaagctggcttccatctcctcccacttcggcatcgcgacgctataccggcctgaccccaggtggtgatggtactttttctttgcagcattttctttgtttcggtccatcatcgcttgcccttgttgccctgtcttgtaagcaacaaactcgtcccagtgatcccttagcttcgggaatgtgttgaagttcggtgtcagccccttcaggatgtatttcttgtagagttcttccttgaagcactagaactgttctaccattttcttaagagtccactgtttcactatgttctccgtacccgcagggagtgtgaacgtctcgagcattgtggtccacaacatctctttctctgattccgggacaaagctgtcataatccccacgtgcccttgttctaagccagtacaccttgctgataggcacgttatccctcacaacccaaccgctgtgtcgtacgtaattcttggctgcttctgctggggcactaggtcggccgtcttcgtccacttcagttttaatgtgccgaccctctatcttctttgcggcacctcgttgtctgcgtcccctcttctgtgcagacgagggttcatttccactagcctcctccccgttcccctcctcgttcccctctacgttcccctcctcattcccctcctccacgttcccctcctcattaacttcctcgttcaagtattggtttggatcctcgttcccctcttcttcgttccagtactggctgcttccctctgcgattgtatcatacagtatctgttcgttatcgcgatcagccatctgttcatacaagaaatatttccatatataatattaaatctctagtaatcatatgctaactctagtaatcatatattaaaactctaataatcttatattaaaactataataatctcatatggtaactctaaataatcatattctagctctaataatcatatatgaaaactctaataatcatatgctaactctaacaatcatattatatctctagtaatcatatgctaactctagtaatcatatattacatcacttgcatgcgcaaattcctctgagggctagctaccatttagtcttgagagacgacgacgacctcttttctgcaacatgcaaaaaaaatgtattagtctaaatgcaaaggaacatactttgattagtgcaagatagattaaactaggtcggaggggagtagaagtttaggttcatggattcattcgcgttcgttcccgtttgttcgcgttcgttcacgttcgttcacgttcgttcccgttcgtttacgtttcgttcacatttagttcacgttcgttcggcgttcgttcgtgttcggtcccgtttcgttcacgttcgttcgcgttcgttcccatttcgttcacgttcgttcgcgttcgttcccgtttcattcccgttcgttcccgttcgttcgcgtttcgttcacgttcgttcgcgacggcgtgggcaaaggtagtagcggcttcggcctcggcaaaggcggcggcggcggcgacagcgagacgacggcggtggcgtggcgcggcggcggtggcataggcgtcgtgcggcggcggcggcggtggcggcgtggctgtcggtagtggcggcggcatcgtggcgcagcggcggtggcgtggcctcggtcaactccaaccttgttaaggtcaaccgttgtcatcccactgtcatcaatcgttacgcctccaccagtcagcctaacccattggcaccgaaacagagggaccttgagaggtccatagtcaagttcccatatgtcctcgatggcaccgtaatacgtgctagttgtaccatcgtgtcccatatcatctatacgaacaacactattctggttcgtgctcttcatatcttaggctctcgtgtagaatgtgtacccattgatctcatatccctggaatgtcgcgatcgagctagatggtcccctcgccaggaaggccagttgttggttaatcgtctcgttacccatgagaagtcgcagccacgcggggaaagtatcaatgtgatgccgtgtaatccatgcatcggacttaccgatgtttctggcgcgaactagagccaagttctcctcgatgtaaggagccaccaatgaagattgttgcagaaccgtgaaatgggctttatggaataaattgttgtctaccatcattattgctttccttccgagagtcccttttccccgtagtctcccttcatagcgtgattcgggcaccccaattgggcgaaggtcttcaataaattctacgcagaattcaatgacctcctctgttccataccccttggcgatgcttgcctctggacgagcacggttatgaacatacttcttcagagcgcccatgtacctctcgaaaggaaacatgttatgtaggtacacaggaacgagaaagcagatgcgtcattatattgaaaaataaaggtggaaatatcaactcaaagctaacaagacattgcaccatatcattttgaaggtgttctaatttatctggatcgatgaccttctgcgaaattgcgttcatgaaagcacagagctttgttattgttgcccgaacattgtctggaaggataccccgaattataactggtagcagctgtgtcatcaacacgtgacagtcatgagactttaggtttgtgaacttcttctccttcgtgcttattattcgctttatattcgtgaagtatccagacggaaccttgatgctctccaagcattcgaacatactttccttctctgccttgctaagagtgtagctggctggactcaagtaatggctacctttctcctttggttcagggtgaagatcgctgtgttgttccatatgcttcagatcattacgtgattccagtgtatctttctactttccatatacacctaggaagccaagcaggtttacgcaaaggttcttagtgaggtgcatcacgtcgattgcgtggcggacgtccaagaattcccaatagggtaactcccaaaaaatagagttctttttccacatcgccgtgtgaccatcttcgctctcaataggctggctgccaggcccctttccaaacattactttaagatctttcaccatagcaaacactgttttcctgctgcaatgtttaggcttcgtacggtggtccgccttatgttcgaagtgcttgcttttcttccgtacaggatggtttgcagcaaggaatcaatgatgacctatgtacacaaccttcctgaaatgcttaagatacgtaccttcagtttcatccatacagtgagtgcaagccttgtaccccttgttagactgcccagataggttgttaagtgcaggtcaatcgttgatggttatgaacagcagcgctcgtaggttaaactcctcctatttgtcctcgtcccacacggggacaccttctttcttacacaacagttacagatcttcgaccagtggtcttaataaatatcgatgtcgttaccaggttgcttggggccttgaataataatcggcatcattatgtacttcctcttcatgcatagccaagggggaaggttgtagatacacatcgtaacgggccaagtgctatggctgctgctcatctctccaaaaggattcatgctatccgtacttaaaccaaaccgtatgtttcgtgcgtcctttccaaagtctttaaatgttctgtcgatgtttcgccactgcgaaccatcggcagggtgtctcagcatcccgtcctgttgacgttcttcagcgtgccaacgcatcattctagcattccccttgttcctgaacaaacgccttagccgcggtcctccttggcgtcctgcaacatctaaccaagatcatccgtagcgtcgttatcgtcagcatccctgtccacctcgcccgtttgatttccttcaaatccagcgtactgagcccagtccggaatgttctcgtcttccacttcatcttcttccatttcaacccctttctcaccgtggaatgtctaacaattatagcttggcatgaaccccgactcaaacaagtggaaatgaatagtcctggatgcataatactccttctggttcttacacatattgcatggacgacaaataaaacccttatgcttattagcttcggccactctcaaaaaataatgcacgccatcaataaactctttcgaccgccggtcagcgtacatccattgccgatccatctacatgaaatgaaaaaaaatcatacataaataaatattcgtacaataatgaaagtggtacaataatgataaaataattaaaaactctttcaacggttatacaataatgacgtatcattattcatacaataattataacataatccaacaaacaattcttatttattttttttgaagttttaaactaatattaatgttgtgcttcttttaattttcaatttagtttcttttctattatttaagattaattttcattatattttaaactatgagaataaaactttttaagtaaacaaacaaaattcctatatattcttcttcccacacaaattttctctctcatcaacttacaacaaagttttggcgataaaaaaaattgtgaaacatagctccaaaagtaatataacaacaaaaaacattggagaacaagttactaaccttttagacacctctgatttgtatataatcaccaaaaagatttcacaagaaattttggcatgacctcccctcttttttggagaaattttgaagcttgctcgggctggaggaggaagaaaac

SEQ ID NO: 63850 - DNA, 1292 bp, Oryza sativa
caatcgagtcacgtcgccgccatggattcgcaatcgagctgttccgaggaagaagacgaacaacaacagctgctcgtcttgatttccggaatcgcgcgtacctgtgctcttcctccgtccatgggatgcccttgcgcctctcctgctccgccttggagcagctcttgccgccgtcgtacccgccgccgccgcccttgcgctcgtcgcgccggtgtccgccgtccttggacgcggcggcggcggctccggctccgtcgggcggcgccgcggactcctccccggcgtagcgcgggagcgggacgcggcccgcgtcgatggccgcgacgtcctccaccagcgcctcgtagtgcctccgcacctcctccgccgacctcgccccgggcacgctcgcggcgagcgcggcgaaccagtcgtcgtcgggcgcgcctccgtccgcgggcggcggcgccgcgcacgccgcgagcgcgttctcgaacgccttgtcgtcctccctggtccacgccgccgccgccgccgccgtggtcgtcgtcgtcgccgcctgggaggtcatcgggtggtggatctcgcactctcgcctcctcctccctgggccggcgcgcggcggtgagacgtgcggcggccggcgacggcggcggcgtacgataagtatagtaattaagaatggcgggagggagccttatccacaagagtggtagggcgcaaacgaaacgatatatgtactggtggttagtattggttttgcggctggatttagtcgtaatcctgtaaattttgaggccatcattttgtttttctctctacctcctcggttttgctgcacagggaatggtacttctaatttttaaaatatttggacaatttttttttaaaaaagttgacttggtaatttaggcgctatttttcgtgcgtgaacgaggtcccaacctgggaagtgacacatcttactgtgatcaagaggtgacttgattaaccaattcgtcaatgcgctagtgaaactacaaaagcagatgcgatattaattgaaaaaaaaatgtctcgaaatgtccaaaaaaaatgtcaacatttgaaatttatagtttttgaggtgttacgaaacaactccatttgaagatataaaatgctctggttcgtagctagaataattatattttagttttttttaaagatttttagtcaggaatcgacgtcatatttactacttataaaaaataatcagatagtttttacaccataaattacttatacttacattgtaattatacattggattatattggaaggtttagtattca

SEQ ID NO: 63851 - DNA, 584 bp, Oryza sativa
tgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtagtcctacacttccagttgtaagaaggattcaaactaaagaaaaaccacccttccatttgtattcatgctttaaaattgtaaaattttatcttatattcttttctttttaccaatgctttcatacagtttggggatagacggtggagatgagacgaacatgggttgggagacgccgcagcaatgtggtggtggcggtgcgtgtggcagccgccgagggtagtggccacggag

SEQ ID NO: 63852 - DNA, 1891 bp, Oryza sativa
tgtctctactagctgtgtacgttgtcctactatacggccagtccatgaatatatcctgctttcagatttgatagatacttccccgcaaaaaaaaaaagatactgtatagctatgcatgtcatgaccggattgtgaatattgaacatatatcatgcaatacgttttattattttgatctatcactcgaagagctttcgtacgtgttatcgtgtctgaaagtctctgcggcaacatttaattaattggcattttaaatttcgccgtaacatatctctggcggcggcagcagccccatcttccccaaccatggcagcagcccccacgccctgaacctgccaaagtgtccactcccatcgtccacgacttggtttgtcctctgatcgatctctggatgatggggatgagtcgttcatctgtctgaagcaatttgcccatcagcgattcattcaacgatgcagaggaataatcccaatctttgctcttgcagtattcctcaaaattgggccatgtttccttcttttttttattagaggagtttcaatccgtggtggtgggttgtcgcttgtgattttttttttgacagattgcctttgctgcccttgatgcaaaactgctgaagattaaggcatctctttaatctgctgctgcaagctcgttatggtgttgcggttctatactgtcttcgttatggtgtcgcgcttctatactgtcttttttttttttctgaattctgcagctgttactgaggctgtgtttagatctaaagtttggatccaaacttcagtctttttctatcacatcaacctgtcatacaaatacaacttttcagtcacatcatctctaatttcaaccaaaatacaaactttacgctaaactaaacacagcctgaataatggtgctggcgctgaaagttgttgttgctgttgttcatgatgatgtgctgctcttgatgctgcagacctgctgctagttttggggtctgctgttgattgcttgttgcttgccatgcttatatcaaaggggatcacctatacatttgttgataaattttctccgaaaaatttaacagatgtaattatagtaccatcgtactgtaattacactgtaacttatatgtaattacactgtaacttgcatgtaactacagtataacttgtatgtaactttcacgtaattttgaatcattagatctattacaagatttgttctagtgatgaacaaaaagatcacagcacacacatatatgaaatgatttattctcacgacctcgattttaccgaaataacatgttacggagagatttttgaaagttacatacaagttatattatggttacagtgtaattacatgcgagttacaatgtaattacactgcgattatactgtaattacatctgtcaaatttttgggagaaaatttgtcgacaaatatatagcaaaattgtatctggttttgcggtttggaggcgattttgtatctcgatgataagttgagggaccttcggtgtactttttccgagagattgattcctctacaaaagtctatagaatatccttcagagctcatccccagcctcattcctctacctaaagtctgtattgtgtccctctacaacccagagccctctatggaagtccaaaatcacgtccttcccgagacaccctcctcatcggtttataaattctcccaaacttcagaaattgatatctttcgaaccgtagccccgattgactccattcaacttccagaattcctctaaaatcaggatctatcaaatggcacaattagttcatgatgattcgtactttatttggaggattttatatggttttctattattgaccgcgatattctggatatttatcgcatgtgggtattctaattatttaact

SEQ ID NO: 63853 - DNA, 666 bp, Oryza sativa
ccctcttagcttgtagcttcttaattacttatttgccacttttgcccatgtggcatgccaacgtggcagcgcggtgcaaaatatccgtgggacccactagcgaatacacaactgtcccctaacaccctgtgttagatcagaccagccgtccccttgattgacggagaacctcagttacctgacgggtggaaaagaattcttttcgagggagcagatgggacaaatacgctagcatacaacgggggaaaacccagaggcgaaagaaagatgcaaaggaaaactacctaacacacaagatgcactggacagttgaaaacaagcatagacctctataatgcaggagtaaacctacagatcaacaaacccgtgcgtcatctataacgcaagagagggtaactcctaatgcaagagaaacacctgcaggaaccggatgaggggcgaagtataacggatgacggaataatgagtgattgaaataccctttaaaaagagaagatatgttctagcgtggttaacaactccaagaggaatacgactctgatgagtaaaggagaccaaaaaacgatttctggagcaacaatggacagaaggaaatggcacttaaaaaacatcgttgtaacgtaacagggcctgctgttaaaaaagtcggaacaatcacagaataat

SEQ ID NO: 63854 - DNA, 1878 bp, Oryza sativa
gcatggataaaattagagctatcaatcatttcttaaagataaagaaaagctttttgttgaaatcaagacaattacatcaaaatgatacaaaagatcttgaaatcagttatgacctctacataactaatatacacaaaagaaaaagttttaagttgataaagacacgctaacatctatcatacttagactacatcatcacccatggtccagagtaaactactccttaaccacctgcttcaaatgttgaaacgtacatatatctgcaaataaaagttgtcaagccacagctagtgcataattaagtacataacctacaaagatatcaaccacacttgagcgatattttaagtactcgagaggtataaggtggtaccaaaattttttaatgtaaattttcgtacctcctactaacggaggtactatgagagctattaaattttatagtagaaaacgtggtatctcccggtaccttctcagagactgtaaaatcactcatcacttcaagtatattatgtgctcgtccatgaattcatggaaccgaggaaaatttatcttcaagtatattatatgctcgttcacgaattcatggaaccgaggaaaatttatcacctgtacttgggaagaaaaataaaaatgtcggtattaattgcttgtgtttcctgagtattattctttcatcttccgattcatatttgtaataagctcccaactatatatgaattacctacctagttcaaaattccttattcatccttgagttcccgttagattaattaattcctttcatacccggcgccccgagttaatttcactgtctgtgcctagctagtcttgcattttctggtggaataatctaagctaaattccaaagactacttgactatccggagactaattaattggctgatcactctcatgaaggagatgcgctgctggtgccttactactccagctaccgttctctatttatggcgtccaaaatcaattaaacagctcaccatcagcaactaattaaaacccatgagcctgccaattcgttcagattaacccagcatcacatatcccatcgatcgttgagtcatcacatatcgttgagcttcggtcgtcgatcaatcggccggcatcaatggcagtgctcaggaacgtcatcaccggcgttggccggcgtctggtgctcctcgtcctgacgctgttggtgttggcggcgctggatgatcaggcgccgcccatgatcatggcctccgctgccagggttttgctacaacaatatccaccgacttatgggcctccgcgctgttatccgccgtactgtgcaccgcgtcacgctcgccgatgatgtagttagttatatctgtcttaaaaaaattaacttccctgaatgaatctggataaaatatttgtctgatccattcctttttcttggacggaaggattatgcgtaagagttgtgatgagtactcctatttatttgattagtaatgtttgtgttaatttcttccataaactacaatatattgtacacctagagaaggcttctgctcctgttgctcctcctgcctggacagagctgtataatattgcttgccatttggatgcatgccttgcgatctactccgagctagagccgcgtatgaactgtctctactagctgtgtacgttgtcctactatacggccagtccatgaatatatcctgctttcagatttgatagatacttccccgcaaaaaaaaaaagatactgtatagctatgcatgtcatgaccggattgtgaatattgaacatatatcatgcaatacgttttattattttgatctatcactcgaagagctttcgtacgtgttatcgtgtctgaaagtctctgcggcaacatttaattaa

SEQ ID NO: 63855 - DNA, 18047 bp, Oryza sativa
cttattcaatgttttaatcttacaaaattttcttacttttcactcaccataacatgcacatgcatagccttagttgtataaatgtataatatataatataaacttgctgcatactctgagggatggcttggtcccagcaaccttcatgacagcgctgataacccattgcctatagctgtgatagcccaccacccgttgccatttttccatggctcggatattttttagaggaaaggccacaaggacccagatttttaaaaaaagcatgagtcttatatagttttcacataacactggggtggcacagttttcagggctagccttgggcctaggccggttatgtgacacctagggcccaggccggaggggggtggggcatcaccacctcccagcccagcggcagccagcccggcaatcccaggcaaagcatgctgcgcgcaagctaggagggagggaggtgagaggccacgtcgctactcatctccacgcgactcttcgttttctgtttttttttttacgcgactccacctctgcgaccggcgactccgctctgcgcgttgcagctgccgtgcaatccctgtctccctgagtccgctctgtgacacaacgccgcgcacccacgccgatggccgatcgatgccggatcaccgcctgatagtgatggctgatgccttgttaacgacgaaatttggtaaatcatgcatcgaatttggagttaaggccgaagcggatttgggaggaaatcgataatggaaacagagtatgaatcggcttcggaaccgtatcggctacagtgtgcattggcagttaccgaatcggacaaggcaagccgatgtagccgattccggcaagatgataatggaatcattgtcggattgagttgacgtgcttcataatgattgccatgtacggatcgagtccgaagaaggcagttgtatctattaattaggaatagtttgttagtttccttttttatccttaggaaagtatgtttagtgtccgattatgaatttatgctttccttttatctttaggaaagtttctttcttgtcctacaaggactagtatctacccatgggtataaatatgtacacccggggtcattgtaatcaatctcgatcaatacaactactctcggcgcatcgccaccctctttcctgaggtttttacttatcaaccggcggaatttggcacctgacgtggggctgcatcggctttcgatcttcggcgaaggggtaagtcctacgtttcgtcagccctagtgaatctgtcggctacgttggtgttgttcaaggctgcatcgcttcgaactcttggatcgctctggtttggttgaaatatttgcctacctgatatctcaattctatctctaattgcattgtgtttagaggcgcatcggtttagttgggactgtctcggttaggtctgatctcctgtcttagccgatatatctctacaatcataatgttgttctaaatatatttgttatatccatcacattagacagatcaatcggctcatcgagtattagattatcatatataatctcgtgctgcatcgattaggttcgacctactagattgttgttgataatataagtcttgttaagccaataggttcatgctaatgttttatcgaggtgctagccgataagttatctggacgttgcatcggcttgtaaagattgcatatacatataaattggatttagccgatcgcaacaaaggtttcactgtttaatctaatcttatggattttatgacatcggacctccagccgatgtatgctttaaccttcggatcgatgcttatttatcatatcattatttgctgattggtttatactagattatattgttattttattacctcatcatcaaccgattgcctttatatcattatctacattgaacatatagtcgattgcttaaaccctatcgccatcggctgatatcggcatcggctattatcggctatcggctggaactactccatcggcttgtcagccgatttgcatatcttgtcagttgcaggatcaaactgactggcacgcctgtatctcatcaagttttggacctgcactggagctaagcagatctctcaggccagtatgtgtttttttgcttcaacacgcctctccctgtgatcccgtctcctataggctacgggcaaactgaggttagagtcttagagtctttttgtactgtgttactccttctaagaaatttaagttagcaacttattacttatggacttaggattttcttgcttgcatgctgtcaattgttcaaaacaattgatactaagagttatctagcatagggtggaatgaggaactggaagcatttataccttgagactcaaacaacatgacaacagtattgagcatataagacacatgaatacttggaatggacttaggtggagattaagcaaaaaccagacaattgatgatgatttgcaacgggaaattgcaaaggaaaaaagattgtcggagacaagtttttggtaagaatagtttctgctatgaaatttcttgctaaacataatttggccttttgaggattaaaggagaaactttatgaagataacaatggtaaaatttttttgtgtcaatatatagtatatatgatttaaaaagtatatactagaagtaaaagaaataaccttaactctttaaaggcctatagtgtcaagttcgtctagggcactcgaaattgttgggccagccctagcggctttcggtaccaggcaggcacaaaaacaactaagagacatgaaagtctatctaaaacagagattgacagaaaactagctaaaacaactgactgagcagtgagaaatagttgggctgataaaatgaaaaggaagtgagaacatacagtgtgtttctttttcaatgccacccattctcataataaacttatatgtaacaagtgttgccttagtatgggcacatgtattgtttcatttggaagataggcagagagagagagaggaggaaacaatccgttcttggatgacatggtagttggttactacaatggaagaagtggatcgaccatcatgaataggaaaaagattttaaatagcttatggttaagggaggtgaaatatgaattaaatatcaatagaaaatttctcaggttcctctaagtttttaaccagtctgtctcatgcacgtgaatatcatacaatcccttatatgcccctaaatttctttatagacccctacatatccattatgttaattgactgtgaagagaccattaacaacagttaaatttggcaaattaggtcttttgccaaatttagtaatttcagccattcgcagagccaccgcccggcaacccgcggctgtggtctcggcaacaggttaatggtctcttcacagtcaattaacacataagtcatcatgtgtgctggttgtcggtttggaaatccgctatgactggttcctaaccaacaacaaataccttattttagtagtgacggaatattatggctggaaggacgcgtgtagaggtaagcctgccaatgggctggattgaaatgggcccaatggattggtttcagctttgggtgtagtttggatggatggaaatggattgaggagtttaatgggctggactggttagggtagaggtggaaacagtttggattggattggtttttggtttctgatttttggatccaaattggattcagtccatggatttctttggatgcactagacagtccagtactctccaaacctagcgtcatcagtcgtccacggctccactccttccgccgccgccgctccctccccttgcttcgcctcctccatctctccgccaccgtccgcgaatccgccgccaagccgtcgccagtcagattccctcccccaccaccattgcttttctttttccctggtttttctcggtctttgatctatcctggttgttttgtttgtgtttttttttgggtctcttcctgatcttggtggttgcgggtgcaggtgaagcagaagaagaggaaggtgcgtgcgccgctgggcgttggcgaggatgtcctcctccggcggtccggccgcgtcgccaatctataagaagcccaagtaccacgacgtatgtgaacagtgtgattggtgtgatagtttctataagattttgtttttttgttggttttactgaggagttaacttgctcaagattacaatctttgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtgcaaattttagattgtagcacgtgtacaatgtgtggaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattgacagccgccaaaaagtcaggaacaagtcaccttattaatcacatagccgaatcatgtccagctattgatggtgatgctagaatcaacttccttgcaacaattaagaaacagactagggaaggtttcgtgtttgttcccaagagaagccgggagctaatggtcagattcttcattcatgcagaggtgccattcaagaaaattgaggatccttattttttggagtgggtggagtccatgcagccaactttcaaagttgtggggcgtcaaacacttcgtgatgatgcctttaacttgtatgagcgaatgagggaagacttgcatgctgaaatacataatcttgattcgcacgtatgtctaacatccgatatgtggatttcaattcaaaatataggctacatggttgtcacagcacactatattgatagagagtttaacattaagaagaaaattataagctttaaggaattgaggtatccccacacgggattcgccattgaagaagctataatgagttgcttgacatattggggcattagaagcaaactgtttactataactttagataatgccaataataacaattctgcatgtcaagagttgataaagaatcacaagaatgcattgatgtttgagggtcagcatttgcatgttagatgttgtgcccatatcctaattattttggttcaggatggtatgaagataattaaacctacaatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacagatctgtcctggatagctatgcaaatcaacatggtgaagttgcacctactgaactagaatggcagaaagttgaatcaatttaagaagccacattatcggtgtcagcagataggaaaccaacagcacataggttcttgcccttggtgctacaaattcgtcgtgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgatagagattgtcgaaaaagtgggacagcagcagtgttggatcacctgttcttgggaaaagaaaactcgaggaagagtttgcttttacaagtcttgaaggaggactgcacggcaaacgaaatcagaatttgccatatatttagaagaagatgttgaggacgatagtgagagtttcgatgttttggactggtggaagagacatgctcaaaaattcccggtattgtcatctatggccagagatttcctagcaatacccctcagcactgtatcttccgaatcagcattcagttgtgggggcaggatacttggtgacacacgaagtttgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcatatatcatttataggtggaaatttgtcctgatttattcaggtggtgaagtgaagaagatggaaaggtgactttccatatacatatatgcaactttaaattcaacttttcctttggcgtattggaaatttggaatggaatacttctcttgaacctgcatttttccaaaattgagtttaccactttgttgcctattctgtttgtatataaaatgttactattcattatttaccaattgaatcaatttggcacattgttttgataacactgcaaaggtcacattatttaaattgttattgtaattttgtatatttgctttcttaagcaacgaagtaacaattttctagttattcctggatataaattttttatgacatctacttctttcaggttactgtcatctgcaagaatgtgtggctgagaattggaagggtttttggttttggttatcttagaaggtaatctaaagattgagacatgaagaaattgttggtattcagttatacatggttctgaggcttgtaatgcttgatagctttttttgttggagattttctcttgagcctgttgctctagtagaatctctagtgataattgtaatatttagttgccaaaacttgttggatggcactacttaaagcatcaaaagttctaagtatgctagtagcgttgattgattatttttgcatcttgcttatgttatttgtaagtatgctagtagctgtatgcagtgtgagtgttcgccggctgctctgctctgcttcctgccgtggattgggtatgggttggaaaatggattccacccgtggattgtgttgaatttggactgagcaactttgtgggttgggttgggtggggttagctcaaggaattcttggtctggattggagtgacaattttgctatagtcactttgggttgggttggattcggggtggatgccaacccattggcaggcttatgtggaagtgtaactatgcattgttctttttctcctaatgccacccattctgaaaatatattaattcctccagcatgctctatgtagaatgtagctagtgtatacatatatgtgtattgcaaaatggaacaaaatgatgccaaagagatagggtttgtttgtttcgttttgcaggcagataggtaggagctcttgcttagtgatcaatataaataggagggggaaagagattaaaaaaaaggcatgtcaatgtagggttcgtaggtgcttgttgcaattaattactcccttcaacaaaattaaaaccgggtctggtaattgtgcacatgtaggtgaaatactgaaaactaaacaaggaattgtcatttgttctgtacacctcaatgaatattttcttttcaagtggtattgcgtgtacgtgtgagttgtacaaaagattattttattgcctccctgaactataaaaatctatagcctaatagtaggatatatatatgaatgtgtagccctttcttgcaacttttcatttcatttgttcttttatactgtttagcttcatttattttgtaatttgtatttgttcacaatattatttgatcttttatgtctataatatatgactttgatcattaaaaaatacatgtgatctaatacttaaaaaatcaattatttttcacccattagtctgtcttggtgtaattcctccattttgaaccacaatatttaacataattgtcaggcataaatccaaagagctagatgtccatgcaaaaatataataagccacttccgcccgtcagaggtgagccgtcaaagcttaggccaatttgatgtagggagtactccctcaattccaaaatatgggacgcaactgctatttttaatgtttcataacacacggagcatgcatgcatctaattaactaaggccaagtttaattctaaactttttcttcaaacttccaacttttccatcgcatcaaaactttcctacacacacaaacttttaactttttcatcacatcgttccaatttcaataaaacttctaattttggcatgaactaaacacaccctaacacatacccgtccctaaattttcgtttgtttaacttttcacccttaagatctctaatataccattaggtacatgtattttatttattatgatgattcaaacgagtaggggataataatcttttgatggtctttgtgtaagtgtatatttttttattttttgggaatggagggaatactgcctacttcacactaggcccaattcagtgtgaggtgtggggaaaactagaataatctttcctttgaccagcaagaaaactcaagacagctatcgctggcagcttatctaaatttgatcctccatatcctcatatggatggccatcgaaaaaagattcctcctccatataccttcccactctaatagatcatccatattacatactccatatcacaccctcctatattttactaatatcttccaactaaccatatatttatgttattttttaagggctatattttgaacaactaaaatttaacggtgttatttatcacgataatctaaatgagtgtattttaacctatatattttcaatggataatttaatgcattaaattgtgacttttctcccgaactatatttctctttctctctctttttctattcattcttttctctctgctcctttctacactcttctccattctttccccttctctcttctgccgactgccgcagctctcctctcctctcctctcggcgtgggcgacggcggcagcagggcggccgagctggcacgaggcggcggtggaggcgagcagccgggcgggcgaggggcgcagatggtcggggaggaggcagccggcggcaggtgggcgaagggcggaggaggcccgcggcggccgcgcgcatcgtgacggtggcaggcaatgcgagcaaggagcagcggcgcgagcgcagtcctgatgggggcgacgcggacggcagggcctccactccggcgaactccaacggcagacccagtatgtccatcctctctattccccacggtacaatccagatggtggcgcaagttcatctgagctgagtagtttggggatagcgtaaggagagaaactccaaattaggcatggggagggcgcggtttggaggaagtctaaaaatggtgtgcgtgatagaggatttgctagagcgtgttttttcatctccatacgtgaaaaatgagatggatggcgggatggaagagctgctgggatgctctaatgaacccagaacccatgatgctgcccaagattgtcaggtggtggctccactagtagatactactaagttggtatgcgcataggtgaatgcgcaatgtgcttctttaccaatgtcacccattctcaaactaaaatccagtaacatgagttttctcttatgtacatattacaaaaccataaaaaagattgcacagagatagtatccacagcttcagttagctggcaggcaaacagatgaaacaacctttgcctagttattattatataaacaaaagagagagaaaaggagatggaagcatatcaaaacagggtagggagtagtaataagtaatttcttggcagaaatttacagtttcgtaattgaagaattgccggtgcaatgtatcacaccataccatcttccacaaattaacgtcttaaattgtccaaatacaataaaaggtacctctagattaaccattgtcacagtaggtaattaatgtgtttgatttgtactgctctctggcactttgcatatcatataaccctacgacatctcgacatactccacgcatatccatatttggagttttgctttgctttgaatcagtttcttgatcgtgcctcattgcatggatcgctttcttcaggtattagctcatgtggatcaaaattcaactgcctactaggcctaattcagtgcgagggcatggtgaccgcaatagtcaaaaaatcaccctgttcctcttcgctagttagaccacctagaaaactcatatttgccatggctggctggaaatgagcccacgaacccaagttgttcccaaggttgtcaggcagtgactctagctagcagtagatgagtctgactgctgcgtgtataggtgcaagcgcattgtttttctttcccaatgccccccattctcaaactaaaatcatgtgacacgctttgtgatttgtacatgttacaagaccgaaaaaggtaatgacaaggggagagcatgtattgtttcaattggtagataggaggaggaagcaaccttacgtagtgatcagtataaataggagaggagaaaatggatagaagtatcaaaatttggtaggtggttgtaataagtgttcttttcttgtagaaagtaagcttagaggtaaaagccaaggtagattatatgctaacttacactggagaaacgaaactaaaattagagataccatcatggactcacggatttaatgcttgcactagtacggatttatgcatggctagcaaaggcttgagactagccaagaaacaaaatttatttattttttgataaaatactcatccgtgacatgcttaaacttaaacccgattgagatgacctcatccgtgacgggcttaagtttaaagccgattgagatgtgtcatccgtggtgagccttagtttatgcccgattgagataagtcatctgtgacgggcgccataccatagtcgttttcaagtatgagcctatcacagatgagctcatcgttgatgggccctagtttggctctagtttgactcatctgttgggtcaaatctatcaatgacagggctttagttttggcaagataaatataattgtcatccgtgacggcaaaatacccgatacagatgacttctcatatcaatgacctttggtccgtgacgggaccgctcccctacacagatgacgcttgccggccaattaagatgagatatcccatgccggtgcttacttgtatagtatgtaaatgtaatctaaacatgtagcatatacttcaatggagctttaacgcaacctttcgttttgtttcatttttaaatacaatatgtgacctgatgagctcaactatatataattttttcatgtaaaatgcaacgactcctacttcaagcctactagcgaagatatgtgtatgcaaattttacagtagtctacgagtagtataagtaatgcaggccttctatttcttttgtttaattaataaaccatatatatttattctatcaaatcatactaattctggaataaaggtggcatataacataaagtaagggacacataaatcaatgtcacaaatcatttaactgttagtaatgaccattccttcgtgaacaaactggtgcactactgaaatttcctcgaaagctagttgagctattgacagaactatattcttcacaaggagctcatgtgaataacccaaattaaccgggtgttaatttcaagtagtgattgctagtgtggctcaggtggcgtcccgtgcacagcttctgtcttgtcaaaaatcacaaacacagttgtgtctttagccacaccatatcaattagctttgctttccaggtgctgctgtagcagcaatactagctatagctttgatgttatggcatgtctaaactcaagagatgccctgacaagactggcagtatctagccgagccaatttgcccgggcagagacatcagcttggcgaatctacctttgaggaaaatgtggcggtgtgtctctcccaatgccacccactctcaaaagcgaactcatgatctacgaagtgtaactgtagtacatgtgaacatgtcgcgaaaaggttgcacgttttcgtttggcaggcagataggcagacataggagaaagcaaacccagcttgattggagggcatgatagttggtttgctggaatggatgaagtagatatacagatcatggattggaggcggaaaaaagagtctatcttgtaaagttatagataggaatggggaaccaagataggatgtatgaatacatagtagatgttggtgattgtagtaagtattctctctatcccaaaatacataggtttatactacttctgtcccaatttaagtgtagttgtagatttctatgtccaacgtttgatcatccgtcttatttcataaatttatgaaaaaaaaattaaaaacaatagtcgcacataatatactactacttccgtttcaggttacaagactttttgactttggtcaaagtcaaactactataagtttgacgaattctatagaaaaaaatagtaatatttacaacaccagcatagttttcattaaatctataattgaataaattttcataatatatttctcttgggttaaaaatattactattttttctataaaattagccaaacgtaaagtagtttgactttgtccaaagtcaaaatgtcttataacctgaaacggagggagtatttatgttttatcatcttaggaaactttcccataccagaaacaaactttacaaactctaattgtactaaatttggacttcttccaaattcgactccgcttcccaattgcacacaatatctccattatatgacatatatatggaatccccatcaaccacgtgcattaatctttagcctaagcatcccgcttaatatccatcatcttctcccaaattgactcccaatccattatcggcaacactctcccgaggtgtaacatcctagcatttgccggcaaagcagagtaaacgtgatcagtgcttacccataggaacatgaataaaaccagatagcacatccatgactcacatggaacatgaataattgaaaccggaaataaagaatcaaattgaaaaccatattgcacatccatggcaagcatggaacttgaactatttaaccagaacctgaaccatattgcgtcaggcataacacatagacacatcacaccactgtaagaagagaatagaatgagtagatggcatgggggccaatccatcccatacccaaactattaactcggtacagtgatagatgtatcacgacctagcactcactctcggacaacctcacttggcattgggaaaaaaaagagtaaaagtcccctcctctaaccactttgcattgcctatatggaagcaaagttacctattcttagtcttataagatacaacattaattacttctataaaagagatttacacaagttagatccatgattaaactagtttaactaaggtctagggcaactaaaactttatcatgtacactcacagaccacaagtataacacattgcaactccatgttgttctccctaatagctttccaaatatggttatgcgcaaacgttaatctccacactatacaccgcaccaatggatcaaaactgaataatttttttatacctcctagctttacttaatatacaatcaaatcttattcgtagaagagcatatatatctagtaacaacataactctagaaattacaaatacaatgagatagagatcagtaatcaataaaataaatcagaagtgtaatggattgaatgacccaattccattctactgtgcgccaatgtgttaaaattttaaattattcaggcctatctcatgttttgtgttaatccattaagcaacgtaaagctcttttttctgaccaactaactctaagcagatctggtcaaagttttttttttagtcaaaattatttattctctcccatggacctaccgcctactctgataccaactgtaacaccccaggtaaccacgtacctagagtgctacaccaaaatacactcaaaccactaactcccaaaattattagaaatttcggcggagtctcccctataaatacggacatccataacaggcaattataagttaaactaataataatatcattcctacagcgcgatccatccttataattccatggaaagaaactaatagatatctaaaagattattacaagaccgaaccatgatatagtttaagtatcattatggacctaagcattatagtttgatagtgtgcaaataaatgtgtatataaaggtgctagtttccgtccatgcatgtcggtctcaattcgtacctaaaaccaaataaaacacaagagtgagtataaaaatactcagaaagtacaatatggaacaagaaaacacatatacacatcattggcaataaagcataaacagatggctttctttttttgataggaaacacattttcaaacaccaagtcaaagaagatagtagttcccatcccgggtaggcatgaattgaaagagtagtttccatcccggacaatagtgaatacatcctatcatttgccggcaaagccgagtaagcatgttcagtgcttacccataggaacatgaataaaaccaggtagcacatccatgactcacatggaacatgaataattaaaaccggaaattaagaaccaaattgaaaaccatattgcacatccatggcaagcatggaacttgaactatttaaccagaacccgaatccggaatattgatacaagaataacgacgtaaacataaaataaacttgaaatctaaatagcatgaacaacaatctgaacatatgcaatcacatatcacacataaatgtaatgaaaataaatagatagagcaaacactctaagaatcacacaattagttcgtcatgcacttgcctccaatgaaggtttggtatcatacacgatctgaaggaccaccacctaatcacaaacaaacctcagcaaacacattcaaacatacatatgaaacaataaaaaaggtgaacctactgcccatcccgtcaaaacgcaataacaaggaatgccgcttggactatacataagactgctgcttcaaacctttatatcttgaaatataaaaaggctatgactgaaaatatatatacattttaaaaatctatagaacaatacctacaacttttatgtagaaatcatatttttattctgccatttaaatggtctaatttgtgcttgaaagccggcttcagaatctgtccagaatttcagagggtacatacagaaacaactatatctggagttctactcatctgatcaaagagtattttaccaatatggaaaccttggagaaaactctacaactttgtctagaggcggcttaactgattccgctgtttaaccccttaaaaaacagttcaatctactactatccagattatgacataaaagcaacagtcatactaaaaaaaattatatctcctaaaccacttgagataaaatcacgccctttggtcagaagatagatccaaacgttatctacaacttcctagctatacactttcgcagaaattaacatttatagccccgaaacatcgtaaaaccgaagcactgcaaatctgcccacatgcagaactgcaacaaaccaaaccgcaaccacccaaactcctcctctagcattcactaaccacgaattaaagcactaaaaccatgctagaacaactgatacaacaaggggaaaagcctcacctagtgatgtgaacactcacgaagggtggcccgatcttcacgacaataggttgaaaaccaaggataagttgctgtagaaatagtgggtaactagctttatacctgccaaggttggatgggaccaaacgacggggagagagacgccaaaaccgtgaggacattgactcgatctccgaacgaccgcagaaccacaatccggaactaatccacacaatacggtgcagccaaactagaagccgtagagcatgaactaggggacctcagagagatcttcctgacaagtccaagaagaactcgcaagaacaaaagggtgtaagacactcaagcagctcggttgcaaaaaccatttaggttatcaaatcatcaaaagttgttttctggaagcacataggggatatttatactaggaacaaccattctagataggtatgaaaagtcttggaattttaaaggacataggctagcccaaaggtctccacaagtgaattcccgagaagactcgcgcgcctgtttgccttctgagcagccttcagtaaaaatgtcattactccttattgacatggggttggttgcgttggaatgctaacttaataagctttcacaccatgtgcataatgcactacaaaatattgtagattgatatatttttgcatggaaagttgaatgtcttggcaagctgttggccttcggagtagtgtccactaatctggccataactctttagtgggaaatccaatggacgaacggtttgttgggtttgaaactagactcaataagcttcccagaaagtgctcattcaccttcatagcttttgagaaacaaaagttatgatgatttattgaactagtccgttttgaaactgaactggctcgattttgctggttcttttttactgtctgatttagcatcctcttgttgcatattcctaagaacaaccaaagtagaacatttaggtaatataacattctcatctatagatgcatcaaatgtagcaaggagtgagttcacctgctattgtagttttttcacatgacttcgcgtaatcggtctttccattacttggtcgcatgtaactgtagttgaacttggtatagtcatgactgggatgtcctcatcacctagggtttttttagagaacttgtgaggagacaataggggagactccgatctaacccctcctactcctctcctcctcatcattccgtttttccacttcgcttgttgatccaagctatgaagatggagatatagggagagcaatttgttgtagaggggagagatgcaaacacaggaggaggggaggaaggcggcgccgtttgaggccggccagggagaggggtagcggcaccatgaggggatgtgggattcgattcccctctctctaggttttaggggagaactagtgggctgggtttatgggcctcctcatgttggcccacttataaaggtatttttattttatttatttatattaacatatttatttaacaagtcaacccaaaccaaaaacctaaatatcttttaatatacaggatattacacgaggcatcaagactcacctacacatgcaatcaaccaagaaattatatccgagtacaagttctttccatcttgactcaatctttgcgcacaacagtattacatacgcatagtatccatctataagctataaacatgaattatccatgtgtggccatacagtcgtcggtcagattgcgggctggctagtctgaccgcttgctacaatccggtctgaccagctttagctagccaaatcagctcatcacctcaaaatactgtttattctcatccggtctgaccgatacacacaccccagtctaaccggtgccaaaaccattttgctaataatctccaaatatcaaaaaaccaatattctcaaatagcaattgttaatcacaaaataacaatcaaacacactatgattttacaaaaaacatagtgtaattggctataaaagggaggcaaaggcaaacctatctgcaaatgctcatcaaaggcgggttatgcctgtattatgcatgaaaaaacttataatttgttctaaccctgatcataaaggaaggctagtagttacactatcagtttttcttttgcaagaagaggtgcattgtcatgagtcaacgcgtggagtaactaaacagaagttctgaggataatttgg

SEQ ID NO: 63856 - DNA, 4469 bp, Oryza sativa
  unsure (1)..(4469): unsure at all n locations
ctgctaataagtccgcctttttcatcttccgtaggggcctttagtcttttgattagagtagaggtcgcgacagagcagagcgtaccgccctgccatagtcgcgaggatcttaatagtcggtcgcgactgttgtcatagtcaacgacggttgaaacttccaggaaaaaacttcgaattgggagggcgatcctcccggtgagctgaccgtannnnnnnnnnnnnnnnnnnnnnnnnnnnnnnnnnnnnnnnnnnnnnnnnnnnnccatgtcgaaggaactcggcgggctttgtgtaaatggcttcatgttggtatggggtattaccctattttactcaaaatactgtgtccaaaagcctgctgcttatggtactgctagtctgttatgtacaagtatcttaccgacgaaaaatgagagataacatgctttttttccaaattttttttctaatgtgcatagatcgtaaggggataacagaggagatgctgaggaaagtgttggggattggaatggagtttttcaagttgcctaggatttagagtccaacgcgcaaagctaaagaggatttcaagtcccccgcccgccagaacctaaagattgctttatttatatacgatttattgagttaactaaaaagctggttcattccatagagatcagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatcttgaggctattatgcgcaagcttggtttccaccaggtcgaaaaggtgatgaaatgtgtgacgtcggtctctttttcggtgcttttcaatggtggccaactggagaagttgaagccaacgagaggcatccgtcaaggtgaccctatctccccatagtaagccagccaatagtaccctaacttaagaagttctcttagctagcgcatgtccattaatgtgaccaccgcatgcacctgaaaacaatattcaactccatgccttcaagagcataaatgggtaacagccagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccacactttatcccgtcaacatgcttaaacttgaaaagcttcaatgcagaaaaagtttcaagcaatgtagattattgatctaatctgtaacaccttatttacttgtaatctcatacacatgttcatgtgcattttcaagggcagaaagaatatccttaaagggtcatctcgcaatctttttctaggggatagtcaccacagatgctcagcagatccaacatcgtattgcaacatataagacactcagtgtttacagtatgataataatggatattgtttcattccaatatgacataagaaaatgattcatacttactttaatggattagctaggaccctctgtcctattgtcacaaagctggtctcctggttcgacataaaccatgcaagtgacgacacactacaatccagcattctcagaaattagttgctgatttgggaactaaggtgaagaaaatgcaatgataactgcaaagttttcaacctaccttcccgccaagcgggagaaggggcgaagcgagaactcaggaatgaatgaaccaagaagggttcaagacaaaagaattctactcaggatgttgatcttctgaccacgaaactgagcaagaagtccatccgatagtgggggagatcaaaaagtacttttttatgggcttgccctggcgcacaaccactccaatccgcctgggtcttctcgaatgtgtagaacctactttaaaacccgcgtcctcgctgaggagtgcctacgtactttcttcatagaagaaagatcagggttgctttcgtagttctttcgaaatgatttacggtcattcttctttattttattgaatacattacagctagtacccgggaaaaggaatacaactgagcaagataattggattgaaccagatgccgtaaagagtcaaagtaaaatccattagcgcccagaggcagagcaaagagattcggagatagaagagagtgggaccacttcgaagtcaacgggttaaacatagtgcgagttagacagatcccacggagagtctatctcttcactctagattttaacatctaatgcaattcgttgcacacacgaagggaataatataatgaagaagagtgagaatagttgtgaatcaatgagttgatcactaaaaagaagaaaagggaataatataatgaagataactgtcactttaccgggccggaaaagtgacaccgtcacgtctcagagttgtatgcctggaacaagaagggtcgtcgtacaatttcggcgattcaaaaaaagaaggaggcgagctccctatccctctttggggtgcagacaggttcgtcgggggttatgcaagcttcagaggtggggggtacgattgtggaagatcgcgtggaggcaggggttggagatgtgatgcaaggatgcggggaattgggtggaaggacagtcgttaatgtggagtcaggtttgacgggcgtgaggcaagaagtggagggaagtgggatctagattagaagagataaatacgatattcctgatctgatacccgctgacgatccctagcctagcttggcaatcccttgaaaatgcaatgcataggcgtcctcggattggcccgggggatcgaattgattatagaaacatgagtttaattaatcgatttattagtaaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaattggaacttaagttccgattgttgatgttttattcgaaagggccaagttgcattggaatcgagaatgtttcattcataattgcataaaaggagtaaaaatagtggctggggcgcgtcgagggtcaaccttgatatcgaataacctttcgagcctgccccaatggatctctatcctcctttgaaaccaatagaagttcactgaccatccctgttaaacataacccaaggtaggatcgagaggagaagaataggactcttgctagtatcataaccgggagaatgaaaccattagattagtggaaagaagttcgaatgggaaggacatgaccccggatggcatacgtgggcgggcagggggccccactacttcttcattcaggggggctagcctcatgacttcccactgggcgaggggtgcgaaccaagtcatgagcgatagcgaagccgcctataggcgtcgaaggatgaaagtccgttagacctccaagccatagcaacctcttggggaaattacgagcaccgcattgcaaatgcgcgagatcaaagaaatcacaaaccaagcataagtggatagcaacttatactatggaggcagagtctcctcccctcatttctggctgcttattcgtcatcacaaagcaacccggtaccttttcttatgcgagcgactgagacgagagctttcaattatgccgttttggtcaaatcctagggctctttctgatttgattaaatacttctatcatttagatagagagtgaacaagaatagtagtcacagcgagggatgcacataaataagatctgcactggtataagtgataggttttgggtaagctcgctcatatcgaaagaagaattcaaaggaaatgaagcataagctgtcaccactaggagtaggacttggatgttccggaatcctcttgccgagctggaacgacccatctcctatttcagcttccaacgcctacacgttgagtctgagttactcgagaaagacttattcatagtggagatagtcaacctccacgggggctccccggccggggaggcaaaggggattgctatcgtcaccctttctcccggtgtatgtgaaagagaaaaagtgacgaactttttttcttttcggtctgcggggtccaaagaacgagagtcagcttccttaagtccgttcttcctcag

SEQ ID NO: 63857 - DNA, 5058 bp, Oryza sativa
acttggggagatttgattcatcagaattcgaattgatagttatagcttttctgactagcgacccctgttgtccttctctttttttttctaaagacgcagcagaatcgtcaaacgggaaatcaaaagtgggaagttgattgtaggatttctattcctcactctcgttagacggagagtaagcgacttctattagcaccggaccgtcgagtcgaattgatcgtgtcatgtgcaacgtccatcaatggtggttcattaatgtccatagatttagactccttccccctcccttatatgcaaaagatcgagaggggcccaaaccaaaccgagaacgtaaacagaattcgactcactctcgtatggctcgccctcgagccctgggccctatcgaacaaatagaggaaaggacagaaaggggaaaaagtaaagtctaagcgacatatggcacgaaaaggaaatccaatttcggtaagacttgatctgaattgtagttcagatccaagtcggtttagtgagggcgaccgcgaaagtcaccgaatgggttcgacgcctggtccagttagacagggattcgttctccggtagggctaagactccttcgttgtcgaaaaatcacccaagctgatgtgcgcactcacggtggatgaagtagcacatgtccgcctgaatgttgtgaatggaagtatcatcgagctgtttttcagacttggggaattttggaagctgcatcagatcatgacagaattaaggaaattaattattcacaacaatacaagttagcgactaatttaacaagtatttacttacctcgtcgtaattcgcacaatatttcccattaacccttaggaactcacaacattaatatccgcataatactattcccaccggttgcttgtgacactttcaacatcaaaataattataaggtatattaggttattaaatgggaacacacaagcatttatgaaaattaagtagtactgtttggcatccatatgtacttatcggccacttattgcagacgaatatgcgttctcttgagtttttgcgttgtccgcctcgctagtaataccttttaaatgcactgtttgcagatataattaatttacattcgtcagagattaaaacacgtcatgctaatatcttacttacagatcgtgaattcttagaaattcctgataggtgttgctatctttgtcgagggaatccaagacgatgacttcattgtactttagatagagaagaaagactatccaatggtcactgcaaacgaaattgttaatcgagccatgattatatgtatatactcttagtgcatatatattacaacttactcaaaggcatatggggcataaacacactacttgtcctgcgtagattcaagcgcaatagctacgtacgtagcgacatcgagcaccttttcatgatgcctttgtgctacgtaagctttcctctattcgggagtcatcgccttgatgtgttctggtagcttcttctcgtctagcgtgtatgtgtggttcggcttacttatcctgcacgggtttaggtaggcgacaggctttttcatcgcttcggcttccacgtaattcatcctgccaacaatggatatcaaatgagctacgcatataggtgtagtgatctattaacatgttcaagtgtagcacttacagacaccagatggcaatcaaattggcgtctagccttttcctatgatagagggaatgcatatcggagaaatggacttggagtagacaaggaccgctccagaagatgttctcccccacggcatctgtgaatgaatcgatgcctttcatggtgcttgccctaatgtaccaatcgtgccaccttgttagttgccacggtccttctcttagttgccagtcgtaaatgaatggtttgccattctcaaactagtgtggcacgtctggggaattgatatagttgagatagtcatcaaaggtctgcttgaacccttttaattttcagatatcaaattcggtatttacgatatctttgtcccttcctcggaatgctgttaccatataatgtttcttggacgcactttttgctttgtgcttgtgcgtccttaccatcactggcacatcggcacccttaggttcctctggttgcgatggctctggttgcgattgctctggttggtcgggcattggttgctcaggcaccgcttctatttcacccgccactagctttgtaggctctgcttgtacaggctgtgatggttgtgcgggagacatttcccgtattgctagctgtgattgtttctttgcaagcaccaattgttcttttgcatcctttttagtccgagctgatgcaacgggaggctctggtctaggaggtgatgcaactggtggctctggtcctagaggtgatgcaactggtggctctggtctagggggtgaagtaataggactatccctcggactggctacgactggtggacgcgactgtgacaccggtatccttggtggacgatcaattccatccgttgaccctagttcaatatcattcttgtgccatagtatgaattggtcgacggcatctccaaggtacacaatctgctcagtagttggaaagtcgagctcgtgtatccggtaagcctcaatgaccgtccggacctctaccttgacgtagtcatccggaatgtcttggcaatgaaacctgtggcctggtatgaacctcccagttgcaacgagtattttctttcccgccctgccgaccggaatcaagagcttgcatagagtatcctccgttacatcatcgaaaggatagctcagctcaggctctaaaacagcagcaccgtgcatcattttctaactccaatatatattgcattcgtcacaagctgctgccctagcctaagagtcaatctcttccttgtagcgatcacgcttcttgtaggtatgagcatcctgtttgaatccatccttccagctagtctttgaggaaactccccatacacggccagagtgctccggtttgccgaaggcataggttagctcgtcccgatctctatctggcacgaacgtcccggcctattgctgcgtgacgatgttcttcatcttgacagctacctcccggagcttctgatccttgaatactacatcccccttaggggtgaaggccggtgttcttgcacgcacccagttcctgcttcgtgggttgtgatttttcataggaaccggtttcccagccttctccatctcttcatcttgttttgcccatttcttcactgcttaccggtaaccggtcgatcccaaatgatgtggatattcattccttcttgctagctcagccatcttctggctcttctccttttcttccgccgatgtcttaagggcaacaaactcatcccactgggcctgtgttatccttccgtagtccttaaacggcgtgagtcccttctggacatatttcttattcaggtctgttttctagtttcaccacagcttccccattgtcttcaacgcataatccttggctttattgtcgtctgtcccctctggatattcaaacttgctttgcagcaacgtccaacagctgttctttctactctctggaactttctttcaatccttccatgtgatctccatgatatcccagaccaccgccccacattggttgctatacttcgaacatgagtcttccggtgacaggggttcccctgtctcactcatccgcgtcagcacgcttacttccttcaacaacatgttcttccctcgctcgcccctccttttcttaggtttgcttgaagctgttgtgtgcacgacagttgtagcttcagcttcaggttcagttgcggcttgggctttccttttggagcgacgtggagcattcaactattgtttgcaagtcaagtgactttaattaaaatccatagttcgcagttaatatgattggaactaaacaaatattatatgctacgtaccaccggttcggggggaacgtagtcggagtcaacttcattgtcgctactgccctttctcttctttgtaggagaaggatgggggtcactcggcgagtgatacgatccactgcttgattcacttgagctagacgacgaagattcctccgcgattacttgcgtgcaaatatcttcctccatgactagctgagtttccttgcccttgtcacccgtgggttgctcttgggtgggtttgtccattgatatcgcttgaaggtgaattcatgttagttgcgaaatgtaattattttcttattgtaaatccgaaaagaaggcaaaatttagatactaattttgtactacaactataaatattgttaccaatcaatgagattggtaacgacatcaatattacaatccaccaacgctgaccatttcaaactacctaattaagttccttaattatcaatgaatgacataatacaaaatgcatggagaattatggtgtctaggtcggttccgtccatggattacactgaccaatccaccataattccccatgcattttgtattctgtgatggtttgataacctaggaactacattaaatctgcggccaatctatcaattcttccatttgaactaaatttcaaaccctaaacctaattaagttccttaattatcaaagaatgatagaatacaaaatgcatggagaattttggtgtctaggttggttccatccatggactacactgaacaatccaccaaaattccccatgcattttgtattctgtgatggtttgataacctcggaactacattaaatctgcgaccaatctattaattattccatttgaactaaatttcaaaccctaaacctaattaagttccttaattatcaaagaatgacagaatacaaaatgcatggagaattttggtgtctaggtcagttccatccatggactacactgatcaatccaccaaaattccccatgcattttgtattctgtgatggtttgataacctcggaactacatttaatctgcggccaatctatcaattcttccaattgaactaaatttcaaaccctaaacctaattaagttccttaattatcaaagaattacagaatacaaaatgca

SEQ ID NO: 63858 - DNA, 30994 bp, Oryza sativa
  unsure (1)..(30994): unsure at all n locations
aatatattttatctttatatagtagaaaatcatattttaaatactgttgatttttatgaatgtatgttttttctgtcatttttatgtacatgtatatgttttttttccagcgaagattaggaaagttttgttttcaatcatgtacaacgtttgtacgtatggaaagaaagcagtggcatttgtaacgtataaactcaaactcatacattcatgaggatattattttttaataatagatctaatctaatagtgtaaaataacaggtctatcaatttaagtgaaaatgaacggtgagattagatagtaccatgtggcgacttaggagcgtttgtaggagtgccacgtggcggcttaagagcgtttgtaggaagtttaatggacttttagtatataatagaagattggtactctttactaccatgcgtgcaattaatcagcttaaaaaatatcatgtactcatgcattggaacccacggtgtaaaagaccaagttaaagggaatgtgtgaatcatccatgtgccagaaagtcaatagtgttaattcttcagacttagactcaaatatttcgaaagtgaaacaatataaaaccacaagtttaatgatgcagcatttgcaatattcagttttcatcaacagtacaggtgtgcaacttatggtcgccatcagtctgtagatagtttgcaatccaggtttgggttacaacttggtagacttgcaaaaatgaaattggcggctcaccggttcgttaaaaaaaatgtttcttccatctcttgattcaaaaactcgaactaaatagtttttttttcttaagatgatggattaactcctcctattgaacatcgatttctttccacggcataaaatttctcacaataagatggactcaagatttacgtgtgctatcttttcccaatcccactcattcccagttgaatcggtagagccgaccattgtttcccttttactacaggtcttccacctatctaaactttctagtatacaaagctttccagtatacaaagagatgagaatggacagtgcaagtgagtgcttggtagagaaaataaattccagtagctgaactactggttctatacgaataatggaagaagacaattaattagacaaacgggatgtacctaattaatcataagatcaacgaggtcagtcacagaatcactgcacatccatcctcatcctttctatttgcgtcactctggatgcttcccattccaaatagtattacggcacaatgagatcagaattgaagcattccaaaaagaatttagcttcttcgatttatatgcacatcagcacatcaaggccagattttgaatgcttcaatgttttcgatttcctactgtgtgtttccgactaggctaaacacagtaggtgcattatccgacaacaatgcatttatttcctaccatttgataagtgcactgtatagttccaaatattggtttctacaatttttcccaacttgatatctaatctccaactaattaaactaatttctattgtccaccaatgtgctaaagccggtgctgacatcaatagagtagctattccgtccgccccatatacaagttaatatagtacgagatgtggcatatcctaaccagtactataaatctggccaattagattaacttattatgggatgaaggtagtagctgctagcaccatctaaaagcactacacattggctccatttgaacctgattaagatacagattttacctcgatttctgttagcatgttttttaaattgctaaacggcttttttcatgcgaaagttttataggtaaatgttgctttaaaataccaaataaattcatttttcaagtttaaaacaactaaaacttaattaatcatgatataataactctcattttacatgtatgtacttaatctgcatcttgggctagcttatctggggaattcggtaaggcatgcacagtggagaaaagaaactaccccagctacaaaagttaaatcaaacaataatgctatgcagcacctgtgggcgatgatgattctgaagcctactatttatccatgaacagtatcacggctgccatgttttcttcttttctggtgccacccactcctaaacagcacaaggaagaattaatattggcataacacttgctgtataaaactttgtccaccatatttcacagtggtacatttcactttatgccctgtgggcctctgtttggagctcaatattctgggttagtcgtagtagtaggaagacagaagctaagctgctagctgctaggatgaagcttggattacgatttgatttatgcaattgttgtcaatctgtcagtataaatggaggacaagcttaagcacactgtactagatgacacctcacaggtttctagctaggggaagttataatgtaaaataagcaagattgaacaaatgactctgtatggtaggcacgaatatataaacgcagaacatgcgaccagattgatcgggttaattagctcttcttgatggtgtggcctcgtgcatgggatgagctgataggtagtatatgttagggtttaggtggtagaaaaataaaaaatagttatccaaagaatagaaacaataaataggaagctaaatggccacatcatgccacaggcaaaaagatgaatgaaataaaattgtgcacaatcatcttactacagtttaaactcatgaatgaaataaaattgtgcacaatcatcttactaaaattgtgcacatcatgccttatttattctagttgtctacccatccatttcacaggttattatttattacaaatactataaatgttgttagaactacttctaatattccaagcgtcaaacatgcatcagcctaggcccaccccaccccacgtcccgtcatcccacttctactgttgtcggagtaaacgatttactcctatcgcgcgcctcaaccacccacatttattcgagtaaacgatttaattcaataataaaaacaactcccctgcttccgattccaccccacgtcccgcatcgtgctcctaccattatcggagtcaatgatttacttcgataaaaacaacttctctgcttccggtatatattctattttttctgtacccaaccaaccactctcgcgcccactttattttttttcctttttttcagaacccactttattttttttcctttttttcggatctgaattgatccaccatcccagcccacagatcggcgatacaccatggaggaggacgacgacaccgtggcggttgatggcggtgaccggcgagcggtggccggcggtagttgaggcgaaggcactgcttcgggcctcgctgccggacgctaggcaacaccttaacgagcatggagatgttcacctgggcctatagcaacaaccagtggctgctccatgtcggcgactttgatagaacaagcaagtaaggaaatgacactctgatttatatttgcatactctccttcaacttcacacatgaagccctaattttttttgcaaatcaaattaacgtgcaatctctaatattacctgatctcaattgatgggctgcacaggccttacatttgcacatcgtgctccatggggctggccgcagaggatagggtggaatccgccagtgacagaggttgtttgctatttttcttttgctcgtcgtctctattgacatgaacaaaaatggttttttatttttttcgtacttgctagatgatggatggctgctactgcccaacgtcgagctcatctctataccacaccgctacatccttccatgattccatcatcgactactgctcgccacccggttgccctctccactaccagtcacaagacacagaccatgctcttcatccttatagcaagatccagcaaagccaccagatgaatttttggctgaatcattttttttcttttctagtttgattcatatgtgagtaattttatcgcttgtgtgtgattgagcatgtaaattttttcattcatacgactattttgggatacagattaacaatactcttagtatcagtctacacggtggctacgagatcatggttgtatcgagaggaaggtggtaattgttttactcgcagaccacgaaatctcagtctcttatactgtgtattgaacacatcagtaaacatattactacacggtggctacgagatcatgggctatattgagaggaaggtagtaattattttactcatagaccacgaaatttaaacaatatttataatattggttaaagaattactagcattgtaagctggtaatatttcttttatgaccatctaggtattgcgttatacgatgtggaggcattaatgagagtaaatttgttacttttggatgagtaaatgtgggaggctgggagtaaatgaaaaactccacggagtaaattcgttacttttgaaacgtgcggagatataaaaaaaggaaaaatcggaaagaaaaattagatggtaaatattttacaaaaacgtgaaaatagaaaaactatagagaaggaatgaaaaacaaaaaaatctggatggttaatattttaccaggcccattgatgaagcatggatgagatggaaaagtgaaaaaacatagaaggtggggtggtaaaaaacaaaaaagacgaaccgagaaaatgtgggatgcggaggaaaggtggagtggtaaaaaagggaaaaatcggaaggacagggtattctgcggcgctcgaactaatattccgcactgtagcgcgtggaatagtgctaccattaatgttgtaatattatgttaaacatattggttatctttcgtgtgattatattaaaagaggagtccatataagttacaactttgctaattattaatttagaatagtagaactgaattaatagagcgcaaaattgagagtctaagatgggtgtaaaatatattactaccttcgtctcaaaatataacaacttttagttcgatgtcacatatcctagtactacgaatctggacaggtcactaggatatatcacatccaccaaaaaattgctacagttttggacggagggagtaatattgattacttgtggatttcaaaattataaatttagagcccacactattataatgcatgatttattttacacagactcgcaaccccatgcatggctcaagctaatattgttgatattaaaaatattaagattgctttcatatcttatatgtcttggtttctttcattattctggctttgctgaaaagaagaatccattccattttcaattttcttgttattatttccgaatttaggatatattaaaattttaggtatgtctataactaaatagtccatggtagtaaaatttgaagagtccatgatattataattaatcaataacacactacatttaacacgaatcctctcttattataaagttataacccactaactcctaaagtttaatatgcaaagatgccacatcattgtccactaacaatatgccacatcctcatccactaacaatcattaaatttaaacatcatacaaacatattatattatctataaatttataatttgttaaattttagagcttttaaaatataaacatgttaaatcatcatcccgtataattcacataatatttcaatatatatcttcattatttttacaatatgctatgtagctatatagtttatcctcacttagttaatgttatttctctcttctctcattgagtcatatcacatcaattgtttttagtgcttaaatgattaatctatggtctaaattatcacctcaattatttttagcctttagaagattaatctacggtccaaactatctcaatatttttcttctttcataaagtcatatcaccttacttttacatttgaatcattattgtatatactatttaaatttaaattatcataaaccacgttaacttatataatattatattgtctagttatcttacacgttatttttacttattattatcgtactagactcccgcagcaacgcacggggtttcacttagtatttagtacggcattgataaccaactaacaaacagtcgcaacttcttgattggtattgcttagattttaataaaataacacattgactttcgagcatgtaaagtaaaacttcatatttgttgttttgaagaataaatataaaattataaatttaaccatatgcatggatgaataagttggcattgtcatccttgaagaactaattaagaaagtatattttttaattgtaaattactttttggtgttttacaatcttgaaatatcattggcgttttattttagtaaagaaggaatagtgagttaattaaaactgcaatgtaattatttatatatttgtacaaacaatactaacttaaaactataactatgttactcttctaaatctattcatgaccatggattattatgctgtggttatttctggtagttgtatcgatcgtgaaatcagcgaatacatattggatgccaggacaatatgcttatatttgttggcatcttctcagcacatttagtacatgtcctcatcgagggttcgcatcccctgcctttgggcataacggcaagtttggatttcgctggtccatacatacacctcaaaaatcacttttttctcgaacggaagacctcttagacatcatggttgtggcccactgtagctcaattttgttttatgtccatcatgaatacctgcatcttcaagatttattatccacaatacatatcattagggaatgtatgtgtgtattttaacaaatgtatcagttttttctcattggacatggaacaaatggaattaaatttaaaaatatactgttcatccaattttttgtcaggaatattcgggatgcaaaagtttgtggannaannnnnnnantaaaacctttaagtagntnnnnaanatttttttgtnnnaatagnannannnnnnttttnaattttgagagccaaaaattgctactttactaggtgagtcacttacttgtactaaataaaaaattttttttttttttgggaaaaaagggaaaaacccccccaaaaaaaattttttaaaaaaaaaccccctctttttttccccattttttcagcctagcacaaaaatgcaaaaaaaaaaagtgtacatgcatatgcatctagcattagtttgatttcagtcttttatgtgcatttgattttggtttgcatatcatgttaggttcatgaacatgaataaaaggacaacttcactagacaaacccatggtcattcttgtgacgtaattataaggacatgaaagtgaattcaaataataacaactcagttcaagtcaagtcctaatacaagtctttacaaacatttagatgcatttatataatgagaacacttatataaataaacgccttgctaattattgaaaataatttatgcaaggtaaaatcatgggaaaattcatgtagtctctactcaacacatacaattcactataattttattaaaattttaacacttagaatgatacctcgaataaatcagtcaaaccagttaaatgatagaccaattataatccttaatcggctaaaacctgcctcaccataatgtgcattaaactgcataaaagtgtatagggtaaataatttattaaaatactaggttatttatcatgaataaatagaatttttacagaatttatctactctgttcaaatctcctaaaaattcaaacaaagttctaccgagcccatattctccaattttctgagtgcaaaccacataaaatttttaagagaaacaaaataaaatggaaactaggtatcttcagctacctccagaaaaatccacatgaatttatcgtgcccacaaattaacctatagattacaaagagagaagagagattcaaatcctgaaaatcatccaaaatggattaacacccaatctcctacccacctctctcactccagacttgttcccttcgccctggacccacttggcagcctccttggcttgcccttcctctgtctctcctctccaaccgaccaagaacacgagagagaagaggggacacgccctgggcgccggtcgacgcgtggccgagacgcgtggacgcccagttctgcatctctagctttctcctcctcccagttgcatcgccacacatcactcaccacccgtgagccaaagaaaccgagagggagagctccagctctcctcttccctctcctcttcgttgccggccgccaggaagaaggacgccgcaccccatcgtcgagacatcgccaacaccaaatatttcccgttccgtattctaatcttcatgccgaacaagtttccttttgacaccatctcatttcatccactgcagcgacgggaacgccatcgtgcccacgggagctccagagcgcgcccggagcgccgccgccacgacctcgtcgctgtcccggcttctgtggagcgaatccggtcgagccgtcgcgctaacatcttcccctcgaggtcctctccaaatgccctcaagaatccccaagatctgagcactgaggagagagatcgagctattcttctccaactccggccgccgagctccatctttgattcttctttctccggtgagctccaagtcgattccatgcatttcctaggacctctttaacaccagagacatacatgcatggcacttcttgtagtgagtcaagccgacgccgttcatcgagaaggagcgccgtcgccgagccgttccgaacgccgtcgtcgacgaccaagcttcgccaacctcatccaatactactgtgagcaccctggagcttctagagttgcatgcatgcattttatccacctagatccggcctctaacgtgacatgcatcactaccccgagacccaaagccactcgtgctgccgtcgccattgattccggtaaccacagatcacgataagaccaccattggcttcgaaaagaacccctattccttttatattttggtttcatgccgagatctgccaccgttcgccgccagaaagctcgagaacgagctcagccatggctagctctgtttcagctcgaaccagggacctctgtggagaagaaacaaaactgtagatactactttgtaaaaactaccacacacatggaacagtcataggactgcggattgatttcctgaaaagccagggaccttttgcatattggtctctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagaaggatgaaatttaatatggaaacataaaacttggcacttgcagtataaatttcacctctaaaatttgtctaagaaaaactatacataaagcatgcacaaatttacaaaatgtatagagaattcatttcaacttaaattgaagcaaactcaacttccacagattcatcaacttactctctaaggtaaaataaaataaaaagatgcacttgctttacaccaaatacctctaaatgtatgttatacaaaataactaattttagacaagctgaactttaaaaatttatataaaattcatcttacttcctttttgagtaaactcaagttctgtagaatcatcaagtttagcactttagatatataaaataaaaatatatacttacagtgcaataaaagcccctaaatatttatataaggaataaacaacttagagcacccttcaacttctaaaatttgtagagaattcatctttagtccaaatggaatgaaccaaatttctttagaactagcaagtaatgaactttaattaggtaaaataaaatgtggcaccttctatactaaatatgtcactaaactttaaatagataacttcagtgctagtcacatggtataggttaggcaatacatatgtataaatgtatatataaatgcactctagctctaagtaaccaaaataaaacttgatagaccagagaggtcatagttctatccccaaccaccaaaaacttagcacacttagctcatatatcaatttctagattggtatgttaagtaactaacatagaacactcccctagcgtataaaatgtgtagtagcgtaatataatctctaaaattgtgaactaagattatattggttaataaaattagtcattttatacatcacaaacaatatgaaacatgtactggacataaaactccaaaaccatgtacacatagaagctacctacctacaacacgttaaaacttgtaaaatacataagaaattcataataactctaaaagttatgaaaccaaatgtgttagtcttagaaaacacatctctacacccctgagaaatcaaacctaataaaaatcactttgcaaaaatatttcataacactacctaagtaaataccaccctgtaccgagtaaacttctaaaactcataactcacaaataaaaagagataaaatataaattctttcacctaaattcatcttagatcagtacctacccactgtgcacaaagcatgcattttagagcattttgaatttttacctattttggtgtttaattgcataacgtgtattttatatagataattgcgtaaatgatgaagaagtgaattaggtgctaacatttcccaggaacaaggcaagttttctcctcccaatctttgatcacattgaatcccatgttttgaggaatgaaaatatatttgtttgcaaagttgcatatgaatttagactataacggtatttgaaacttggttatggtagctatgacctaattgctgcatttacttctttgaataattgtgatcctcactgattgtaaccttagaaatggttacttagaaatggttagagtactttcaaagtgctcaattgggtttatacatgcttacataaaagccttacgcttagccatgcctagtagtttctaaataatttcatgatcacttttaaaatgagaatttaggggaaaattttcactgctggacagaggtgaatatctctgatatttgtgaattaaaaggtgtaaaagtgtgattttagacctgggcggcaagtggtatgcatatggtgttagttgcatacctataggggaagtgctcgccctagtcaattaaggaccgaactttgtgtcaccatctaagtataccgtgcaaccacatgtgctaggaatgggacggccttagcttattaagttgtttaatgtctaaccttgcattgggaggcagtagtagtatgaactagtcggaatgatggtttataggagctacctagtgcggttgtgcctaggcgtctaagcgtgtccaatataacggttaatataacggttaagtacctcgtggaggaatggatgtgttcgctgccatggcgctagggatggcgagggccccccgacctagcggcacttgggttgctcctcgtgtgaataaacacttgccgtgctcgtgcaaggttaggcattagacaatgtaaaggctttcgttatgacctttagaccacattcaacgtgaagaatgtggtagagtcttgcaaactcgaaacaaactatagtgttcatatcatgtgggtaaagctgtacaaactctgtagagttctttaaaactaatcgattagccatgctcacggtcatgagcgctttggtgatgtgtcatgagtatagccttgtgttgatgaaacttgggattgaaatggaaaaattgtgttgagttgtgtgagtgatgatgattataagagttgtgccattgaaggcaacaagagtatgcttatgatgatatgttgttatatatgatgatatattatgttaattatgatgaacttacaaatttgttaatttaattgaatcaactcctttacaaaatatttgtgaaccaaaacttgctttatgctgaaattaaactacatattgtcctttgaatatatgccttacatgtagtatgttaggattgatttttggcttgccagtacattaaggtactgactcttgctactggaataatcttttgcttgcaggttagacttagtcttcttgagtggtgcgggtttcgattgctttttctaggacttgaacttaatggggtaaacccttaatcggtgtgcttgtggttgggtagtcaagcttccgctgttctctgttatctatctatatttggtcggtcggcctatgtaactataaagtagttgtaaatttgaatcgctttcgtcttatttgtatttgctatgcataaccatgcttaagaagaaagtgtgaatctagtacatatcctaggaacaagattcatatgagtatgagttaaggatatttgaggtatcgtagatctttagcccatttgacaagtctcctgaatgtgtaacacatctgatcgtctccttcgtgtggtttgatgggcacatctcaggctgaagttgactggcaagctaaaggcccattaatgtctctaatatccttctctcgaggcgtcggatgttttattacgtttgtttgatggcttgaattattcactttatccctcaaatataatgagaggtccggagagcctacgacaaatataccgtcggtatcgcacagccattgcgcgaaaataacgtgggaaagacgtcgcgtcggtatcgcacagccattgtgcgaaaataacgtgggaaagacgtcgcagacggtatcgtgcggtctcgcacgccgcgctgtcgctcgtgttgttgatgagttgattttgacaaagaatgtgttgaaaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcgtgttaaacacatggaagaaattgttaaacaagataaggtgttttcttgcccaacttgtagaaaataaaaaggtcttttggatgcttgtaaaaattgtgctattcttacacagaaggtttcttatttgaaaagttctttgcaaagattttctgatggtaaaaagaacctcaacatgattctggatcaatctaaggttagcacacacaatcgtggtttaggttttgattcttatgcttatcatgctagacatcctcctattattttgggtgttgctaggaggtgaaattttgattggatctgagcctaagaacactgtgtttaaatttgctggcatcatgtcttctttaagtgcatcttcatcgaaatcaaatgttgtgaatgcaaaaccatcaatttcagaatcatctacttcacaaacttgtcgtgaaaagtacacttattctttttgtggaaaaaatggacatttggttgttttttgttttagacttgcccataaacagaaaaaggaaagagaaattgcttttgcaaaatgacattggcaaaaatcgggttttaattcgaggagcacagttagaccgacattgtccagtcggtcagaccgcaggtgaacgggcggtcagaccagttgccaggcccggtcagaccgcaggtacagcggcggtcagaccggccttggggcaatttttcgcatacttcaaatcggacttttgtgaaacgacaaggtaagttttcaggtaagtctggttctgattttattagtgcatatgtatctactggttctactggttgtgtgactcagtgttggattccaaaatttcttatttctaaccccaacacagaggcgtcgacatcttctcgtttgtaggtagtttggtggcatagtccccatgtgcgttcaatgttgagatgacgattgcttttcaaggtaacatcaatttacttttggattgacataatattgttctactttcttgattattagcttttcatgtgctagtgtttgagattgtagtttttgttgatactaatgaatgtatgtcaattttgagagtatttgtgatatctttggcaattggatgtctttttcaaaatctttgatttcttcttgatttttgttcggggagaattggaggttattttgagggggagttagtgctttttatgactttcttttggcatgatttaagggggagtttatacctcatggttttatcaagcaaaaatatgacaatgaaaaaattgataaaagagagctttgtttatacatatggtattttcttgtgcatgccagcaatactttgaaggtttatttgtctctagcatagcttgtatgtattctagtcttttcatgagatttaaattttgcttttaagagagatgatgcatgacacttaaattctatacttgaattaagcaaatatgcaatgttgatgtaaaagcatatggtttgatttctaaatgctatatatatatatgttttattgaattgttattcctcaaatagctttaattgctcattgtgaaaaagagaataaaatatgaaaaaatgaataccgaatccttggaaacagtcttgacgacaaagacgtattcgatgtgagtaaaataatgggtgccgaatccctggaaacagtcttgacgacagggacgtactcagaataaaaaaaagagaaaaatatgagaaaaaggctcaagaaaagaaaaagttaaaaattctctttgttatgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttgtttgctaacaatgagtcaagtgggagatagcttggtctcggaatatggtttctttgtttgtttcatgtgtaggtgactcaatgcctcgagagagtatttgcggtgatggtccgggagtcggcttggtgttaagacaatgtccgtggtagtcagatatcatgcgggatactaaggctagagttgatgcacgtggttgatggagattccatatggcatacgatggaggtattgtgtgcgtatgggatgcggagtcgaatttggaagtagtccaaatttggtatgattggttatgtagagtttgtttcttgtactaggaggtttcctatggggattaggactcttagtatgggtttggttcgtggctttaggctgctgtcttacaatgcatcgggagaatatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgctgagtcgaatttggaaggagtccaaatttggtacgaatggttatgtaaagtttctttcttgtactagagggttttctatggtgtttaggactctttgtatgagtttgattcgtggctttaggctacctacctcatgtataaatagagggggagcgtgaggcttcccggtatcacttttgtatagcttttgagatctagtttagttagggtttcgagtttagtcgagatttttgtaaggagtgctgttggtgcactttgtaaacacagagagaagcaataaagttgtcatctactttgagagttcttcgatttgtgtttcactgggtttcggcggtctaaccggcgatatactggtggtcagaccggcggcgctagggcggtcagaccggcggcgctagggcggtcagcgacaggtgatctcggcggttcgaatggactttgatctcggtcagaccggcgtgttccaggtggttagactggtacaactactttggtcagaccgcgagccatcgatttcgagggtaacttttattgccgctaaaagtttttggtttttgggtataccaatcattcacccccctctggttggcttagttcttgtgattcgatcctacaagtggtatcagagccacgtttgctctttttgatctttaccgatcttgagtttttgccatggctatttctaataagtttacaactaagcctcatattttcgatggaacggatttttctcattggtgtagtaggatgcaatcttacattatggctgagaattatgatctttggagaaaagtttctcatccttatgtgattcctgaagctattaatactgctgctaaaaaattgtttttgaacaaaattgcaaagctcgcaacattcttttgagtggtatttctcgttcggattatgatcgtgttgcttatcttcaaactgctcataagatttggattgctttgagtaattttcatcaaggtacaaataacattaaaaaacttcgtcgtgatcttttcagaaaggaatacattaaatttgagatgaaacctggagaagctttggatgactatctttctaggtttaataaaattttgagtaagcggtcagaccggccggcgctgtgtcagtttcggtttcgggttgtttgtttggatattcgtgattgtttcatggttatggcttctagatggatactacacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagtttagtcaaaatttttgtaaggagtgctgttggtgcactttgtaaacacagagagaagtaataaagtcgtcatccactttaagagttcttcgatttgtgtttcaccaggtttcggtggtctaaccgacgactcatcggcggtcggaccggcggcaaggcggcggtcagaccggcggaagcgaggcggtcagaccggcgatagcagcaggcacggtaggcgatctcggcggttcgaccggagttcgatctcggtcagaccggcgtgttccaggcggttagaccggtgcaactacttcggtcagaccgcgatccatcgatttcgaaggtaacttttatttccgctaaaagtttttggtttttgggtatctcaaccattcaccccccctttggttggcttagttcttgtgattcaatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaaagctcgcaacattcttttgagtgatatttctcgttcagattatgatcgtgttgctcatcttcaaactgctcatgagatttggattgctttgagtaattttcatcacggtacaaataacattaaagaactttgtcgtgatcttttcaaaaaggaatacattaaatttgagatgaaacctggagaagctttggatgactatctttctaggtttaataaaattttgagtgatcttagatctgttgattcttcttatggtgctaattatccacaatctgagatttctcgtcactttttgaatggtcttgacatgtctatttgggagatgaaagttacatctattcaggagtctgttaacatgtctactttgactttggattcgctttacactaaactgaaaactcatgagatgaatattccttctcgtaaaggtgattctaagtctagtgctttggtttcgtcttcaacttctttggatcttggtgcttcttcatcaatttatttaatgccatgtccgatgatcaacttgaacagttcgaggaggaggacttggttttgctatctaacaaattttctcgagctatgaaaaatgttaggaacaggaaaagaggagaaccgaatcgttgttttgagtatggagcacttgatcatattcgctcgcattgtcctaagcttgggagaggcaagaaggaagatgatgggagagtcaaagatgatgacgtgaacaagaagaagaacatgaaggagaaggagaagaagaagcattgcatgcagtggttaattcaagaactcataaaagtttttgatggatctgaagatgaagatgagggcaaaggtaagcaagttgttgatctaggttttatttctcgtaatgctagttctgatgttgataaatctgatgatgataatgaagaaaagcttagttatgataaattagaacttgctacttaaaaatttgctaaaaaacttcaaacatgttctattgagcttgatgagaaggatcacactgttgagattttaaatgatgaaattgctagattaaaatctttgattcctgatgatgataattgtcaatcttgtgaagttttattttctgaaattaatgctttgcgagatgtcaattctgttaattgcaaaaaattggaatttgagattgaaaaatctaaaaagttggaatcttcttttgctcttggatttgctttacatgctcgtgttgttgatgagttgattttgacaaagaatgtgttgaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcatgttaaacccatggaagaaattgttaaacaagatgaggtgttttcttgctcaacttgtagaaaacaaaaaggtcttttggatgcttgcaaaaattgttttggttggtttttgttttagacttggccataaaaagaaaaaggaaagagaaattgctgttgcaaaatgacgttggcaaaaatcgggttttaattcgaggaacacggttagaccgacactgaccagtcggtcagatcggccagcggtcagaccgaccggcggtcagaccggttgccaggcccggtcagaccacagggacagtggcggtcagaccggcctcagggtaattttgcgcgaaattcaaatcggacttttgtgaagcaaaaaggtaagtttttttggtaagtctgattctaattttattagtgcatatgtacctactggttctactggtcgtgtgactcagtgttggattccaaaatttcttatttctaaccctaacacggaggcctcgacatcttctcgttcgtaggtattttggcggcatactccccatgtgcgtttaactttgagatgacaattgtatagcaaggtaacatcacttacttttggattgacataattttggtctactctcttgtttattagcttttttatatgctactatttgaggttgtagttttggtttatactattggatatatgtcaattcttgagaattttggtgatatcgttggcaattggatgtctttttcaaaatctttgatttcttcttgattctttgttcggggagaattggaggttattttgagggggagttagtgctttttatgactttcttttagcatgattttagggggagtttgtacctcatggttttatcaagcaaaaatatgacaatggaaaaaattgataaaagagagctttgtttatgcatatggtattttcctgtgcatgctagcaatattttgaaggtttatttgtctctagcatagcttgtatgtattctagtcttttcatgatatttagattttgcttttaagggagatgatacatgacacttaaattctatttgaattaagtaaatatgcaatgttgatgctagcatatggtttgattcataaatgctttatatatatgctttattgacttgttattcctcaaatagctttaattgttcattgtgaaaaagagaatagaaatatgaaaaaaaaatgaataccgaatccttcgaaacagtcttgacgacaaggacgtattcgatgtgagcaaaataatgggtgctgaatctctgcaaacagtcttgacgacagcgacgtacccggaataaaagagaaaaatatgagaaaaaggctcaagaaaaagaaaaagtcaaattctctttgttattttgtgctaaaggttatttgagaaagaatgataaatgcaataggtatatgtgttagtgtttattcttcaacctatgtgcttgttaagatgttgcattataaatcgtatgaaatcatgatttttgattgttgattcaagcttaattgtaaaatctttggttcatggttatactttaataaatgcttgttatattatagatggattcatcttctttttattgcaacacatgacatgatatgctatatgtatgttaagctcttatactttaataaacataatttctatgcttgatgaaatcattggcaaaagggggagaagagatgagttttggggagaagagatgtgttttgggagaagagaagagtttctaagaagtgcatgtttttggttcaattgggaatttctttctttgtttttggttcaattgggaatttctttcttttaaggaagcaataaagttgtcatctactttaagagttcttcgatttgtgtttcaccgggtttcggcggtctaaccggcgactcaacggccgtccgaccggcgacaagcggcggtcagaccggcggcatacgggcggtcagaccggcggtggcgacagcaagtggcagttgatctcggtggttagaccggagattgaatctcggtcagaccgacgacaaccaggcggtcagaccggcagtgtaacttcggtcagaccgtgatccgtcgaattcgaggataacttttatttccgctaaaagtttttggtttttgggtatatcaaccattcacccccctctggttggcctagttcttgtgattcgatcctacatgtggaaccatcagaggcccacttgtgaaaatcgatttttgcgtgtggtgcttttaaggagccgtatgcaaaaacggaagttgatttttgcagaggtaaccagtcatgatttgtatgtaacctaaagaatgtcttattcagaataatcattactgtagtagtgtaacttatattcacggtcaaatttgtttttttcgttgtgacgtgtaaaagttgaattttaacttgtatctttacgaagtgatatatcacatgttaatacatcttctcaattttttataactatttgaataacttacaaacaacgaggggatatcccctcgagagttaaaatccactcctagttgatcagccactcaacaaagagtgagcatcatagtgagagagataagagacggagacgaagcgtcgtgcttgcgagtatggggtagcaagaagagaaggcgaaccggtgattccgtgatttcctcaaaattctagattggacacttgggctttcctcttatgcggtggtagacgtcccaagggaggtagggtgacgtgggccgtagctgtgccggttgtaagatcaacgtgtgttttgattcttattctgtgatgaacaattggcatatgtgattattggttttgttatttggagattatcgtcgaagtggttttggatgattggatttacaggtgctattattttatgtggtccggtccgaccggacggtggttgccgctcagaccggagctatgtgagcggtcagaccggccagtctgcggtctgaccgcccgtcgctgtgtcagtttcagtttcgggttgttactttggatatccatgattgtttcatggttatggcttctagatggatacgatacgtatgtaatactgttatttgctaacaatgagtcaagttggagatagcttggtctcggaatatggtttctttgtttgttttatgtgtaggtgactcgatgcctcgggagagtatttacggtgatggaccgggagtcggcttggtggtaagacgatgtccgtggtggtcagatatcatgcgggatactaaggctagagttgatgcacgtggttggtgaagattccatatgacatacgatggaggtattgagtgcgtatgggatgcggagttaaatttggaaggagtctaaatttggtacgattggttatataaagtttctttcttgtactagagggttttctaaggtgtttaggactcttagtatgagtttggttcgtggctttaggctgcctacctcatgtataaatagagggggagcgtgaggcttcccggtatcgcttttgtatagcttttgagagctagtttagttagggtttcgagtttagtcaagatttttgtaaggagtgctgttggtgcactttgtaaacacagagagaagcaataaagttgtcatctactttgattgttcttcgatttgtgtttcacagggttttggcggtctaaccggcgatatactggcggtcagaccggcggcgctagggcggtcagaccggcggcgcaggcaggcagcggcaggtgatctcggcggttcgactggagttcgatctcggtcagaccggcgtgttccaggcgcttagaccggtacaactacttcggtcataccgcgatccatcgatttcgagggtaacttttatttccgctaaaagtttttggtttttgggtataccaaccattcacccccctttggttggcttagttcttgttattcgatcatacacgggtcgccccatgccacccaatggtaacgtccgcccctgataagagctgagccgaacctatagccaacgagcagagacggccatcccttgagctgtggttgtggtggagcgaggcggccggggccaatcctatttgatacctcgggctgccttcccctcttctttttcttgtttatccctgaacaagatgcaaatgaagcaacacattcaagctatttctttggcattcttttcgagttctgtaacattaatggatattgtaagcaagaagattttatgttgagaatggaaggtattggaaaagaagctattgagaataggctagttgaaagtgatcaggatagcgagccataagttactacaacacagagtatcacgtcgtggcctgagttgacgtcttaagagagtggttgacccaacgagacatactatcgccgtccgaaaatactcatcgtattaagtttttattgcaatgtttgaccattcgactcattcaaaagattatgaaattattatttatttttttttcacttgctttattatcaaaagtattttaagcatgacttatctttttttatatttgcactaattttttaaattagacgaatggttaaacattataagcaacaagttaaaacgacatctaatttaggagggatggatgtagtaaattcaagcaagtagaatcctgaacatgcatgggcatgagtggatgacatggagactgagaagtgtccaatttcctgagttcaaggacaactatgtagacagggataccctactagttgtttgctaaggctgtgtttagatctggggggtgtaaagttttgatgcatcacatcggatatatggacacacatttgaagtattaaatatagtctataacaacacaaattacagaatccgtctgtaaaccatgagatgaatttattaataagcctaaaaatctatcattagcaaatatttactgtagcatcacgttgtcaaatcattgcacaattaggcttaaaagattcatctcacaatttaaacgtaatctgtgcagtcagttattttttcgtctatatttaatactccatacatgtgtcgaaatattcgatgtgacagggcgtaaaattttacaggggatctgaacagggccttaaacaattgttttttagataagtatattttttacacggcctctttatcgaaccggatatttgcagccatttaagttaggaacttagtctctcaaacaacctaatttgaaattcgctcatatggagatttaaacttatgaccttgaggtgctatacaaatcactgaaatcactaggctacatggggtgcttaaacaattgttgctcatgatatcttactttgtgaattttgatgactacaagcagcttgtgcaagaattggattgatttggttacaccacacattactcgaccagccaaaggtcaatccagccgaagctgcgcatgctttaatatcaattcaactagtcaaattcaacgcacaaaaaaactgaatggataaaggtggaacgaccaaagttgaaagaaagcttcattaaagagtatttgcaggtttatgttacaaattgtatgagttgagctgtacacatccataagtttcagtgagtgaaattgatttttttataaaaactaacaagtagtactacttaaaaagaaaacattattcatcgaggcatgaaaaacaatgccatcgatctcatgtttattttttctttccatgtcttatgctaaggctgagttagaggagaggaaaagagggaattgagaagatacgtaaaacgagatatgcaattagcgtatgattaattgagtattaactactttaaattttaaaacagattaatatgatttttttaagtagttcaggaaacatacatgcggaaaacaaggtgttttctctctcaaatctcccagtaacgaaagcagccgtgtagttatcgacatctgtaggccatctaccctatatgttggatacgtccaaccaagtcttccgtgaaagattatgtcatctttgatgacactgaagctcagtcttccggtagcttttcttttttttttcctcttctgtgcaggggggttcagggcctaacaattcgtgtgtgttttggctctgtatattctccatgaatatagaggctggatttgatggcgatataaatatagcaaatctgttgattttttctcattaaatcatgagatgcaaggtagcgggctgctacagattgtcgtctcgacagtgacataatattgattatcagatggatgcgtggtatgagaggcgatgggatggtcgtaccaagcattgcagctcaataagaggtggaggtaacacggggttgttctccggatatctattcgtagcagcacaagtcaacacgaattactagatttgtctaactcttctcccccagagactttggtactcatgtcttgttgcagccgcggcttgagagccatctctaccatcaagcgtctaagcttgatccgagtaatatcatcggtatataggagtaccttccatgacaccaccgattcccatacataaatttaaaatctgtaccatacaaactagtgggagaagagtggttatgtactccagtcaaccaacaagtgtatgctatatatcgttatttgtccttatatagactgaagagggtgggacaggaaaaccacccaaaacatgtttaactgaaagtatagaggacaataatgcatggtgtctgagacttattggcttcagtcggattagagagagttctttattttgtcatgtcaaggaataactaaaacagagtacaatggattggtggaatataaatgtagttctatttcctttcatattggtttttactcccaagtagtttcccctctctactccaaatcttcgagtcatccacagacacaaagtcacaaacaatgtgcaataaccagtccttgatcaaatcctctgatttatgccttcctaaatcttaagcagattaccttgtgcatgtaagtcccgaaattagatgatttttcaagcacattcttatcaataatttcgtaaaaggtgttgatgactcatttgaccttgtttcgtatgctaagtatcaatctgaccctactttttttaatttacttatttgactccactttttgaaattaaagatgaaagctgaccttattccgttaaaacgagttaacattgttaaccaaggggcaagtagtccttttgcccttgcttatttaaccatattatataaaaacatccatatattccaaccttttgacataattgtaacgaatttgacatatctttcacatttgacacaagtttgatagatttggcttcaatttgataaatttgaatcatattgaaaaatttggcggagtgcaccaattttgacacaagtttggtacactgattttgctcttgtggtggtgagaaagcatagccaacaaattagaagaggaagccgagaacaacaccaccataatcttctccccacgctcgtcctactcgtccctccgtgccaccgccgctctctccctctgtgtgcctgcggagccgctgcctccatccatccacccgcctgcgctagcaccaccgccccctcctccctcagcatgtcggagccaacgccaccccctccctctacgcaccggcgctggctctaccgttcatgccgagagagacgagagagcgataagggtcaggcagggtggtacgagatggataagattgaaggagggtattttggttagtttgaataataaatagatttattttctttttcctaaatgaaaccctatcagtatattgcaaatatagtcaaacggtaggttcaattgtgaaaagcagggttaaatcagcaacctagaaaaaaataagatccgattggtagttagccttcgaaatagggtcaaataagtaattattcgtttcctaaaagtgatgaactactcgtagtagaatatttcttctactggtaatataactcacaaatgaacggttaccatagtagtgataatatgggtagaacgataactaccggcagatacccatgtaaaagtactccaattggaattatttgtagcaaatattacgaccatttttctgtagcactaaatattgaactagtctgaaaatggttgtgactttttaattaatttccaaacaatcctaccacaattggactccattgaagctacaattaagttttttgttcttcacatttccgaaagaatgatcaggttatctgatttgaccattaattccctatggagatatacattccaatatcaatatgcttttgttctagagtttgacaatcactacacaatgggggtcttggttctattaacatatatactcctacatctatgtgccagttacataccttgtgatgtataataagcccattaattgatgcaaaatgcatgcaattcggccgtggtaagagaagtcgtattatttctacagaaaagcaagcagagggcaggagtgattctttattaagacgactgaatttttccttctgccacgtggtaatgcaattcatttcattttattgtatttgttaacattattggtgacttcaataatatcgatctccagtatgtattaattaagaccaataatatatatatagtaagtggagttcaattctaaaaactctgaaaaaacaataacaaaataagtatgtgctcttgtgtacctctcgttgctcaatacaatgaaataattatataaaactatggaaaataatgacaaaagttgggctgtgtttagatccaaaatttggatccaaacttcagtcattttccatcacatcaacctgtcatacacacacaatttttcagtcacatcatctctaattttaaccaaaatccaaactttacactgaactaaacacagcctcgaagagagaaggttacgatggttgcagtgaatctccaattccactacctacctaatggtaaattttgcaggttagcccttcaattttatcatattaaaaaacagtgaaatctaaatgaaggtgataatataccctatagaaaaatatggataacacatttaatgaaaatttggtactaccaacactttggtagatatttctattgatttaggaagttctggaatcaatccaaacaacacataagtagtatttagactaccaacaatttggtagtgtaagatttggcactaaattaaaagagcccataatgtattttaattctgagatctatggattgaattgagaaatgcatgtccgtagaggggaatgacattataatccatgctactactttttttctctagatttacaaagtgaacttcccatattgtttcctcatttagtgtacagagtaacaagatttactaaaactgtttgtgttccatacaatttgatctactgttcagaataagaaccaacaacatacccatgtaaaaaaaagagtcataacacaatataaatatttcaatagaaaacataagtaatcgaatttgatacatcattagcaggacataaatatgttattagttttgctgaacgtgcctatgcaaccagcttgccagctactagctagttgagcatacagtatactcccatgcctgatgatcaccgtgatactctttagtgcagcaattcgcatagtctcacctcagcatacatgcccagataacgccattaatatatatagatctgtcaaacttgctgctaacccaagtaattggcagcaaaagcattagtcccggttacccttaaccatcatcgcttcaaccttttgcttgagggaataagtgaataacaaccccactgcaaatggtgcaagcgttgtacgttcttcccatgacaccacccatttccatgtaaaactaaactcgcaagacaaacctaggtttaacaaggtcaggcatgagaagagtgtacaacgatcactgtttgtattactcagctgatcttcccctttgaactgtgcgtgtcaaatctctctctctatatatgtaacaatgacaaaacatatagatacattgtgttataaatagttacagagacttaatagcagagtgaaaagctaatagcagggtgataagcaagctggctgtcagtggggacagctatgtgtatctattgttcaagacaattaaggggatgtttaaatcagggtctaaagttttagcgtgtcacatcgggtattatatagggtgtcatatggggtgtttggatactaataaaaaacttaattacagaatccgttagtaaaccgcgagacgaattattaagtctaattaatccgtcattagcaaatgtttactgtagcaccatattgtcaaatcatagagcaattaggcttaaaagattcgtctcgcaaattagttgtaatctgtgtaattagttattgtgttagcctatatttaatactttatgcatgtgtttaaacgttcgatatgacatggtgaaaaatttttgggtgggatcttaacagggcgcgcgtaagttagattggttcatgattggctgtaacttttaggacgctataatcttgttcgtattggtttattacaccagattaaatcactctgctcgtatcaaccactgaagtagaacttcgtactgtgctatctgttctcatatcactactgatctttgctgggtggtgcaaatagtcccggttcgaatagaaaaatagactaaacatcatttttagctctggttaaaaagccaacgaaactttttgatctttagtcttagttggtgttaacaaccggaactaaacatcatttttagtctcggtttgaaaatttgtcaggccgtgtcaggtcccattatttttagtcctggttagtcaacactttagtcccagttgtttataccaaccgagaagaaagattgaaaagaaaactaaagatcaatactttagtcccggttgtttgtaccaaatgggacaaaagattgaaaagaaaactgacagccgcacgccaccccctccctcgtccttatctccttgcacgcacaagcgaaactccctccctctctctcgctcccgccctccccctacctccttatctcctctccctgtgtgctccctccacctccctcgcaagtgact

SEQ ID NO: 63859 - DNA, 711 bp, Oryza sativa
atcatccacagtatcttcaattccatgtgccagcattcttatctcttccacccagatttcatacgtctcattattgcgattgcgtacatccattcgagaaaggaattgatgtatcagcctgagctccctctgatgcggcccatgcttccttgaagctctgttatctgcgaaacaaactttttgaattttgaagtagcttggttgattgcttcatttcccaaggcaacacaaatcttcttcacagctaaaagaatcacggcttcagccattaatttctctgcacaaaactttggggacagccagattccgccccaggtatagcttgagtatataatttttcaaatatttttttatgcagtataacctgaaatataaaggattgtcataagtgctacacttgaatgccagacctatcaaattcagtggtagacaggaattggattttttatgtgagaagagggcctggaatctcggtaaaagaaatattcaaacgattctgcaattgaaataagaaattttagcttcaaataagaaattacctttttggcgttttccttgggctcatcactgcatatgaaaatgaagcaatgatacataggaaaaagatactttttagaaattcaagcaaaatgagtttacatctaatttacaaattcggtaaagttcagttttaaagctgatttatgttgacatacctgctattaatctgac

SEQ ID NO: 63860 - DNA, 65570 bp, Oryza sativa
  unsure (1)..(65570): unsure at all n locations
ttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaaatataatacatgcccacacgaatgcgcgggctacctttctcgttatctagaatgtgccatttggtaatgcacagctcaaacatcggtgcttggagctgtttgacatgtgcacacgcaatctttatatacgatttcaggggtggaaatgaggcgtgtgatttggccacgtggctcactgattatttagggttagttcatctgaaaatcagccacgtgtccctgtgcaatctcagatagtcagatcagtaacttctcgagctggcctgtcttctcctacctgattggtccacatggacttacaaaatgttgacacatggaacaaagacaagatgcagcctgcagctagcctgctagctacgctctgctttcatggttacaatcctctagatacttccaagctcgtagaagtatagtcaataaattaaattaagaacacctagatcgtttggacgatctcaaaaatattaaccctagaataaacattacacagcgaaaaacgatacagcacaaaatttaggaaaaactagaagaaataccataaattggaaaataaataatgacatgttatagtgaaaaaatagttgtcaaaagaaataataaggccaagactttcttttgagaaaaatcaacaactcaagtctagagcctagatgcttttgagctaagggtacaagcggctacctacaaaaacccacttataggctaaactaacctccgaactcgcttatcttataaaccgatttcagggttctaaccctggccagggattgggccacgtggcaccacgcatagaacaccagccggattctcggctggagaagcgtgacacgtatcccacatctcctgcagccatacgatagcatatcaacggtgagaaaaaggtccaacggacgtaaatatatattgcaagtttgagatggtttttttttttacaaaatgtgtgatctcatctaaaacggtctagaacagtcaggagtggaccaaaaaaatcctataaaaagaatctaataaaaaaatcaacgagtggttagccccccaagtggcctaattccatatttttgtccctaagcatagccatttgattaaaaatcttgttagaaaaaaatccagaaaacatagtactatgcatgagaaaaaagaaatctagagtggagacccattgcaatctagagagaaaatctggaattaatatatttgaatctttgtctccattaaagataaatctggaattaatacaaagcgaaaatacgaaaaggtgttgcagattgtgaagaaaaaatagggataaaaataaaagagccaatcttaccagcccgcgagccgccgccatctcccatcccacgagacgccatcgccagccatcaccaggcaaggagagccgcctcaattctagcttcttaggatgggaagagaaggacaatggcagatctggtcagccgacgaccttcgctagcgacgccatcccctctctttcttccccttcttccaccggattcgcccgtctcaacggtgcggacctgttgaaccggccaaatccaaggaagtcgatgttggaccgcaagcaacacctccgtcggctaccatctagttttgacctataagtgggttcgcgggtgacctgcttgcaccctaattttgagcgggtctttgaaactggagctcaaaaaataaatagagaaaacaatggaaaattaaaatgtaaaaaaaatagatctctaaaattgaagctccaaaaaataaagataacacaactgaaaatcaaaatatgtaaaaaaaagggagctaaaaaatagagaaacaaaccaaaatccaaaatgtaaaatttaacagcggtgcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaagacttgcaaaattattctgatcatgtcacaggctataaattttgaagcacgccaactggcgtgctgatgatttttctagttcttacttatttgtctgttttatcctttcctggccacttcgcatttccaagcagtttggtaagccccaagcagaaaaggagacaaaaattgatactctaatcaatttaaaatgaaaaaaaatcatcaaccacaaagttgatcttataacgtgtatataaaatttgttcccaacggacttcatatgaaacagtttacattttaagaggcagtgacggttctcctatgaaattttttttccacatgcggttttagaccattggtccctcttgtcattatgacaagtggatgttcttttgacccacttgtaaaatgaagctggactttttgaaaaacgatttttttaagtagtgatatcaaggtttggccaagaacatgatgaaagatattcacaatttaatcatgtaaatatataccatgaaatagttggtactagtctatctcaaaaaaaaaaagacaaactctagctacgaacctaaacacgcataagtccaggttcatagctatgattggttttttttgacacaggggcgtatgttgatacattttatctttttttagggtaaataaataaatccttacatcatgagtaatcaatgattgtgtgatgatgtaggccattgagattctcttggaaaatattttttttcagctaccatgaactagaaggtatcatacatttcagccgacgtccttctacaccaatttataccaacagattgaactgtaatataagatcaaattgcagtccaagcttcatcctatctgcttctctctgtacacctacccactagatatattgaactccaaatcaagacccaacacaacacagaatgcaaaaccaaccactgtgacttgaagtacagaggtcgcgtgtgtgtgtctctctctctctctatatatatatatatataaagtttatcaaaatactatctaggtatccacattccttcaaaatctatatattgttgttcgtactgcaagtatgatgccactattcaaccttgttctgcttaggagtgggcggcatcaggaaatgagatagaacttggcagctgtggtaatatgcacgcacaaagtgtaggccttcaaaatcatcaaactttgcttgtctcactaaactttttgttactaaagaagtttgtccatcttagtcatatcaccaattatgtatccaatggcaacatcagaaagagagcagatcagctagccgaatatgtagtgtacgttgtgatggcagacattgcttcctctgttcccagtcaaggtccggcacaaagtttagtctattttgagattaccgggttatgtcaagttggaaaggaattcatctaggaattgttagcgctagcgctgaactccgatcgaacaccttccgggcgaactgtagccgtccggcacagaaactccaagcacagctaactaacgaaaatgaaaacagagcaagaacagagtatcaaggaatttcagaacttagcgaaatcacgaacaaatgtggggcaattttctagggtttttcattcaactgaattgtaaaaccttacaagggaaaaatgaactgattgctacttatactctagaaacagaaagaggaatcctaggcctaaaatcgtgccatcccacgactcagtttctcctggactccatgcagatgcaaaatgccactccgcacgcctgacgcaatcgtcgccaccttccgcagcctcgctgccaacttcgtgcatgcataacaaactccaaacggattttattcctccagccgttacaactgtcaagactggatcacattggggccacagctgaaataaacagcaacaggaatcatgttattgattacatttgtggtgattttcttttgtgagatcagtagagacaacacacagtgtccggaaggatataaacacagactgatcgtatcacaaagcatcttgatatatcagatactatgtgctaccgagtgctgagtgttagaatgatagttcgtcatcctttccagattctgagatagataagattgaagtctcgctgctatatgtacaaacggtttcatacgtaggatcgaatcataataactaagccaaccagaggggggtgaatggttgttatacccaaaaaccgaaaacttttagcagaaataaaagttaccctcgaaatcgatggatcacggtctgaccgaaggtgttgcaccggtctgaccgcctaatgaacgtcggtctgaccgagatcgaactccggtcgaaccgccgagattgcctgccgcgtctgttgccgccgccagtccgaccgcctcgctcccaccggtctgaccgccgccttgccgctggtctgaccgccggtgagtcgtcggttagaccgccgaaacccggtgaaacacaaatcgaagaactcttaaagtagatgacgactttattgattctctctgtgtttacaaagtgcaccaatagcactctttataaaaattttgactaaactcgaaaccctaactcaaaactcaactcaattgctctctaaagtgatatcgagaagcctcacgctccccctctatttataccgaggtaggcagcctaaagccacaaaccaaactcatactagaagtcctaaacactttaggaaaccctctagtacaagacacaaacattacataaccaatcataccaaatttggactccttccaaattcgactccgcatcccatacgcacacagtacctctatcgtatgccatatggaatttacatcaaccacgtgcatcaactctgaccaccacggacgtcgtcttatccccaagacgactcccggtccatcaccgcaaatactcacccgaggcatcgagtcacctacacatgaaataaacaaagaaaccatattccgagaccaagctatctccaacttgactcattagtagcaaacaatagaattacatacgtatagtatccatctagaagccataatcatgaaacaatcacggatatccaaactaacaacccgaaaccaaaaccgacacagcgtcggccggtcagaccgcgggctgcgccggtctgaccgcgtgatacacgccggtctgaccgacagcacatgcccggtctgaccggtcacataaaataacagtacctgtgattcacatgtaaatccaatcatctccaaaaccacttcgtaaataaattccaaatatcaaaactaataatctccaatgccaattgttcatcacagaataataatcaaaaacacctttgattttacatcataatcaatcgatatcttctcatgtttaatcttacgtcgaggttgttcttgtgtgctgctagcttagagtcttcagagccttacgtctggcatatgccctaaaggcaatcatagagatgattgtatcacatactatatttacatatttatccgacattgttccttgaaatagataactcattattggttaataaatatgtgattctttcatgagactctttatgttgtttgttactatttctaaaagatccctgatcaaatatcatatgtggaacaaatatgtttatatgatcagcacatgtattaattgatgatcatgtctcatggatcatggtatagagataccaaattaataatgtggacacatgttggtgaacatattgttggatagacccaacatgagacactgcatgagccatatgtgttgtgtcatcagtgatctcatttagtgttggtgttgaatccttagacctgagattctcatggttcccaacatgtgtagtagcttacttagggactgctaaacgctactccgtaattgggtagtaataaaagtagttttcgggtatgctatgaaacatgtagtaggatataaataatcaagatgggatttgcccctcctatggagagatatctctgggcccctcgatgttgtagattatggaagtgcatggccataccaaaggtgattgaggagtcaatcacaagttatataatatatcaataggttcgagtgaatgattgagctattagaggacggcacatatctaaccttgagcttaatcgatatcgtggcgcaaaggggttcatacaattatacactagaggttcagccgatatgatctttatgtatgcccggtgggtcaatacattctgctaggggccgctgttgacgcgtggaccaaaaaggagttttcgggttacagccgagtatacatgaacctacagggtcgcacgcttaatggaccggaatagggggattggatggagatccaatatgagcttaattcggatagggatccgaataggagtcctacgggccatggaggcccgagtaatggatcttatatattcgtgaggggtgtgatcggcggaggcattgcatcacgtgagaaaccgtagccgtcacttccctccctgagcaagaccctagccgcgcacgggtgctagcacatctgtgcgtggcgttccgtccttgtacgtgtggataccggtagaggcgtcgctggtttgcggtgctgatcggcgtgggagtatggcgaggagatcgcacgaggaggagaaggtcgagccgatgtgatcgactacttcctctacatcaacgcgcgatacttcgcgagagttccttcgacttctcagcgtcttcttccgctgcgcagcgcgtcgagtagtaacgatctatgatataataattgcatggttcctggtttacacgatataaaattttgagttatgctatcgtagcctacgcgtatcccaacatggccaccagtgaaattattctattagctaatttgtagtatatggaaagcaggtaggagtacggttcagttactgagcaccactattttccttaattgccgaagatatggaatatattttcgctaccattcactcgcttccttaaaaatatccttgccatgtcaagcctgtgactctcacaggtgcagatagatcaaaggccctgttgtaaaaagggctgaggcaaccgaaactttgtagatagatcgaaggccctgttgtaaaaagggctgaggctacccaaacttagggccttttcgttttggaggaattttaaaggatttggattcctaactgggaatgagtggaattgggaaaagattgtagacgtatagagcctgcacgagttgacaacagtgctcaagtggtggaaagaaggtaacattcagcagaagatggaaacatggatgaaaacaacaggcaacaaccgatcgtgctgggataaatcattctaaggataaatcaaaagtaataccttgtaccttatagttccatctaaggataaatcattagtaatatcttatagtaccatcaaagacaacgataatacatttacacattactatcaaatccgagtacgttcatcgatggaagaaaacagatgaacaagatctaagcctctgtttgctatgcaggatacttcatgattcttgaggaaattaaacttctcatgtgaaattcctagtttctaatataaaccattaaatcgtatatcttcagaactgataataaccccaaaccctcaactactaagtggaaatttcatttttagtagcaaggacatcttgaggatatttttagttgaatttggtaaatcatcagaattcttaacataggggagggagggtgccttttgtctgacaaaattgacattcagccatcgtctaaagaaaattgcgaggcggaggaatcaatacctcatcgttgtcgacgccgacgaggaagaagagggaagcgtaccgccggtacaccaccttgtagttccggtgctccacgaacgaacactgcaaccgcacgaatcatacaaatcacatcatcacgaggaagagaacgaacacccaagaaccagcacagattcagatcatataaatctctatttaggatctgtttggctcagcttcagctctcaaccaaacagtttcagctccacccaaaatggaagcggagctgtgcggagctctctcacaaaatgaactggagttgtgtggagctgggtttaggcagctccacaactccacttcagacctaactcctgaagctaaatttaagagttggagctgtaccaaccaggtttttaatggcttatatattttaaatcacatattactttttaaaatctatttacatcatatattctactcaaaatttgtgacaaaacgagatccatgcggaatatattcaaacattttattaatttaaaagtaatttatttaaattgtagaagtaactcagatatgcaatagaaataactctctattacattagaagtaattataatataagtgagttgtagcaagaaaatatgtcgagtaaattcacaagcaatgtgtacagaagattttcaagtaaatacatttatgaaagtaagttacataaagtcaaaaaataatttacataaatcataaaagtaactttgcacaaaatggaagtaagttgttacaacattagaagtaaatccgttgtatggataaaaacataagtttatcaagaaattaaacttacttagcacaaattatgaaattgactaaaaacaataataaaagtaagcaacttagagcattatgaatgtataagaagtaatttattcaaatatgaaagtaatatatatatatatatatatgagaaaattttctcataaatcggataagtaatttatgagaaaatttaataagaaggaataaaaaaggacatgcatgtgtagatgtagcagttttttttccctcagcggctcttgctttgtgtatgtgcgtggtcgaatggctttgaggtgcgtcgtgcgataagattaaaacgagaggcttcttgatttagatgttacgctaatttttctatcatatcgccaactataaaatcataagcgagaggcaatcgatattaggcgttggaagatgttcgtattggtaaactccaccctccatggcaaatctataagcgaaagaagaagtgaaatccggctacatggcatctcaaaacagtcagtattatatcaaattccacataagcaagaaggtgatcgtgttaggctaagatcaattatgaaattggagacaacaagaacatatataacaaaacgcaagcagtaattaattgcccagcaaattgaatcacaggacggaccgacagggccggttagagtatagctaactagctaggagttgagttttgcacttggcctgtaggacatcaccgcgaacaccgtctgcacgagcgtgcagaggaggaggacggcggcggcgagccaggccaatatgagccacgggttgtcgaagtggcggcgcgccacccacgcgagccagcggttgaggcggcgtccgtggtgcctgttgagctccagccccacccctcgcaggtagtgatcgccgtcggtgtcgaaggcgaggcccctcgcgagcccccggaacagggcgcacgcgtcgccgtcgttcccgagcgagtgctccatgacgcccgaccgggacagcaccgccacgtccccagcgctccccagcagctgcgacatgaacaccacgtacgccgtcacgtacgcgtcgcgctccacgccggcgccgctgtcctgctcgaacgccagcacgttgcggaacacgcagctcatcttctcgtcgatcacgtggcgcgacatggtcaccacgccccacgagaagtccacgtcgaggagcccgaaacgaggggcaggctctgaatctgacctgaccctgaaccggacgcccgattcactgtactccgtcgccgtcctgaaccgctggatgtgaccaccacccgccgccgctgcctgctgccacccggctggcctcaggtaggtgtggcacaggtcgaccagatgcttgcagtcctccttgacgtcgtcggcgttggaagccgttgggatgtgttgcatgaagttcctcaccgcattccaggccgttttggctagagttgtaccagcatgatcgacgagcaagccgaagatgctgtgcacaacgaagaacgggatctgattctccagcagcaccaagtcgagaaacccgtcgacgagcaccctcttctgcgtcctgctgccagtgcccggtccagaatcctcttcttcttctttattagcaggcgcgtcatcctgttcctggatgccaaacgcggtgagcatcgcgatcaggaaggccccgtccaccagcagcatcatgcagaattcccccgaatccatggcgacatcgccgtcgtagcagcgcctcgcctcctgctccagcgacgccatggacagcaggcactctctctgcagcgacgccgcctgatcggcgtcggcgccgagttggagcttcatcaaccgaaccttggtgagctcgttcctgcccatctcctccgtgccgtggcggtggtaaggcccaaccgagaacaagctcggctggtaagcgtcctcgtcggccagccgatgcctccccgggacgcggaagatctcgcgccttgcctccacgacttgtgcttgtgcttctttctccgcggcgtcgagacgtcggatgatttcgtcgatgcgaatgtgcgccgcctcactgccacccatctgctccccgccgttcgtcctcatcatcggcggttcagttccatctggatcaaacaattactagttaaattaatcacaaatggaaataataagaaactaaatctcgaggggaaaataaaattaactataaccaaatatggatgagtttctcgaacaacgtgaatctgagaaacgtacgtactgttgggtgaagccggagcagagtccgcggaattcgacaaacccgtcatttccacgctcaaccgcagaatttccggacgaaacatggtgtctgatgaactcaatcggtcccggacgacaagagtagtaatcaatatctcagggaagtccagatctggtaacaggtctgacgacggatgaacaccacggcttgcactgcggcagatgagctagcgatcgagtatcgaggcagccatatatggcatgcggtcatgactcatataagatgagatgatgactcatgaacatatcattctagagcttaaattaggagggaagaaattacttactaacttatccgtttcacaatgtaagaaattttatcatttctcacatgttaatgaatcttacatcaatataaatgtaaaaaatgttataataatttatattgtacaacggacggagggagtatggagtaacaaatagagtgtgatttggttctagtacgactgagcacgcgcggtcgaaaaaaaaaaagaagtggccctccaatcatcaacagctatagcagatcgttatgatattgcgaaccacatggcctgtactaccaaaagtaccgagtagctccccttcaagaaaaaagcaccaactagctagttttaaaaaaaacaaaataaaagtgtaccaattagcaacactatattaccttgttttaaaatatgtgacgtcattgactttcacataacatttaatcatttatcttattaagaaaatttgtataaatattattctttttttgacttgttttttataaaataaaatataatcttagcaaataattttacatatacacattaaatttttaaataataagaaattaagaatggtccaatgttctctgaaaacttagcgacgccgtacattgcatgcagtatttgcaaaggccaacccgatggcttgagttgaaccaaaacagcacattgcactattggagaccgggaaagctcccgtgtgcttcctactgctacatttgcatatggatacgacaagtttatgacatgccaaacagtacacatgcatcttttccaattgcacccaaaactatttgaacgtgacctttttttcatgtttatcagctaaaatttaaattttccaccttaattttgaaactgattttaaggtttttctcatcaaaatttatttttcagtttttacttttaaaacgctaaaaacacatatataaaaatttattcacagatactttttatttgtaaatatatactccctccatccaataaaaaaccaatctaatacactggatggatgtatgtactatgaatttgactactattttttttacggagggagcatatcgtttcgattgggccgttgcatggcccgacgcgacgacttgacgactcttgtcttggcattccatgcgcgacagaccacgtgcggccttagctgtgtgtccatgctactctggacgcattatcaaatgctccggatccacgattccacgccattgagcatatatatccaacataccctgtttagttcacactaaattttatccaaactctcaactttttatcacatcatatcacatccaaaacttttctactaacattaactctcaacttttttttttaaactaccaaatttctccaaatttctccccatttcagacactaaacacagccaaaaagtatgatttggacagttttgttaattataagcggtgctggtaatttggatgtggacacgataaaatctgataccacaatagagttttgttaatcataaggtgtgctggtaatttggtgcaaggagttgctgtcccactctccgagcaaggaaaaaaaaacccaaaatatatctatctattatatactaaaagtccattaaacttcctacaaacgctcttaagccgtcacgtggcactcctacaaacgctcctaagtcgccacatggtacaatctaatctcaccgttcattttcacttaaattgatagacctgttattttacactattagattagatctattattaaaaaataatatcctcatgtacgtatgagtttgagtttatacgttacaaatgccactgctttctttccatacgtacaaacgttgtacataattgaaaacaaaactttcctaatcttcgctggaaaaaaaacatatacatgtacataaaaatgacagaaaaaacatacattcataaaaatcaacggtatttaaaatatgattttctactatataaagataaaatatattacttcacacatataaatatatttagttaaattaagatctataataaatatcctatcaatgttcttttaaaccatcttctaaatctatctattatataaaaaaagtacattaaactttctctcaaataaattagagaaacactaaaaatctattatacactaaaagtctattaaacactccaacattgtcacgtgatgctctaataaaattagagaaatcctaaaaatttagagtagaaaaagaaaaccatccaacctttaattttcacttaaattagtggacccactattttaaacattggattagagctcttaaaatttccgtgctgctaatctctatcccggaaaaaaacataacttgcttacgtcgtacgatcgtctcctactcggggaaaaaaacttaaatacctacaccatatatgatcgaaaaaagataaagccaaaaaaataaaaagaaaacatgcacacgtacatagtagtatcggaaagaaattctaatcatgaaaaatcatcagcgtcagcactgatttgttgtcaacatcctttaatctacgattttattataaataatactacacaaatatgcacagctaaacttaatcgtaaacttattgtagtgataaatatatcatgacaaatgacgccaacatgtaatagttaatgcgataataatgttccaaataatttcatatcgtattttatggtgtcaaatatcacgtgacaaatatacaacgttaatttgaatctacatatgtaaaaaattaaaataacaaaacctatagcattgttttttgagtacatctatttaggtttatttaattttggaagagattgagattctcaaagtattaggaatttttcaaaacttttcttatttgaggtgtgagaagcacaattaatagattgatgagaaaacataaattaaattttagccagtgataataaaacaatagaatttagctttggtttttaagtggatctttttaggtttattttgggtgatattgagattctaaaggtatctgaaatttttcaaaactttttgattgttatttgaggagtgagaagcatacatgatagatagatgtgaaaaaaaaataaataagattttagacagttattttgctagaatacaactcttaattcatcacgagaagtatgtattatctttgccaagtagtattggcaaaacatgaataatccaataaaatacgcataaaactacttatattatattttttgtagttgatagaaattctaatatactgggtatataattgacgaatgttatacaccacagaacccaactataaatgcactctagcgaattggttagtgtaaataagtttgtgaaaataagtacattcttagaattattaaatgagtctcatataattataaataacatatggtggaaacaaatttggcgctaaagtataaatctttatcaaaatataaataatgatacggtgttttacagattttcgtggtagtacatctctttagctatatttttttaagtagtgtcgaatgattaaccccactcatttgaaaaatatgatattgtatgtattccattaaaatttgataagtacttattactaacttcatatacacattttgtctattctctaccaaaaatcgactcaaatttttttgaaaaaaattgttttcatcacctcctccttctttctatccctctttgacatttaatgcagggtgcagtacttgctacgctgtcatatatattgtatgggcatctacatggttgagttaaggtggtgtctgtgaaagaccatcataggcaatgtaactaaagtgacatagttatcaatataatcatttgtaagtgtaccaatagtgtactaagtgttgaaattgtattgtatgatggtttttaggggcatggctacatcgaaatgcgggacctatatgttttaagccattacatacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatatgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattgtttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactgcaactgcatcaaaacattcagcatatctcttgctatcttgcaattgcaaattagttatactcgtagctactgcgcgcgcactaattgactacacaagcaaatatgggttctccttctgccaagtacttgctgtttagccttgcaatcctgctggtcctgagtagccagcagcaagctctgctgccttcggcattcgcccgccagttggttccgatgcccacgaacactgccgccggtaagaataacatcagtgttaattaccagttccatctgtatatgttttgtgaaatatcatgtggagaaactaaccactacatctctttgaacatttggagttgcggttctttcttctagcgtgtgtttggccctcccctttttaacctctactctcttatttctacttgcatgtttctcgaactattaaacgataatttttttaaaaagttatgtatataaaaaaactatttttaaaaaatattaattttttcttctaattttgataagctaatacttaattaatcatatggttacgagtccctccatttttgcatgtgcccaagaccttcattgcgaaacaaagccttaattaagtatagctagctatgtctacatactttctctatttaaaatataataattgcctcagatttaaatttatcgaggaggaattactttgaacgttttctggtttagtatatatttttttatatatattggatttttttttgaagtaacacatactcctacgtacattaattaactgtttccattcgcatgcgtgatggagcaatcgacaggccacgcagatgtcacggaggaaaagcctagcgtcccgccgtcgagcgtaacaaagatctgccgagttttacgtatctgcaaacgatcatcgtcggccgcaacatcggccaagccgtgatgtgtcaacgacggcaaatgcatgcacgcgggaataaataatggaggcaccgattaggatcaacaatatggttagtccattaaatatgtgtgtaagctcgatcgatatggaataatgagaaacaaataaacaatgagaaacaaatattcaccatgtttattactacctctgttttcaaataaatagtattgattagtgtaattttgaactaaccggcatcaaacaaaaagaaacagagagatacttgtttacgttacttcttttgtatacgtatccagccgcgatgttcggaaactgtgtaggatcgagattggcatcgatcagtaagggcatcaacaatgttactttttagctgccggtaagaagcattaaatgctcttttcctatccggtagcaagctctgtgagagtggcgaagaattaaaatctggtgataatatctattaccggtatattactaccggtgaagaagagataaataatattatttatatagtgttttaatagaactttaaaaaaatgaaagtggctgttgctgtggggtgatgctcggatcgagatgacatcgatcagatggtgaaagaattgtttaggctgtgttcagatgcagttcctaacttcaaacagtgcgcacgaaaaacgaagtgatcaattagcgcgtgattaattaattattagctatttttttaaagaaaatgataatatgattttttaaagcaatttttgtatataaattttttttgcaaaaatcacactgtttagcagtttaaaaagcgtgcgcgtggaaaaggagaggtgagtgttgagaacttggagtacccaacacagcatctaaacaatagtttcaattatccctataaactgtggcaacaaaataaattcactaaatatatatgtttgtaccgaacaaccttagaaaagactgaccagaaaagtgcatgatctgcaaggtagccaggtgcatttttagtgataataagtgtgtacttcgaggtaaattttgctacaggacgcttcgacttcgtggagttagccgtgggataccgcctgaactcatttttagaggaaaacactccataaatatggtaatttgtcaatggacaccgcacctattagaataataatttctggttgaagaggagagagaaatcacgtgaaataccaaaaatgcctttgggccaacacgtcagctctcctatctctcttctctctatcttctctcccagagggggcatcggtcgccggggcggaggacggcgaggacggtaggagcggccgccgcgggcttgcggcgggagcagcggaggacggcaaggacatggcgaagcggaggagcgggagcaccgggacgcgaagctgtgggtcgccggcgtggggtggcggcgcggccgcatgtgggacgtgaaggtggtcgccgacgtggcgacggcgatggggacggcggcgtgtacctgggtcgtggctggctgcggttcgcccgcgcccacgacctgcgcgacggggacctcctcgtcttctgctaggacggcaaagacgtggcgaagcggaggagcgggagctccgggacacgaagctgcgggtcgctggcgcggggcagcggcgcggccgcatgtgggacgtgaaggtggtcgccgacgtggcgacggcgacggggacggcggcgtgtacctgggccgtggctggctgcggttcgcccgcgcccacgacctgcgcgacggggacctcctcgtcttccgctaggacggcgccaccgtgttcaccgtcactgtcttcgacgacgggaccatgtgctgccgtgcctaccatgacgccgccagtaatataacctcgccgcgcgtcctccgtcccggcgatcgactccccctatgggagagaagatagagagagattagaagagagagaggaaaactgacatgtgggcccaagggtatatttttgatatttcatacgatttctcactcctcttcaaccgaaaattattattttaatcaacacggtgtctattggcaaatcctcttcaaccgaaaattattattttaatcaacacggtgtctattggcaaatcaccttatgtttatgtagtgtttttcctcaaaagtgagttcgggcagtgccccacgactaaagccacgaagtcgaagtgtcctgttgcaaaatttatcttacttcaaactcaggtagacgcaagaaaatatgattcagtgaggacaatacatatcaccgcaggtcaattgcaatagagctataacagctcaaatttcaagcacaaggactgaagcattactaaggacagtatgagcccagtactacccaagtactaccacgaaattcagattaaataaatacaagtaagatgcccgtgcgttgcaacgggaaattttattaagtttaaagaaattgagtgaaaatttgttaaactaccagaagcaagcagtcaacacgtacatttgtaatatctccaagcggggctgctcatatccaaatagattagaacgtatttggtacaaaacacctaacaaatttctacatgtgaaatattacacatcaacctgaaacagatgaggatgtaggagtagccattttggtcgtggaatcttgagatccatgatatgaaagagttgaattaattcaataataataaggtgttgtgttcaaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaattaggaagcaaaaatatatcaattgagtaatggatatgaccatggctggatggatgaaacaattacatgatcttttggacgatgttggtgctgaaccgccaccattgttatccattgcagaactaacttgattagaagttaaccgcaactctagaaaatcattgttcggtttcaatttagttcttcacaccaaaactggcacctaaaactgaaaatcgtacatcatgatgtggggataatgacatgcaaaagctaccagcaaagtagatgagtagactgtactgcagaaaatgaaaaaaaaaacatggtgcatgtactgaaataggtaagatacattgcaagaatgcggatttctgaacttgaactaatgttcagaatgtggttttcaatactacaaaatattcaagataccattcttataatagtattcagttttaatgtccatggtgttgtgcaacaaattataatgttgtttgagtgtccttaggcaaattagtgcaagatttgcagatccaagaatgtacaggttaagaagtgcaggccttcaagttagtagtagtagactgcattctgtatctttgctacctaattaaattgtacagataaatcctattcagggtaataggttatttcagaaatacttgccgcaaccaaaattgtagttactcaatccatgatgctaggatgcctagtgatgcaagcaacacaacatgcatggattggggatataacatcagaacttcaaacttattacatttttttaaaaaaagaagaagagcagagtccagatttgacctgttatctgaacaactccacaaaccataccaaatgtcaagaatggattcaaaaaattaaaaaaaccagagttattcagataaagggatgatggtctggataaaggaaatgcccttcattttctcatcattttatcaattttaggtcatgttctccaggcaactacacaacattgtagtgcttctatcccgttagaatggctaacggattaatagtctgaaacccctctaacaaccaaaccatgataaattctgaagcatgatatcttaatagataaagatttgtgatgaacgagagcaattgtttttattctaaattccagcatatgcaaaaaacagaaaaaataatatcttctcatatcaatcactcaaggaaaacagggaaaaaaagagagaatagtcccgcagtagttcatcattaataatttactgcccctttttgagatcatgcataatcacagttgttatgcatgccaatgatcctgaagacgcagatgaagttattactatgctttgcctgagagcctgacagctaatctctaggtacgctgttgaaaaatcatcacaatgcccagatatgcatggtgaaaaatcatcacaatccaatcagctcacatccctccccaattcatctatacgcacgctgttaaaaaatcatcacaatccaatctgctcacatccctccccctttcatcacacatggaattcagcggtttgatgcactcaccgatgcacacgaccttactcaaccgccaaaaacgcaaggatttttcattcagttaaagaagaggaagggggaagcaatggatgagtacctgcttggccgccattgccggtgaagcatagaacatgtagcacggcctgcccgctgacccgaacatgatggaggagcgggaggcctcggcggcggccgtccaggcgacctcgttctgcggcggcggggtgaccggttgctgctcttcccgcggccacgtgctcccgcctcgccgatccggcgccggcgcggtggagaagccgtccgcagggggaggtggaatgcgggcgctgggggatgggggatggggaggaaggaggatgaaggcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacggtgacccagcatggcggccgctcctcctcagtcttttgctctccccaacacgcgtcggccgctcctgtatgcctatggaactaccgaactattgtaatgtgtcctgtgtggcagtgtgcctatatgcctgtgtgcagtgtgtgctgtatgcctgtgtggcagtgatgacttatatttttaaattttaagcaacgcagtgaccattgaactactgaactgaacacttatattattgataatttattggatgtgttatattaagcaaaattatattattgatgggttttggttggtttttcctaaagagctgagatcatgttcagatgttgttttgctatcgtattgcggctaattgtaatgctgccctcttattatatggactgaatacaaacttgacatccgataactttttatcctttttcgaattgagtccgcaccgattccgcaccgaatccaacgtccgaaataatccactccacatccgcacgtcatccgtacccgctccgtatccacttaagaaatagtttaggatatgatagagctattatccgtctaaatccgctccattttcatcctctccttccctcccattctctgatctagtcacaacttgctgagttgcttcttttcatatgtgcgacgggagagattggatcgattttttcttcttttctttttcatgccacagaattggatgattttttttcttcttttctttttattttttgggacaaaaaccgtgatgacgtgcatgcttggtgagcacatttttaccattatttcttaattatgtgcacgtgaaattttttgtcctttccaaaaaaaaatattatcaacattgttttgcaagataaaaagataatatttcttgcataaaaaatacaacatttcagaggtttttaggtgacaaaggaaaacaaccttcacaaacaaaatgactaaaccatcagtgcttctcaaattgtcacaaagtcattaaagatgcgaaagggcctgtagcctagtggttacaagagtctaagtatcacttgaggttctgggcaagacgcctgtgatgactttgtcaatctgaaggatagcggctattgtaagtgtttgtattgtactgtttaattctaaaaaaagtcatctatctatctatctatctatctatctatctatctatctatctatctatctatctatcttctatctattttatactaaaagtccatgaaacttcctacaaacgcttctaaatcgtcatgtggcactcatataaacgcttctaaaccgccacgtggcactatctaatcttaacatcgattttcacttatattggtggacccgttattttagatcgttagattagatctacacagttaattttcacttataatttagttgctagaccattattttagattacatatatatgagaatatatagatgccaacagttggccgaaaaaaaaggcaaaagtatttactgttcgtactatggaaaaggaaaatccatacacgttgatttccagaccgttgttttagattagatatgtaagtgtaataccttcctccgatatatacatacacgagaggaaatttagatgtaacagttggctgaaaaaaaaaaagcaaaagtacgtaaagtaggtactactttgtggaaaacagaaaagcttgcgtatgtacggttcgccaaaagaaaaaaaaaacgtaagcaccataaaaaaatatgccgtcgcaaaaaaaaattaaaattatatatttaattggatcttgttgtattccttttatctaaatcaactattgacatattataaaagttatattatagtcctactaaatacatcacgacacatagagccgataaatagtaattaatgttatgataattttttaaatgattttgcatcatattttagggtgtcaaatatcacttgaaaagttttttaagtagatatgatttaattttaatttttttaatctcaaagtgtttttttgaaattttccagaactacttaattgttattagagaagtgagcagcacagatggtacatggatgtgaaaaatattataaaaaatatttcaaccaatgatcctgctataacacaatcctttaatctatcatgagatatatggttatatatgtatattttgtttatctggtcaaatagtttgataacaataaaataatatgtaaaataaactactcatgatatatttttcttataattgaggaattccaacatatcaaacataattaatagatttatatcatacaccccaccgacatgactaaagtatgctcctacgaattagttattatacaagtttgaaaaagaaattcttaaaggtgtctcatatgattatcaaaaataggtgttgaaaataaaccaattgctacgctatagatatttgtcaaaatataaaaataatatagtgctacgaagattatcctggtggtatgtctctttagttataatttttttattctatcgaatgattaaaatcgcttattttcaaaagtgagtactctatctatagcataaaaaaataaaaaaaaatattttgatcatctccatttcatctttgtccttccttgaagggcaccaagcatcgataacagagtttgctacgatatcgtaattagtacgggcatacatatagctgaattgagacggccctagtggaggccaccgtcgccaatagtgcccaacttactacttagtgatgcaatactatatgagggtatgatagtgaattagacattaaaattatactccagactggtctagatgggcacagctacatcaatgcaggacccatgtttcaaggcacaaagaaataaagtcttgctggctacaatgagcttcacactttataggggcatttatgtttaattttaagatgtatcctattaattggtacaagtggtatttttagaatgtttttatatggaattggaaataagtgagacaaaaacacttaggtatagtggatatttttagtgtattaataatatattagacttattttattcgtacatatgcagtttcatttattaataggtactcaactttagaaagtgataataaattgtagtgacaatagggaagtttatatgaaaccggaacaaagtgttttttttaatttagaagacatccttatcatttaaatatattaatatatatatggtagaaacagtgaaatgtgactttttttaatcattattttcataaaacaacaaataaaatgcccgcgcatctgcgcgggcttcctttctagttaaatataacaatctagtaagccatttacaacttagttgccgaggatatagaatatattttcgctatcaatcactcacttcctttaaagtgtcctcggtacggtgtaattcttaaaaaaaagtcattaatgataacaatctaataagccatttacaacttagttgccgaggatacggaatatatttttgctatcaatcactcacttcctttaaagtgtcatcgccgtgtctttacatattgcaaagcctatgactcaagtgtagactttgtcaatctcgaggataaggatttgctggctattgtaagtgtctgcgttgtactgtttaattctaaaaaaaaagttattgaagataacaatctaataagccatttacaacttagttgccaaggatacggaatatattttctctaccaatcactcacttcttttaaagtgtcctcgccatgtctttatatattgcaaagcctgtgactatattttcgctaccaatcactcacttcctttaaagtgtcctcgctttgtctttatatattgcaaagcctgtgactcaagcgtagatagatgaaaggcccttttgtaaaaagggttgaggctacccaaacttaactgggaatgagtgatacccaaacttaactgggaatgagtggaattatgaaaagattaaacacgtatagagcctgcacaagtcgtcaaaagtacttgaccagtggaaagaaggtaacattcagcggaagaacatggaaatatagatgaaaacaacaggcaacaaccgatcgtgctaggataaatgtagttcatcaatcaagatcaggaagatgaaaatgacattgcagcctcgtgagatttgggaattatatcatggtcgatagtgttgacccaatctacacatttcctctgtttgccccactacctcatctaaagttagatatcacgatatctatatggtcagagataggatcatgcctgcttacaacagtccaaacgttccttttcccttcaattacctagacaagatgctccctctaatttaacagttctacagcattatagtactccgtatgaagtatagtagttagagtaaaaaaatggtgatcaaattggagcacacatcaattcgagttaacatgattcacatcaattgcaccctctgacaatttaagccgtagcacttattatgatctcacaatcagtggctttgtaatcttcacaaatcatgtgtaaaaaatcaaaatgaaataacatgaagaaaagtacatcgcatctttgtattcagcatataatcatctccagtcagctcatatcaataatatgtgcaaacagaaattttttatactccccagtagatgaaagataaagcaccacagagacaaaaggattaaaaactagatagttagagaatgctattctaagaagttttctccataagctggattggtgctaagatgttctgtttacttgtctctactatgcagccattcatcaccatctcttccagcatgaagtgcaccttctctagatggaacatgatgtcgagttcacactggccaaaaggataattaccatcagcttgtcccatgtgatatatgtgagcgtatttacagtcacaagaaaaataattgttgggattactgaaaaataccacatttccgaagtggcggtccatagtttccacaaaaagatgaatgaattcgagaatagctagctcattctgccaaacaaaagaaaattgaggcattttaatatgaatcaaggaaaacatggtgcaggctgtagttatgattgacatcccagaggaaaactacaatgcaaattgcaaccaaaacaagttgaaggaagatttgacttcggcaattgctacaaaattcattgagaaaccaggcagcaaacaatgaactgcagtcaacaggcataagatggagatactgagattcgtatgcagagatgtaagtatgaaatagtgttaccacacagaatcaccaatataacaaattttcttactaaagagttctatctaatgataaataaatagtaatagcgtatatcttatagttccatcaaagacaatgataatgcattttcacattactatcaattagcaaatccgacttgtgcatatattcatcgaaagaagaaaacagatgaacaagatgtaagcctctgttgcgatgcgggatacttcatgattattgagtaaattaaacttctcatgtgaaatttctagttcctaatagaaaccattaaaccgtatatcttcagaactgataacaaccccaaaccctcaactactaagtagtaatatcatttttagtagcaaggacatgttcagaaactatgagctaactgcaactgcaggagcatttcggtgccataaaatggaatttaatggcaaaatttggtaaatcatccgaattgttcaacaaagggaggcagggtgccttttgtctaatgaaaattggaaggcggaggaatcaatacctcgtcgttgtcgacgccgacgaggaagaagagggaagcgtaccgccggtacaccaccttgtagttccggtgctccacgaacgaacactgcaatcgcacggatcatacaaatcacatcatcacgaggaagagaacgaacacccaagaacctgcacagatccagatccaagaacaggaggcttcctttccccgctcccccacccaccaatccggagcccaagtttccgcgctgggcaatattggatccaagaaaacgaggaggaatcggaggggggatcgggaattggggggttaaccaaaacctgctggtcggtgcgggcgaggcacttgcggacgatctcgccctcgagggcgcggcgctcgtcgatggagaggtgctcgtagtactgggccagccgcgtctgcccctgcttgttcacgaacagcacgaaccggatccccatcgcctcgcctctcctcgcttcttccttcgctctgttccaaggctgcttcgtcttcaacctctcgacactctgctctttctttctttctctctcccgtcttctgtttgactcttcttgcccatactcgtcttcaacacaaggcaaccctcttttcgtttgccctttttactatttctaacggtggaattattttaggtacggtgttcgtaatacaattcgtatattcagatattttattaatttaaaagtaatttacttaaatttaaaagttatttttttgacgggaaaccgcaggagaggctcctactgcgataatatattaaataagggatcgacatatacaaagaaaaagaaagaaagaaagaaaaagaaaatagattacaggaaaatatattaaatttaaaagtaacttagaattaactctttgtactattagaagtaattacattaggaccgaattcaaataaaaaatatgtggagtaaattttcaagtaaagtttacacaagattttcaagtaaatacatgtattatattttcaaagtaatcactatattatttttgaaaacaaaaattttgcatcatatagaaattaactcttcacgatattagaaataacttcattattagagaaaagtaatttttataagtaactcttcataataaatacactcctaaagggaagtgactataaaaagataatatataaataactaactctactactagatagaattaagttttcacggcaactacactgctataaggaaagtaactgttatacaaaagtaactcttcacgttattgaaaatagctacactgctagtgaagtttatcggtgatatggacctggggatatcatctttacagggaggaggctacccccgaacccacatgccccccctccagggagatcgggcctggggtggagcggcggctgcccctctccagcttggggtaccgagattggagggaggaggctgcccttagacccacgttgcacttccccgagtagggtcgagcctagggtggagtggcggccgacccctcctcgcttgggggtcgggccgtcccgaccccctcggcgcatcagcctactcctgcgagttgggtgggcgcgcccaccgcccacctaaccgcatttaaatcagaccgaacgggcgtgtcacgccgcatttaatgcggcgtgctgcgcgcctaaccagtctatgaacggtcgaatgactgatgggactggggtagtgcgcctacgcattgaccatgtgtcaggcggtgtgcagcctgccatgccccgtcacgtcatgatgatgagaggctttcccagccggagttggttcatccgctctagtcaagcagggttcccatttcccggtgcaaacaggaacccagaagtcttcacccattaaatgatgaatgaaacgggcgtcccctatgtcagccggttcgatttgaccggtcccacgaccgagatgacgtgcacgtgacttccaagtcaaggaacaagacatgcattcaatgcaaagattgtactccttcacccatagacaggttcttgggcccatgtggtaaccccttgaggtataaaaggaggtccatgcctactaagggagaggatgagcccattttctaacacacacttcagattcactatctcaagcatctacaatcttcacagattcagccaagcacaggagtagggtattacgcttctcagcagcccgaacttgcataaaccttttttgtctctatgtcttcgaggggcctgacccctctctttctctcatccatcacagggatcctcgaatctcaaccgctgcccccggccgaactcacaaagagagggggggtctcacggtcccccgctagaggagttcatcctctgacatagttaagaagaaaggttaaataatttaaatatattcaatattagacttgttttgtcatatattttgagtagagtatgatggttcaaacggatttaaaaaaaatatacagtttaagagatatacatcatcaaagattctattaaaaaagaatatatattagtgtaactatatgttagactcagtagcatgcacgtgaatctatgtaacaaccagcagataccatgtggtcctctttttctggcaagtgatctcatttctctatcacttgatcagtacaacatccacgtgttcatatcttagccattacaactgatcggacggcttacgaaagatgtttggataaggtcaaatagtgtgtgtgcactgaatacattttaccataaagatatgggttaattagattcatgccattataacctttatagttttgaaatatgccattactatttaactatttgaagtcgtgccatttagtagatatttaagaaatgccaccacatacccctccaacacactgaaatttatttttggaccaaattacctgagtcttttttcctccatcccctcctcccattctctttctggatctgagttcccggtgtaagcgtggtggagaggcccggcgagcagccccgaaggagtcaaagtgatgttgccggcgctgtgagatcgtactgccgcagtgtcgtgttatcgtgtgagccgcgaaacgccacgcccaaatcaattttgagaaaaaaaagataaagaagtaaaaaagagaaaacaatgcacggatgaaagaacacatatctgttgctgatagtcctatgcacaatcaatgtaaaacgagctttaagaagacaagaacatatcggcggaaggtgatcttggagcagccgaggtcgtcacgctcctcgcctcgcctgcgcggtgcttcgctgcagccggaggaggggaggaggatgctagttgcagctgctgctttcagtctggtcgccggtagttctaaggccgccggccaccactgaatcaagccaaccgggtgtagctccaaatccgaagagggatgggaagaagaggagtagagagagaaggagattgaggaagatgacatggaaaatttggtccaaaaagaaattttattatattaaaagggtagacagtgacatatttcaaagagtagttattccaaatagatgaatagtagtggcattttttaaaactgtaaaatttataatgacatgaatccaattaaccctaaaaatagatgctgcaagcaaaactcaacaaaataaccacaaattaagacaagtaagcacgtgtatgaagatgttcagactccatgtagacacgttctctgatcgatctgaagcccaagcagtcgagcttgtgcccaggggtcaataccggtgaaggtcaggagcaggtaaccgaggtttgagaggaagaaaatacatagtaactgcggtggagatatacaggtggtccaaactatgctactagaatgtaatgtttttattttgcatgaagttgctccagttctttcataatgttcgtattcgattaaaggtatatttttgtggaggctccaacttcttgttgtaaaaaatgattatttgccgagataaaatggtttactatttcaattataatattattaattgtaaagaagatgttttgcccttaaaaccatagagtgttctcagctccaaggctccaacttctagagttacgtttcttctaccaaccttataacaatcctaaatgacagccctaaactatgcgttcagtcttgtctaaatttaatggaaaaaatgcagcagaagattgtgagaaagtttgtttcgttttccatgcgcacgcttcccaaactatttgcaatgagagtggtgattactttactaatgtgtctctgggttttgatcctctcttgggtcggcaatggtgactcctgctcctttgggaggctgggatttctccctggggatcacatcagggatgaaaccctactcaggttccgctctcctgttcacttctctctttttctctaatcgtccgttcaccctggtggtagactttcctcactcctctttttggctttgttgctcttcggcggctctcgccctcagggcttgcattggtggttcttctggtgatctccatgtctctcatctctctggaaggtgttacagttttacagtttgttctaagaaagttggcctttggatctataatcttagatccttcacttgcaaggattatgttgctcggtttttcctctagagagatgggggccctaactggcataaggaatatgatatctggtcggcagctcaagaggctgattggacaattgttcgtcacaagaaaaagtctaagattgtttccaagactatctctagcagccgcaaatcagttcctcgtgccaacaatgctctagtgcctgtaaaattggtgttccatcggttgtcttctttcttctggcgatcaccggaggtaagatggataagaatccagttaatgtgggggcggtattttagctaggtcttctaggatttcaaattcaaaatctaaggctgaatcatcgcctctgtctgttaaagcctcttctgttagtaggcctagttgccctagatgtcagaagccaggtcatttggaatctaactccataaatagagtccgctgtgcagcttgctctaaacttgatcatcgggcttcagtgtgctggaaccaaaagtctgaaaagaaagtctgggttcgcaagcccaaggctaaaaagcccattggttcagttattgcttcttctagtcggaggcccgcaactgatagtttggttgtttcgtggaagtcgctggaggaagagcataatattttagttggcatcgtttcgtgccttaattataggcagttgcagcctgacgcttcttcttcctctcttcctctcgctctccgcccaaatccaatctatagtgctccaaaaaccccaatggccaacatcaatccggatcctactccattcgtcccgccgacgatggcgatcaatgatgcttggcttcactgtctccctcgtgcagatttgatcatcatggatgaacctcccaagaagcatgaaggtatcgcagttgccattcttgaaccccctcccaagaagcaagagcattttgtccttgtggtttactacgttcaaaacactctgggttatcatgtgttggacaccagtaggcatgcatctgagtttgcttttattcacattgcctcggctgtgcttagagatgctctagtattgggagggccatatgatgtcaatgaacagattaccctaagatttgtcaaccatgataacacctccacttgccacaattcccctccaattagagagggttgggtgatgttcttagatttccctctagacctacaaaccgacagaattgtggacaaaccagttggtacttttggttggttgctttgttggtccagtggaccaaggttcagaggcagggttcttgcgaaggtcatttactccatggttgaggaggtccctctctaaggtggtgattaagaagtactcaagctttggaggtgttggccgctcctagacagtttctgtgtttgtgcttaatggggactttgcagatgtccagcctgcagatgaggatctgccacttgtgaaccacattcccttgccagaaccatctcctgttcctcaacaagctaatgtttggggaaatgcagatgaagacataggtgagaatgatgaagtgaatgcacagatctaggaagaactttctcacaatgtcagtgctgtctcccagcaggactcaggggaatggcaaattttccctgcccatcaagtggcacctactatttctttggatgttgcaatggggccactggtcagccagactgaggaagttgtgccttcattcattgtttaccctcagttttggaaactgctcagcatttgtaggactctcctgtgtgggccaagattgcttgggcctcagcccatgtcatctgatgtagtcccataccagctgcctgtccatcatgtttttcaatttgccatgctagcttctgcattgatatgggccaaagaaaactgggtcagccaacaagttatttcagtccaaccgattcaagctatccatcctcaacacacagtttcagtgttgaatcttctcctggacccattccaacaagatgtctctcctgctctacccccaaggcccaaaaggaggactgggaagttgattttgttggattcagaaatacggagaagtgaaagaattaacaagctttctgatggatttatgtcccctgacccaaatttgggtgtgggaaagccaaggggaaaggctagggcaaagagctccaagaagcttaaaatgctggctcaagaaagtggtatcttgctctctctcaaccctttgcctttggaacttaatgatcgtattgcttaagatgatgagattgatgcccccctgctgattgttctatacagcttcaacagattggcactgatgtctgtgggatgagcagggagatggtatctgctgaagctttgactgcccatgctggaaatgggagtcactgtgctgctgctccctaaattctgccccaatgaacagtcctattttgttattttgttgccctatgttgggtctctccaagatttgtaataatgaatttgcctttaaaagctgtgctattatgatgaatgggacttctgcctggatcgtttcatctgttactcttcgctcctatgttatgcataggactctatcttattgctctttgtttgacaatgaattcacacaatagaaactggaatattttgtgttggaatgtcaggggtctcaactcttcctctcgttgtcaggctgtaaagcaaaagatagatgaaagttcttgctcgattttttgtttgcaagaaacaaaaaaggatcatttggcgccaagttcgttaagacgctagcccctaaaagatttgataatttccttttttctccttctgttggagcctcggggggtgttttcattggctagtgaagctctatgttttttggtgtgctcctgcaacaaacccaacatgttttagtggtcagtttcacttcaaagtcaaatggtcagaattgggttttgatcaatgtttatggtccctcctgtggtccccagagagatgagtttgtacagtggttacacgatcttgatattgccaatgattattggacgatcctaggagatttcaactcctacgggtctattgacaatagaaataaaccgggggacaacatgaatgatatttttatattcaatgatgtaatcagttccttgggcctgctagaaatccctctaagtggaagatcttacacattgagtaatatgcaagcagacccccttcttgaataactggactgggtttttacttcggctaattggatcagtgccttccctaacacgcaagccctagttatggccaggaatacctctgatcatgctcctattaaaattcagattgctacctccatacctaagtccaacgttttcagatttgagaattactggttgaagcagcctgggtttttggatcatatcacttctgcatggacagacattcttcacataactgatcaagcaaaactgatttctgctaaatttaagaggttgcgttgctctcttaagaaatggagccaagctatctctaagttgtctagaacaattgagaatattctttgtgccctaatacactctctggatttttccatgaattttcggagctcaagaaataattttaaagtcacaaagttcattaaactaatttaaataaaaaagaaaactaattaaaatcatccttcctctctttgggcccctttcggcccaatccccctttccctcctgcggcccgcgcgccctctctcggctggccttccccctcgtttcttgggccgtcggcccgtttttcctccctcgcaagtccagctcgcctctcccttcgcaagtccgttttgcctccctctcccatccctctctcactctctccccgacaggtgggacctgtggaacccacctgtcatctcctacctccggctccccactcccaaccaccatggccacccgagccgccccacgtcgccgcttcccccgcccacctcctccaccccgcgtgctccagcctggccgtgggacctcgccgcccatgtcctcactctcctaccccactccttcccacgcaaaactggcgccggatcggcccccacgaccccacgcctctcccccactccggccggcgattccgcccctcccggcctcgatctcgagctccccgcgctataaaaatgctccgcgagtcctcttccatttctccatttttcctgagcttctcgcgccccgtactgctctccccacgctgctccccatcaccgcccacctccagcgagctccggccgccatttcccgtcgctagggccgccgccacactgccccgccgccacgttcggcatcaccgagccaagccctatctcggcatcccctcttttccccaatctcccaccaaaacactaccccactgtcaacccgagccgccatcgcctttgcgagctccggccgtcgttccccgtggctggaacctccgccgcactgtgtcaccgccaccactggcttcgccgcagcaatcccaagcccggccaccgcttcttttctcctcgccaccaccgaaaccaccccttcaccgcgtacccgagccacctcccccattgctgcctctggctgcaatttcccttggtaccgcgcctcctcctcccttcctaacccctctactctctctcccaggctgtgttgtgccccggccgctcctccttcgccggacgtcgccggagtcccaccgttgccgtgcctccccgtggagcccgtcgccgccgcgttcccgttgtctcctctccgttgcgcgagctcggtgagcatccctccctctccctctatctccccttcgccggccgcccgcgttgcaccgccgccgccggtggccatccggctaggccgctgtcgccgccgttcgccgccgcttggccggccggtctcggctgcgcccgccctgcactgtggccgcccgtggaccggcgtggtcctggtccacggcgcgcctgaggccgcggtggaccgtgtccaccgtgggccgcccccttgagccgctgatgcctggggcccacctgtcggtgccggccccctctttgatgacgtcagcatgtctttttttctttggaaaaacaatcaataattgcgcaataaatcaataataattctagaaatctattaaaatggctcaaaacttctaaaattcatatctaattcattcgaactccgaattgagccattcaacttgcaaaattcatctaaaattgagatctacatgtttgtttactttttatgtactgtttgcttggtttttattagagtttttcctcgttttgcgtgccagcgtgtagaatccgtcgtttcggaagtccgcggtcgcaaggataagagttcagaaggttgttgtgaagaagcaaggcaagtcacatattccccttgagcatattgagcctactttacaaatgttttactgtttgcaaataaatatgcatgttttgctaattacatgggatcagggtttcacctatctgctcgcttgtgccatgtttacttgatgtctgtcctttgtcaacattgggtaataaatcgactagctcatgttacttatgtgacctagctagaactatatgcttagctatgcttaattaccactagctcagttgatgggataattacagtattagacctttttagtattagaatgagctgcgtgctcgagacatctggccatgcttcatggtcataattatccaactaaaatgcgactaaatggtgggctgtgggtgcatggttttgctagtcacacccatggcaattaaggactggttcgcgggatgccctagaagaacttattgtacttaccacaaaccagcgtgggcaacggctgggcttgtagtgtagctttcctctagctgatgtacccaggtaagggtgggcgttatggagttgggtcggccggggtgttcggttgatcggcttttagattcaccgtggcacgagagaggggctgcccgttgcctgctggggacgggggcgaaccctgaggtgtggtgcgatcggttagagggggttatgcgaagggtcatgtcacggcctctttccggtatgttgtggtggcatgtcggcacacggaaatgtgtcgtggggctgtgtcttgtgggtacagttgtacacctctaatcagagtaaaactattcgaatagccgtgcccgcggttatgggcggtcgactagattcaccgtgattagtcccaccttaataaatcaactcaatgcaccgtagttcaggtgggttagttgggcctgttcaatgtggtatagcgttgatcagtggagatttaatattaccttaattactctattgttttactgtttgctcaataaaatgttttacaaccgcctttatgcaaatagccacaaaccgtccttgtattcccatgcacgtctgcatcattggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccactgctgctgctttcgtttcggtgtgtggactaagcgcctcttctgtaagtattttacgctttatttacgtttggaactgtatattacttatcgttttgtgtaccctggctggtcctggacagagatttagtctggaaatttgggctaaatttctgggtgtgacatggctccttttggtggaaggatgttttctaatatgatgtcttattcagaggaattgccaaacctgtcttggattcgggaaatgacgtgctttattgggatgatttatgggaaggagtgattcggtcctctaaatatccaagattattttcctatgctaagcacaaagatgactccgtagcccagcatctggctcgagatccacaagatcagttcttcctccctctctcccaacaagcctttgatgagtacaatgatatgaagagagaactctaggacttttctcttcaggatacaactgactcttggacttatatatggggatcggcaaagtacacttcaagactctgctataaactcagtttctggtctttatcccctcccatcaattttaaatggatctagcagagtaaggttaatatgaaaataaaggttttcggctggctgttgtttttggacagagtgaatactagggatctgctggagaggaaacactgtgctcctttgaatgcctcagacatctgcccttcttgctcaaccaatgctagagaaaacagggagcacctgttttttctttgccctttcagctcagcctgttggaataagttgggttggtgctgtgatactactctgcagtttcatcaaatgattcaagcccaactggcagtggtatcgcaccaatgcttcatggaattgttcttaattgcagcttggaatatttggaaggagaggaatgggcttatctttcagggtatccaaccttcagtgcgtaactggttaagaaacttgaaggatgacttgagtatacatttaggtatccatccttcagtgcgtaactggttaagaaacttgaaggatgacttgagtatacatttaattaggctcatggatagagcaactgtaatttttgtttagttttccgttttcttcttctcgtttgtcttctatacatatactctatggaaattaatataccgtgggggcatccctcactgttttctggtaaagaaaaatataatggattttgactttttcttgcactgttagaccactcgtcttattaaaaaaatttggaattattatttattttatttgtgacttactttattatccaaagtactttaagcacaacttttcattttttaatatttggacaattttttttaaataagacgagtggttaaacagtgcaaagcaaaaaatcaaaatcccttatattacgggatggagggagcatgtaggatggccatgccatgtgcacaatgttccctaatatcccaattcctagggaacctttctatccctaggattttacaggagaaaacgtagggcactttcaatttcccccacattgttttcccttggaattgtgttctctatgaatctctttaggactgtgtgccttttttccgacgccacccattctcagataaatcaactttggtagcaagtgatgctgcaggccctgcagcatgtgtatgaatttaccatctatcgttgcatttggtaaaacctacaatgggaggcacgatggttgcatgatttttgtgcagtggatgaaccagatgagcgatcatggattgcaaaatgaacaaaacctatccaggaagcatatataaatagtggttgtgcccgcgggggagagggagggggggggggtgtaagacgtagtaagtactttcttaataaaatgaagtcaaagatgctgatcgatgactacaacaacataggtcacagaaagtaaactaaacaaggaggccctagtacagatcctctcatctgtgacggcccatcacatgcctgggcaacgtaggccatcagaacgaagtcatcccaatcgggcctaaatttttgccgttgtagatgtactcgtcggggtgcatattcctatagctcgtcaccgatgacactcatctgtgacagactcgaagtttggcccgattgagatgacctccactatctcaattgggcccaaatactgagcccgtcacagatgagtgtcatcggtgacgggctccaaagaaggcccgattgagatggccttaatgcccgtcaccgatgactcttatcggtgtcgggcttctatttctgcccgttagagattagtgtgcgcccgttagagatgacatttttttggcccgattgtgatatactttgcacactatatatactccagcagtctgttgtctgtagttatcccactgttcactattttggtgggaggttgaaggggtgaatttttttgcaaacaaaaacaggaaaatcataaaagtaagtaaaagggtactaatcatttcctattaatttagtagtacttatgttatgagatgttaactaatattttgttcattgttcaacgatggatagaagttggatgtacacgactggcttgaggtgtcagtacaaggagtatagagatggcgtattaagttttatgaaagccgcagtggaggataggataagaagaaatgacaagtacatgtgttgtccatgtaacgattgcaggaatgagatttggttggacgatgaaaaggaagtacacgctcacttgatacgccggggattcatggagagatacacatgttgggtgaagcatggagagcaagatctgggtactgatggtgcagctgcagacggaagtggtgcagacaatcatgaagaaggacatgaagaagagcatgacatgtttgtcccatctccattgggcggtgaaatggttgatgtggaactgatatgctgcaagacatattacgtgacgttgatgacccagctatgaacgagagagattccatgaagttcagcaggttggtcagtgactcggagactcaatgaagttgaagcacaccaaattatcagcaacattagacctaatgaagttgaaggctagtagtggatggtcagacaagagttttacagaacttttgggaatactgaaggacatgcttcctcaggagaacacattgcccgagacgacatatgaagcaaaacaggttctgtgtctcctagggttagaggtccggagaattcacgcatgtccaaacgattgcatattgtaccacaagcaataggcggacttagatgtttgtcctgtctgcaaagcttctcgatacaagcgaaaaaagagcgcgggggagggaaagaagtcaaagcggggtggtctggcgaaggttgtgtggtatctaccaatcattgatcgtttcaagagaatatttgccaaccccaatgaagaaaagttagtacgttagcatgccatagagagaaggaatgacggtttgctaagacaccttgcggattcgatccaatggaggaatattgatcgaaagcacaaagactttgctgtcgaccccagaaacatgaggatatgtttgtgtacggatggcatgaatcctttcggagacatgagcagttctcacagcacttggccagttcttattgcgaactataacttcccgccatggttgtgcttcaaaaggaaatatattatgttgtgcttgttaatccaaggtccgagacaacccggcaatgatatcgatgtgttcttggagcctgttattgatgaccttgagattttgtagaaagagggtgtggaaacttgggatgcatatggtcaggagaacttcacgctacgagttctattgttctgcaccattaatgattatcccgcgctgggtaatctttctggacaaaccgtgaaaggaaagaaggcatgctctgactgtatggaacatacacgcagtaggtggctgaagaaatcaagaaagatggtttacatgggtcataggagatggctccccctacggcacgcctttagaagaacgaagaaaattttcaatggtaagaaagaactagggtctgcccctgcggatttgtccggagatcaggtacacaacatggtgaaggacattactaatgagtttgggaagaaaagaaaacgtagcaaggaggacaagaagaggatgtggaagaaaaaatccatattttggcggctacctcactaggaagttcttaaggtccgtcattgcattgatctgatccacgtagagaagaatgtgtgcgatagcttgctggggctattactgaatatgcctggcaagacaaaggacgggttgaatgcgcgtctcgatctacaggagatgaacattcgcagtgaacttcagcctgttacagatgagaagacaggaagagtgtacctcccaccagctagccatacattgtcgaaggatgagaagatcgcaatgctatcatgtctggtagatattaaagttccttcgggctattgcgcgagaataagtaagtacgttaaattggaggatctaaagctggttggaatgaagtctcacgattgccacgtgctaatcacacagatcttgccagttgctatcagaggcattctaccaccacaagtccatcacatgatccaacggctttgtgccttcttcaatacaattggtcagaagattatagatccagaagacctagatggtttgcaggccgatattgtcagtaccctgtgtcacttggagatgtattttccactggctttcttcgatatcatggttcatctcactgttcacctagtgaagcaaacaaaaatatgtgggccagcttttatgagagaaatgtggccattcgagaggtacattggaattctgaagtcctacgttcggaacagagcaaaaccagaggggagcatcattgaaggttacatgaccgaggaagccattgagttctgtatcgattacatggccgagactgatcctattggagttccttcgtctcgccacaaaggaaggttggcaggtgtcggcacaactggcagaaaaagaattgttctagatcaagcttcctacgcgcaggctcatttcgcagtgctgcaacatatggctgaagtaaccccatactttgaggagcatttagcgaaggtccgacaggacaatattggtcgatcagatatttggatcaacagagaacatggtgctcgtttcaacgaatggttcaaggatcgtgtagtacggtcgaccgatggcccaagtgagatattacaaaggttggcaaggggtccatcttgggatgttgacacatggcatgggtacgatatcaatggatacacattttacaccgtcacataagatgagaaaagcacagtgcaaaacagtggagtccgtatagatgcatatcaggatcaggctggatcgagcacatactacggccgcatagagcagatatgggagctgaactatctaaacttcaaagtccctttgtttcattgcagttgggtgaatatccgcacaggtgtcaaggtcgacaaggaaggcttcacattagtggacctggccaaggttggatacgcagacgaaccattcgtactaacgaagcaggttgaacaaattttctacataaaagaccccgcaaacaagaagatgcacatcgttagggatggcaagagaagaattgtgggggtggacaacatcgtcgatgaagaagaatacaacaagaatcttcatgtcagacctcaaatcgaccttgacgatgatcccaaagacgaagtggcttacgttcgttcagaccattcggaaggcatatcactgtgaatgatgtatttaatttgtattggagccttaatgaatgaattgcatatgtttcatgccattctagttaaaactctttgaagaaatggatttgttaattatatggttttaaaaaattatacttgttattttaaactatatgtgagaaagccaattgttaattgtatgaatttaaaaaagtaatatgaattttaaactatatgtgagaaaggcatttgtcaattagatgattttaaaaaattaataggaattttaaactatatgtgagaaaggcaattgtagattatatgattttaaaaaattaataggaattttaaactatgtaaataagacatttgttaattatatgtgataaataaaatgtaatagaaattttaaatcgggtagaagttaattataaatgatttttataacttaaaaatattttaataagtcatctgtgatgggctttagtactatgcccgatagagattattccatctctatcgggcttagtgctaatgcccgtcacagatgactttcatccttatcgggcagagtactaacgcccgtcacggatgagtgtcatccgcatcgggcatagtagtctgcccgatagagatgaggattgactagggtttatttagtcaatcctcatcccgacgccgcctctcactctctcacactctcactctctcagatccaccgccgtcggcgcctccctccacgcctcccggttcaagatccaccgccgcctcctcctcctcgacgccgccacctcctcccggttcaacatccaccgctgcctcctccctcgtcgtggataccgcctccccgactgccgccgccgtctcccggttcaagatctggcctccccgaccgccagcgcctcctccgcacccaagaccgccgccgccgccggcctcttctccaagtccgtgtcctccatgcccaagatcccgccgccggcttcctctccgcctagtcctcaagaccgacgccgtggccgtttcaccgaccgccgccgcctcctcgtcctcaacgctgccgcctcctcctccctcgaagatccggcctcactgaccacggccgcctcatatcctcctctctagatctacgcccagcggccgtcgacctcgtcctagccgccgcgtcgacctccttcacgccgctgcctccctctactgattgccgaccgccgccgttgcgcaagaccgccgttcccgaggccggggccgctcaagatccggcctccccgacggccaccgcctccctccacgccgtccccgagcccggcaccgcccaagaccagcgtccccgagcccgacgcctccctccacggcgtccctgagcccggcgccgcccaagaccgccgtccccaagcgaggtaggtactcctcaccgatgatgatgcataatgtgatgatttgctgtgtacatgttatatgtgatgatttgatgattcgatgataatgtttaaattcgataatgtgatagtgcgattatttgttgattcaatgtttagatgctaatgtctacatatgaattgtgctagtgatgaatttttgtatggctgtgatgacttgtgcatttttatatgtgttagctaatgatgaatttttatatggctgtgatgacttgtgcatttttatatgtgttagctagtggtgaatttttatatggctgtgatgacttgtgcatttttatatgtgttagctagtgatgaatttttatatggctgtgatggatgaatttgggggagaatgggatgttgggaaaaatgtttagatgtgggctgtgatgatgaaatattgtgggctatgatggatgaatggccagtgatgattgctcaagaacataccatttttgggatgaattgttgtgggctgtttttctatgtctatttttttactgcataaggacagacttgttcttatatagttgtttgcaaaatatttagggtattttgggtccaatgggatggatgaattgatgtgggctatgatggttgaattattttgggggaaatgtgagttttggtatgtgacctgtgttttttatggctgtttttatatggctgtttttttttgcatgacagaccctctacacttgttcttatatggttgtttgcaaaatttttgggatattttgggtctaatgggatggatgaattggtgtgggctgtgatggttgacttattttgggggaaatgtgaattttggtatgtgacctgtgttttttatggctatttttatatgactgttttttttttcataagaacagaccctctagacttgttcttatatagttctttgcaaaatttttgggatattttgggtccaatgggatggatgaattgatgtcggctgtgatggttgaattattatggctgtttttatatggatgtttcttttttgcatgaggatagaccatctacaattgttcttaatttcttttgggggtgggggcagttgcaaatgatggtaattgatgcataatttcttagcaaaactgaggccaaacttattatatgtcatgacttttgtttttttaggtacaaaaaataatatatatgtgacttgtgtagtatgggctgttttgggtgattttgagggaaatgggatggatatgcatagaaatctgttatcaaatgaagttactgaaattatggcatttaggagaatacgaagtgtcccagttgccaaatctggtttggtcgggttactgcctgcacggtactgaccaagacaaattggtaaacagaacatttcattcaaatacaacatttctagaaatctgttatcgttaccaatatcctagattgctttcaaggtcatttctttaggaaaccccattcccataaattcagtatccaaagatggttgttgtatctatgggaataagggttccctaacgaaatgatcttggacgcaatctaggagtttgctgataataacgttagggatcttggataggaaaggttttggttgcctgtgtattctatctgcgtccgcctcgtcagcagatatgtagcatccatgttccttagggccggaccagacgggatctcgacctggacatccatatcccactagaacttgctaccgttgccactatcttatggtagtgacattgatagcaagttcgagtgggatactgatgtcgaggtcgagttttcggctgctccggccttattgagcatggatgctatggttccgtcgacgaggcgaacacaggtaggagatagaggtatatcaaaccatcagagaatgtgtgtagatgcaattttgtgtttaaaaagtactttctccccgtacaacagtgacataggacatgttgtagcaaggcgaaccaatgtcgacgaccactactgggactacttcgagccggaatcctaggacccagaataagattcctaaggaagtctacaccataacagaggtggatgatgtttgatatccgacggctccgacgaaagctgtcaaaaagttccctacgatatgcggagtcctagggaggcgaaacttcactattctgaaggaccacatcgatctggtccctcaagaagaagaagaagaggcctggaggcagttcaaggaaagcttccgataccctacagaggccgaggcaggactcaagcggcagactatccgcaagatggggaattgttggaaaaatttcaagacaacgttggtcatggagtacgtcctcaaccccgcccagccaaaaccatttgggaaatacccattcatcacccgacccatgtgggatgagttccatgcctccaaatcaacgaaagagtctcgggcaaaaagccaggcctaccgtgatctgcaggcaaggaaccttcacccgcaccggcttggcaccggaggctacgcggggaaacagtctgaataggacaaggaggatgaagctgcagcggaatctaacaccccgcaagtgcttgctgatatcccggtccagcgggcaaggaactgggcaagggcatgggtgaagaagaatagtgacgaaactctttcgttcccaaatcccgaagatcaagcggtgtaccagaaaattgtaagttgaacacatagaataagtttcattatgttgtatcgtattcttcgtttaacgcgtcctaactgtaccgcaggtcgaactgaatgctgagagacaggcctcccaagaggtctgctcacaaaaacgcgaggatgacatcttcacgaaagcgttgggaaacgaagaacaccgtggacgaacaaggggcattggctccaatgttccatgaaagtttgggtttccccaatacgtgtggcagtacaagaagcacaagctttccaaggcgtagaaagctgcacgcattaaggcccaacttcgggaggagcttaaagaagagcttagagaagagctcactgccgagctgttaggtatggaggctcggatggaggcacgcatcagggataggtcgaccgatgccactcccggtcccatagtacaagtgagccccacgcagaggcgtagcagctgcacatcaactgaggctcctgcagaacagcttgaaggccctgccgcggtggtccacataatggtaaaaacaacttaataacgcatatactgtattagcaccacaatacattgcaacatatactaaggacactaatgaatctatcgcaggaacccacatcgtgtaccctagtcattaggatgacaccaggatttgcaattcctgccgcagagggtcaagcattcaagcctaccccggagacctgagtgcatggggcgcagctgctagccagcaatgccgaagttcaggtggacttagtgaagcccaattgggttggctacactatcccacacccacctaatgatgagattctgacccttggggctgcacgtgggacctttattcaatggcccaagcacaacattgagatcaatataactccaagcaagagggcgaaatcttctccacccaagcttgacacacgcagaaaagctgctggaacggggagaggaaaagtaaaggtgccattagccccaaataagcttgatcttggcaaggcgtcaggagctcctccaaagcctccagccgaattcacattgggcatgccattggtcggagacgatgccttattctagatgggcctttcatgcaaggagttgcatgggtactacatggagaagtccaacgcaaggaggaataatagagagacctccatggtaggccagcacggtggtcagccgttcctcaggcctactgccttcatcgccgtagacttcaaagatctatgagacctctatagggtgcgagcgatcgataccaacctccttaagtgctactccttgtaagtatttcttggtacgcgatatggtagtgactgtccataaattacacttaccgtgactcttgtcttgctcgtaggttaacctggaagcatgtccatcgtaaagcaccccatgttgccttactcgatccagctgtcatcaatgagacaacgctgaaaaacgatcgagcaaacatagtgggctatatcaaggactgcttatttgcccatcaagacaaggacttcactatgtgtgcctacaatcaacagtaagcgtgtaccgtacttatactcaaatactcgacgcgtacaactgtagtatgtaactggcaatttaataatttcgcaggcaatattggattcttctggtaataacgccgaagtggagtttgatacactagcttaactccaatatcaagccagaaatatacgattggtcggccatcgaatctaccttgaatgaggcatgggaccaatacgtggcaagaggcgggaggcataaggatgggcatcccaaactcggtcacaagaaagacttcccaatacgccaacaagttggcgaccagtgcgggtttcatgtctgccataacatgaggagctttgcagacaaagtgacattgctcgaccctgaggtgtgtaattcaattgtttatacacacataggatgacaaatttacaagtatgtagactaacttggcgctgaacattcaggaatttatttcaaggatttcggaaatcaacatcgaaatcattagagaggagatagcacaattcatactagatgatatcttgtcaccgaaagggatgtttagagtgaagtcctaggtagctcgtctcggaatggcagaacatttgcaatgcatatgcgacaaacatttgatttttgtaaatattctttgtaatacgattatattctttagagtaatgtcctaggtagctcgtctctgtatatacttgcatttctacttacatataaaattgttccaatttataacttagttttgcaggttttgatgcatgtcggcggtttggagagaaaaatggatgtgaatgacatatatatgtgaatgggttgtggatgtgaatgtatatgtgtttgattttgtgaattggctatgctgtgatggaatatgaatgtgaattggctgatgtgatgctgggaatggatctatatgaattggctgtgaattggctgtgatggtatatgtgaattgatgctgggaatggggttgctgggaatgggactatgtatatatatgcttctgtcatttttgcagcgggcatggctagcaaaggcctgaggctagccaaaaagacaaattttatttattttttggttctaaactcatccctgacgggcatttagctaatgcccgaaagagataactcatccgtgacgggctatagagtcaagcctgttagagattagtcatccgtgacgggcttttagaatacacccgatagagataagtcatccgaaccgggactagtttgactcaacacgtagggtcaaacctatcggtgacgagctctggctaaatgcccgatggagatgactacttatccgtgacgggcttagtggtgtgcccgattgagattagttatccatgacgggttcctaactatggtggtttgactggtcatactcatctatgacgggcttggttgtcagcccgattgagatagcatccatccgtgacgggctttagcccgattgagatattttctcacatcagtgacctgtgcccactgacgggggccttacccgatagtgatgaggctttcagcccgttagagataagcgatcccgttctagtgaggttggatttccttacgtttccctcgtttgaacttacaaatgtacaacccaactcgtatgcaatatataaacttgaaatacaaaagttgtctcgttcagttttttgttccatttataatttgctgtctttgtgagttcacacatatatgtttatacttaaacattgttatccttttatgcttataatacttggggtttccgttagcccgtagtaccaaatgcctagtggcactactacaaaaaaagctcatagagatcggcactgtaggtgccggaccagctaaaaccggcacctataatgcttttccctcctctatagactgaaaatacataaaaccgacacctttaaacaacaataggtgcccgttctaaagaagaacctacacctataatataagtgccagttttctttaatataatataggtgccggttttttaaagaaaaccgacacctataccataggtatcggttcttctttagaaccaacacctataataagttataggtttcgacttatttaaaaaaaaggcacctttctaaaccaagccgagccgagccgagccaatccatgccgacgccctatatgagtcaaacttatcggcctcatctctatctccctctctctcgccttctctcgcctcctctcttggttctcgtctctctctcgtcttctctctgcggcgggcgacgggcttcggcggcggcgtgatggaaggcggcgggcaacggccggcggcgtgatgggaggcggcgggcggtggcagcgccctcccctccacaggatctagccagaggggaggcggcgggcggcggcgtgatgggaggcaccgggcgatggccggcagcggcgccctcccctccgccggatctggcgggagggaggcggcgggcagcggcagcgcccttccctccaccggatctggccggaggggaggcggcgggcggcggcacaagaggggcccaccggcggccagcccctcttcctccctcatctcttctttgtagatttttgattagatgttttgatcaattttggtgacggtttgtgaatgattatatgtgatgtcaatcaattttggtgacgatttgtggataatttggggatttgggtttgggcacatggctacggtgctcagtgagttcggctcgattcgagccggctcttttttttttctcgagcaaagctaaaggtgccggtttatattattggtgccgaccaataggtgccggttggaaaaccggtacttatagtcgattcccaaccggccccaataaccctttttgtagtagtgtggacaacactttaaattgccggggagcaatgaactacctccggcgaaaactcacacgagagcatgcacacaagaaataaattttgaggattattaacacacaacgggatatgatgacaaacaccagccacgcacactttttcttattgcaattcacacacttggtgacaaccaagtgatacacggcggcttaaggttgcgttcgtttgtgccggttgagagtttatccctccggcataaaaaacggaacagcttattagcacataattaattaaggattagctaaaattaacttaaaaaatggattaatatgattttttaaacaactttcctatataatgttttttttacaaaaagcaaaacgtttattagtttgaaaagcgtgtacgtggaaaacgaaggagaggggttggaaacaaagggtgccgaacaaagcctaagtagcctcgtgtacatgcattctgcagcttcaacgacttggctaactcatacgaatgcatcagccatcctcgcaagtcatgctacgtgctccactcatatatatgcatgcagctacggattctactgcaccacttgctgatcctatatataatctagctataacagcctgagacttactcctactaacacatacagcacacgcacgtgcagttactaattgagccatctacacttgcacgctagtccagtacatgacatacatgaatcctattagatgtctaatacgtgaacacccataacatatatctagctaacataaaccttgtcaagattagtgctaacagatcatggacactatggactggggcatggtgtatatgtggtgtactcgaatcttagacgatggtcctatcttgttcaaccttggcttctagttttctcctttacaagtttgaattcatgtgagcttagtagtgatgctgctcacgcctgtttgtgttggaaacacgctcgcaggcctgtgtttttcctgcttcgtcgtgccgtgctcgtcgatcgtgacctgaacgtctgtgggacggcacggatagtgatgaccatgacacgtgtttagggtggcttgaccacatcatgataatgtgtttcggatttgtaagcatgcagcgagagaatctcggagaagagcgctgcgaattgtntttttgggggggcaaggccaccaaccccaaaacctttttggaatttgatttgggtttccggggttttcccccccccattttggagtttcacgtgtgtgttgaattcgaccaggagagctgatttaatacaacttggaagagatcgagctttccgcggttcaagttgcgccgatatgttagcgttggagaaggatgcatagaatgcatacaaaatcttgtaaaatcgagaaacttggaggaatggatgctatttttttcaattgagaatgttccattgaatcaaatccatgtctaatttcctgcaaaacacactaccaattttcatccaagtgcacaaactgggatcgctggggtagaaaatgtttaagcagactatccgtatccctgtctccatggctgtatgcttgagctttggaagccctactaaacccatgatgcatccacatggaaaaaccagcccttatatatctgaataagaatcatgtctgaactctgacgagaggatcgatgatgaaaaaagaagtacataagtaaccacgtacgcgaaaatttaattcatgattcagccatgtctctgtggaaggcaacaactagctagctagctgcactctcagtccaagggcttgggcccaaccacctccatcgtcgcacaaataatccatggctgcctgacacagtgagcccagggccctagcccgaagcccagggtcgtcagacattggctccgacgcttgctagagtaacgtaagaggtaggcagatcatgcagtatgtttcttttccaatgccatccattctcaagtaaactgatgtaacagtgttgctgtagtacgtgtatatgttacaaacacgaacagtgctaaatagaaagcattacctatcacttgccagggatagatctagagtctggacagacgtacgacaggaggaaaatcacttacttggatgggatgatagtttgcttcctgcaaaggatgaagtagatggatagaaaggatgaagtagatggatagaaaaagcttatgaatacgagagtggaagtagccacgggacatataagaagaatcaatactcggttggtggttgtagtaagtatactcccttcagactgataatacttgtcattttagataagggtgaggtcaaactttacaatctttgattatgaatcatttttaaaatatttatctttcatatatggtgattacatgtatagattagtcttaaaaagtactttaataaaatcatatattttttaacattcttatacatattataatgaaaaataatggtcaaagttgtttttttgagaccatgctcttgtccaaaatgacaagaattatcaacccggagggagtactttcttaactttgaagaaagcacggctagaaaagcaaatttccagacgatgacatttttttcaggtaggtaggcctctccgagctaaatgaccacctgcgaaaatgacaaccgtgaggtgaaatcgttgtccacctgcaaaaatacacttaagttgatcagaagttgataactatatataccatgtaggccatataaaggaaactgaacgagatggtctttgtttttttttaacgaatcgcactagagagtgtaaagttctactgatagagtaggaaaaaataacaaaattacaacccttgaagatggtaaccaggaaaaagaaaaaaaaagtatactaccactcacacacccacaacgccaacacatagactcaggagaaggctagcatcagaccagccaccgctaagtgtaaccgacagccactaagccgtacaacggaacacagccgacatcgcccaaaacccgaccattacaactgacacaaaacacagctctatctaaatctttgggattgagggtgagagggtgagagagaagaatgcagccattctccccctaagccctccaacgtggccaacttgcggaagctaggatgccgacataagagaatatgaattagagagagcttgcaccaattgcttgggagattttggcaagggggtgcctacacggcatctctaacgagaggagcgatggatacaccgccgccgttgtccgtcaaggcctcaagagggccaagactgggttttcacccgatagccccactggaggtgaaggggcggcacgacaacgccctcaagaagggtaaagacgttcgaaaatgccgtcgttgctagcccggccaaggccaaggccgggctaggtttttacccgtcgcctaccgcctgcgagtctacaaatgatgccccgttgctccaccaccgtcaagcctccacaggcgcgtgggcttcactgcaccggctctccccaccggttagcctttgcgtgccgcgccagcctccaccacctgccgaccgcgcctcgacgtgctgcgccggcctccgttgccaccggtggcatctcctcgcgccgtgtcggcctccatcgccatcgtccgcgcctcctcgcgccgtgtcagcctccggccttgctccgcagccatcaaactgctcacgccgtcgctgtcgcccacaacccaccatgcccgcatgcggccgtcgctctccttcttccccattgccggtcacctccttcctcgcctcctctctggctatcgccgtcgtcgacacgccagtccaccgcatcctcctcccgtgcgccggccgtgtcccatctccctgcatgccagcgcagctccagccggcttcgcgcccgccgctgctagcagccaccgtcgctgccgccagcaccactggtcgccgccaccaaaaccactcaagcccggctgccatcgccagccgccatccccgccagatccgaccggcgcagcgcggatctggtcggggtgctctgccgccgccgctgccaccactcagcccaaccgccagcctccaccccacgagatccggccagaatggcgcggatctggacggttgccaccaccgccgccccgagcaattgccccgaccaccggacgcacgctgggcgcagccccgccgccgccgtccttgcggccacgcggctttgcctacgcccgctcaggcggcggcgaggcagagaaggaagaagggggaggagggagttggcggtggcgtcacctctcgtgttgcccatgtggagagcgacacgagatcttatggtctttctattacatccacaaatgttttcttttcaagtaatgttaattactgatctttcctccaatttttttttcactcactaacatatatatgcacgtagaatatgtagtttatacttgtagcacatattattagtgattttctcttaccactttgtttcttttttgtcaccaagagatcatctctaaagctttgtggtctgtatggagtcgtcaagtaccttcattttgagaagatactaatcatttctcatgtttactagtcccaaaaaaaaaagtacgatcgttacggcagatcggaattgtatcactgtttgcatgcacagttgcccttcactcgcaagctcgtaagagaatcccagcgcattcttgtcatcaacgcatgcccaagttagggacttggctatctaccagcttcggggacaaaattgtactgccagctacacactgagccaaattcagtcactgagatcaagagagaggtccacgatatttcatccttttgccttaattccaactcaatgagctcagtgtcccgactcccgagccaccgcccgggatcgccagctggtggttctgctggtgcatgaactgtcatgcatcctaaagtgaacatccagtcctcttcttctccaatgctacccgttcttaaaatgaaatcttttagcaagctctttacaaggtacatgtttcagaactaaaaaattacatgtaaatagcatgagttgttttatatggcagactgatatatatgagttgatttttttttttttgcacgcgagagcatgtacccacagttacaccatgtatatatacaccttgcacgaatcctagggcagttacattaaggtgctaacaaaatatacctcgcatgatgtttcctttatactatattttttcaaatgtaaaacatcttgtttatgtgttttttttatttcttgtattttatatggttgccctattaattttatatgtttaattgcttgagatgtttttccttaatatgtttgatgaactgtaaaacatggtagcatatatatatcatttcgggagtatcatttttgtaagatgttaacctggtgaaaaatatattatgcaatttttcatgcgacgcttctgttgtatatatatgattcgtacctgggacccatctgtcgacgtgtaacatcctttctgtatgaaaataatattattctgatgtctcactataaaaaacaggtaattcatatttggcattgtagatataacttcaaatgaaaaaaaaagcattaactataatgttgtagatattgccgggcagtccaaatttcatatatagcttttccccatacgacgtcatttgaaaattttaaacattcttccgtggaaatagatcccaacactttgaacatctaaataaaaaaaatacatggttcaatctttcgttttcggtatttgtattaggggtgccgatatggtgatatttccgaaattttggtccgaaatttcaaacaaaatttagttaaatttaaacaaatattgctaaaattcatgagaattttttttaaaaaataaaatcgtatcggtgggggtggggtccgatatgaccaaatcttttgaaatttcgttcggaaattttgaaccctgacacaaatggatccaaggaagttgtagaactcgtcgaactctacgattttgccataaagtttttcataaaaggaaaaaactatcatttgaatatgtcggccttttccaatattcaatggataggtccgaactgtccggtcaattgagtataaatgctggttcatgttatgaagaaccagtgatgcttgtttcctatcactgccgatttataacaagaacaactagcagtgatacaatagtaatggttcataacaagaaccaagagtgatattcaagtatcactgctggttcagagtagtatcagtgactgttctaaggaaccaacaatcatgggccggtttgatttatttgaaatgataaagtatgtcctagaaagaaaactaaactggaagatggaatctgtcaacaaatttattttctcgatatacaggagaactacatagatgcattaagaattgtcagtaaaatacaatagctgcttttacttcctgcctactatacttttatggtggtgtttactagtagtagaaatgattgacaattgatctctcttttatttagtaaaccatatcaatttaataacaaatattatagtgaacaggatatagttgtgcaataaagcaagagcctcataaccaatgccacgaatcgtttctacttgcggtaaagaccattataaaagtggccataatggaatacatatggattcaaaatagaaatcaacatatttttcttttatagtcatactgacaacctacttaaagtcgagctattgacgaacccgtattcttcatggagagctcatgtgaataattaaccaaaatgtatatatggggtgtgtctgcaaattttcaactgccgatcgttactgcgtggctcttgtggcagccatcacatacagagcacaattcaaaaaagcacacccttaaacaaagttatgcttatttgccatatgcagaactcacgcaaattaaaccttatccagtattgtgctcatgctcggacgcaggcacctccactccatggatttgatcatcgctctgatactggcttcagtactagtgcacataatgacctgaaagtacataatgacttgaagggtgcattatgctcctttcccgatgccacacattctgaaatgatgattcaactcgatccatcaggtaagggcaagtgctataatagatgtgactaccacctctaaatttatctattttattcactcataaaataagagacaacctatacaatgtatcacctctagtactaaaaataccaatatatctaatactctcacactcttcttgaaatttgtgtagaggttacctcttgatttaggggtggctcatcatctctctcctcacttctctcctccatctcatcattcaatccaatgtgacactcttagaggcaatatatgaagtattatattacttgccctagctagctgagcaaaggagcaggaagcggcggtgcgcgcgtgcatccaagacgcaaagcaggcgctgcaccggcccccttgacatagcagctgcactgtgaatctctgctactttaaaagccagcggtgatggtagtgtctgcctccaccacttatagtttaatataatatatgttagtacaacaaattagaatgaaagaaatgagagaataggatagtagtataatatggataattttgatccattcttcgtgtatattataatatacgctttacaatatataattaagttatctttctttaacttacgtacgattgcaaggtatggacatttaattagctagtttgaataaatgtcaatatctacagttttttcactggcttattgctaagtgctaagtttcttttagataatggataatatctgagctttactttaacggaagctacaaccacatatatagttcttagctgaaaaccaagtataataatttttaataaaggataaagaaacgatacaataataaatgccacggtaaaaaaagagagacacttattcaagaacaatcctattgttaaatctccatccaaagttaacaaaaatttgcatagcggttgtctccaattttcgacatacagcgtgaataaccaccaatgtcctcttcacacctttgtagttgggtcaaaaccgaaccagtatagtgctctgatgagtacatgcatataaactttagttggtattttattaaaaaccatatcattcctatttaaccatatagccaacataaaaggcagatgctctaattgaaatatgttttttggtctttgagtaaatcccaatcagccaattataaaacatatgagtattgtaaaccaaattaaaagacataaaaatggttctaaaaaaattagccatttgacaatcaaagaatagatgttggacataaaaaacaacatctagtactaccattctaatttcttcttactaaattatcattgattaattagaactaccctttagctagataacacatgaaaatcttaagtttgataggaatcttcaatttccgtaacactttattcctatcaatatacccactgttgatcatagcaagatacatggatcaaacagaaaagataccattttgatgaaggttccacctaaacatatatttattatcattaaggttaatacgtacaattcgagcaacaaaattttgccaattaactatattctggcccactagttccctatggaaagaaacattcaaaggaactgtattcatgatagttgcaactgacgcacttttccgacgcacaatattatataaagatagataccaccctttaaaagaagagtttccaatccacttgtcctcccaaaatctacattgaggacaaaagattcaaaacctagaaatttatttttaacttttattagacccggctagaaatgagagtcacctgtttttttaaccacttgagtaattgtctaattatgtagttatttccttcagagcatttactgccaaacaccatcctcattaatcaatttagacaagcatttactaagaaaatattgtaccttttgctcttgttttgtgggtgcagaactgcatagtatttgaagaccaaatttagccatggtccagtggtagatagtgatattttttgaatgcttgcttcttcttatgcatgtttacaaatgggttgttaaatattgacttgttgagtctaattactaaactataatatcaatatcaatgccattaaagataactcattttaaatttgcaagcatggccatgggccatttggccacacctcattatcttttcgtcatctgtctctggtttcatgtgatggatgaactagatgacctatcatagaagacctatctacgaagtatataaatagggtgaggttatgcgagattgaaaaatattatggcaatctaggtcttcggagaattaaagctaaaaggaagagatggcatttgtgtcctaagatacaatgaatgtttttttaataccttgcctctaaaaactgtgttgcaatgtatgaaataagtaaatagatcgtggatcaatatttatggatgagaatcttacatttaggagaggtaaagggatcttcttaaacaaagggaagacgcggggcggggagcggacatagtaggtgcactagtattattatctagtactctcttaaccaactatgaaagctaaaacagaggttgacactcccatcattcacaaatgaaaggaaattaagtgcatgtttaaaagtaaagatgattgctatctctaatttagtgtacatcatctacttatccaataaaaggtaacatatacaatagactacctctaatacacaagctccaaaatataataaatcttcatttattcatttccatctaatccactactatgttgattttaactcttttggagttatatacaggttggcgctcctttttcctctcctcccttctcttctccaccaggggcggatccatcatgttagctatggtgtcagctgacaccaataccttttggtccatcccatcactacaagataattgagctattccccccaaattattacaacaaaaaataattcgtagcaatatattatactattgcaatgataatttttctgtggcaaataattatatttttttgcaacaatctacaatcgttgttttatttagtatttttgttgcaataaaaaatgagatatcgccacaaaaagtcttactgttgcaaaaaaaaacatgttctatcgccacaattttaatttttgtggcaatttacatagtacatggtacttttcactattttttgttgccacgatcaacaaattcgttgcaataaaaaaattatcgtctcataatttaacttatttttttcatatggacacaaattgagacaaattttatatgggaattatagctgtcgatgagatctacaattttataggtgacaacattttcatttgaaatcttttagatatttaaatctatgattcaaatctcagttaggtaaggttcaaatggaacgatatgtattttccaaaagaattgatgcgtgtgtgagttggtaaaggaaagcacgcgtgaagaatagatcttgggttcgaatcctagccaagacacaatatcaaaaaaataaatagataggatgataaattaatatttgaacctttaatttggtacgtagaactaatgccaaatatggagtggtggcaatagcttttattataacgatgtgaagtgttgcaatatgattttttgttacatccattccgtggcaacatcgaaatttattaccactaaataaaaatcgttgcaataacctattaccacgctatttattacaacggctagcaacaattttaaaattgtggtaacatatatctattgccataattttagtattgataccatgatttttttcgtggtaacaaataatttttctagtagtgcatgtaacctgttctagtctacgatgagtgacaccagtgcaccttaccaattaacgccatactcacacgaaaacagcagtaaccactaattgagcaccatttgttctgcccataaattacccttactaatttagttggccacatgcccacatcggcaggcggccgcagctagcagttctactgtttgcaactgccagccaaggccctgagcttctaattttcttccatgcatcaggttcagtaaaacaaattagtggcggtgctattatttacatgtgtatctaataaatttagttcatagtagtataatttaatttcaccaattggacatgcggtatatatagaaactgttgttgaaaatatttttttaaacatggtatttagatataaat

SEQ ID NO: 63861 - DNA, 10292 bp, Oryza sativa
  unsure (1)..(10292): unsure at all n locations
tgagggagtcatccatagttggacatcacgaccaccatccgttcctatcattgcctgcttatataactataggctttgatgacctcttcgaccttttcaggatccggaagttagacactggtcttctaaaatgctactccttgtaagtgcataccttctatacttgtgatatgattggactatatctcctaattaaattagttctaatacgtaaatgttttaaggttttgttggatcgagagtcgtcgccttggtaatcaggttgggttccttgatccatccatggtgaacgaggttaatttacgacagagcttcactgaggtagttgactatgtcaagcagtgtttatgggcccatcaagacaaggagtacatcatgtgcgcacacaaccaagagtaagaggacaataccctttgtgtatattatttttgaagttaaggttattagtactaacgctacgtagccactacgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggagaccaatgtggtttccacatgtgccacaacatgtcaacacttctaagagaggtgaaagatttcgaccctgaggttgttgctaatggcgaataagctcatttcaataccaacattgctattcaaaacgtgctaacatcttatttattaaacagaaaggtagagctggcttcaagatctcacccatcaacccccccgctatcagaggcgaagtgtgcgccttcattctggcagaaataatgaacaagaaaggacgttttcacgtcaaatagactcatgaacttggctagataatttattgtgatgtaaaaaagatgttttcataatttcttgtgatgtaaacaaatatgtttttatggagtgcaatgtaatttactttcatatgtgcaatatttatggtagtttactaaattgtcatcaaatttgatcaactatgatttacgttgtactattcatatgttttctcctttttttccttattgacatgctgtggaggtcgaggacaatatggctttaatccatttggtaagtatatatgcggttatatgagcaacgactaaaattgtggctttcaaggggtgtgaatttgctgtgcaaaattgtggcatttgaactgcatatgtgaatgatgtcaatttttgatatggatctgtgttgttggggatctgtgatgtttgagatggatctgtgattttatattggggggtgactggaatatatctgtgatttatctgtgtttcagagggcatgactagcaaatcctgaggctagccaatatttagcatttatttttttttttggaattaactcatcagtgacgggtcggaacaaaaatccgtcaaaggtaacatcatctgtgacggactagcaaataaaggcccgtcagaggtgacctacctgtgacgggcctttacttttggggccgtcataggtagatcacctgtgacagcttctaactacggagaccatcacctttgacggcctttatttaaagggccgtcagagatgtgtcacctgtgacgggtcccaactcgccttaggctagcggagaccaacacctctgacggccttctagtaacttgcctgtcagagttgggtgtcacctgtgacggccggccacccgtcaaaggtaactggactcaccagtgaccactgatcactgaccatgcatgaagccgtcaaagatcagggtttgggcccgtcacaggtgacaatggccagtgtagtcgaatctaagtttccataatccataaataataaaaaaaagattacgcatcatagaattatcgatcgaggatatgcttacttagatttcccatccctgcctccgagtgggatatttatcaccgtgcgtggcgtggagactggagactcgatccatccccgttggatcatcactacaggcggcgcgcgccgcctgtacacagctagcttaaattttaagggcacacacaatatgattccccgcaaaaaaaaaaacctgcatatgattaatgaaaatcattgctcattgatagtatttgtagcaaaagttatcagacacctaaactaccncagttgctagtaattatagttacagcacaatcattttttttgacataattacaacaaaagttcctaatgacaattaacccatacgaaagagcactacaacactgaagataatccacattcattcaaagccacaccaccgttggttttcggatgaccaaagggttttgcactagttgacctactttgcatatcaaatacgatgaaaaggtatagctgcactttaaactgttaaaacatctatattttcattgaagggctaggcatttgtcatgctatggttaaatttgcttccaggaaatcttaaaacagaaaaccaaaacaaatgtttcaagcattcaatggaatcaccctctgcctctcgtcctccaccaattaccttttctacaccaaaagctcaactaaatttcagtacaaactatgggtataatataatgcactcggtaccatggggcctacataggaagagcaaacaatcagtattatagccatttcatctctaataggacatgacagtaaaataaacctggaaacaagcacatgacggattttatccttactatattaattttcaaaagatatatttgtggcacgggatataattttttattttgtcatgatacataggaggaaatctggtagggttaaatttcttcgtgattcttttttaagtgtcactaaacatggatattatcttaaaatcaatttaatacattaataatgcattcagtacacgtaacggaagaaaggtctaaaagcctaagcttatttcaactattaaatttgagtcatatcttagtatgattcaataacagagaaacaacgaaactatagtgaaagtatacaaatcatcaaccttcaccaagaccactttaggaaatcagaaatacaatactacggatggacatccattagtgccaaggtgggctcgatttctgtttataagaatcaagcttggccgagattgctgaactgacaattacgacacttacccaatcctcttgaaaataatatcttgtctccttttgatcatagatcaaactgtggagaacaaaaatgttggttccaatcctcttgaaaataatatcttgtctccttgtgatcatagatcaaatcgtggagaacaaaaatgttggtttctgctttcttcagattctgcagttaatgaccataaaaattaatgtgtatgataatgatctggtcagacattgcacaactgacaccaaatattacaaatcaatagcagcgcctccttaccatttcttataaagatagtctagggaatctaataaaaaagaagcctgctgaaagagaaagtcgtaagaaacaagctccaaacatcagaagactgattttccaatagacataattagtgtccccttcggatgtgtttcctgttttttgtacactttaaatgaagatgcaatggacataaaaataaagagcttatcattatcaccttagtagtaacatcaactggaactaaagatcaaaaagttctcttcagctttttaaccggaactaaaaaataatctttagtttcaatttttattcgaaccagaactagtgtagtttttggtgacccaacaaagatcagtctccggcagtggatctgaacggtagaagcataatggatcctcaccaggcaccgactgccgtagtgtcaccggccacagtgctttgatcagctgaagttctaattgacttcttgattgaacgttccatctataatctgttctttttcccctaaactactacgtcaatacgaattacccccataatctgcaaaaccagacattcgacatctttattggtatttcttacgtttacagataaatctacaagtgcactgataccgatatagcacttcactcatgaatattcttaagggtatcatatttatatttcacagggaagacagtgtcgtaaagataattatacatcattaatcaatctgtaattaatccaccataatttaaaaggggtaagataatataattaagatagtagactcacatgagattcacctctgtattaatgtttagtagaaaaaatattagggaattatgatacaactgtatttttatactaataatgtttaatatataactagtacatgcttacgatataggactaagttccaacacccaggttatttgtgcttctatactgaggaatggcctttagacaaaccgatgggctctgcggtggttttcgagtcactagagccgttttcatcctagtcgcgacgtgtgttatgtgtatccagctgtgtactgtgcgcggtggccacggccacacgcctcagcccaactgggtactggtaacggctagtccgccgcgccacgaaacctccaaaccctcgcctcctctcctctctactttcttgcaaccatccatcctcgccgtctccaattccctcgtctcctccgcccgatggcctcccacatccacgccgcggcggcgggggacctccccctcaccgggatgcacgacctccgcctgcgcccgcggcttctccgccgggtgctcgccgagtgcctcccgctcccggatccggccgcggacctccagcccacgcgcagccccgccgacctcgcccgcgcgctctccgccgtccgagagcagggactcctcgccgtcgagggcgcggcggacccggggctgctcgaggagtggagcgccgccgtggacgcctgggtcgaccgcctcgtcgcgctcctcgcgagcgacagggtatgtctccgcgtctctgcctatcccctaggtttccttcctatacctgcgagtgcgatccgatcacgtctcccgtttttgtttcgtcaagtattggtgaatcattatgtctttgttgggggcggaattcaccctattttgagattttcttttatgctggatgaccagtgccaagttccgaatttttcctttggtagtttggtttgatattagtacgacgtgaccaatgttagatgctcatcctctcttgaggacgtctttcatactaggcaactgtgaccattaatcaggcaagttgcaaatcaagaaaggaagcacaattgttgactctgcaacctcaactgcacatagaacgcactgtacttcatcatctcttctgtttatcagcatcactgagttcttggaagttcagtctctggtgcactggggccaaggcccaagagtatatttatatggcatattcgcattcactgtcaatttaatatcttagatcatgtgattatgagacaagccgtccacaactctgcataagaggtttatttgagttaggtcccttttgaaatggagatttgtatatgttttacatgagcagttgaatgatcaaatcccttagggaccaaggacagttctcgcattttaaacaggtctaacaggtgttgatgactgtcacccgattatagaccaagacgctatcacatatatagttgactagctaaagctaatgacagtagccgatgaatatgtacatgactaaaacataatgatatcaacagttcaacactccagcactgcaatttacacaaaatttcaccaattttatagggtatgaagatgaaattgcatttgtctgttgattgtttgaacatttgtcttagtgaaaatttcaaccattttaaccctcaatacttgttatcacctcttagataatatatggattatctatagaaaactgattcatttttctagcaattatttctgctcgaaaatataacttaatactgttattatgtgcttgggagattgagaaattaaggcaggtagaggagaggacctccctggttgccagcactggaaagcctcaacagcacagaggactgagtcacgagcgcatggcaaaatgagggacagagagagatagattgaacttgcttgatttctcaatagatttggccgccattatatgataggttccccctaatagatgaggattcaaatctttgactccgaatcgatgacaactctgactcacactcttcttgatatccttctcatgtgcctaggatcatgactccccaattgggccactagctatactagagctcaacgacatcatctctccctgcagagacatcttgtagtcgagctgaaatgagggattgctgtagatcatcctttttgtctaatacagagaactccagtttgtgatattgaggaccctagtgccttccttgtcatcttgcgtgcatgctggagttgtagcagtgctatttcaatcatgacaccaagatactgttggcatcaccataaaccttcatcttctcgatgtgtttgaaatgtgctttatgcctatccaggtgcatgttgattgtgaagagctgagtgttctccgtatcaagctgcttagtcttttcttcaagcttcatggtgttcttcagcatggtgccctggattccaggtgtgatggatcttgacactgataacattctgttgtgtgctggggcaatgagagcaaatagaagagggatctccctggttgctgacaacatattattaggattcaagttgcttctagcatcccctggatcaggattctatctttgattgtgaagtccgtgacttgacaacaatgatgactggaccatgattcttggagttgacttgactaggacttttgtagatgaaaactactcccactcagactctcttgcgatccttctcgtgtccccagcactgcgacatatgttgccttgccccacgctagactgctctgtcctgtgcccggagcatgattccctatcttagctatgggctgtactgtattccaaccataacaaaccttctgctggtatcttcttttgttttgctatgtgataatatgataactcaacaaattaacagtactataactgcacttttactaatatactaccctattcaaattttggtcaggaacacagttgttgggtgggcacttcttttcttggtttgacatttgaagagtgcagtgaggaccgctttgcaaactcatactctttctggtttgagaagattatgaaaaaaattaaggtaacatacatattttaatgcagttttaaatacatgtattcacattttgtaggtttcatgcattatatttctcataattctgttgtgaactatatgtttttttttttcacttttttgcagttctaatggaaaagaaagtttgacatttaagttactatatgtgtgatcagatgatagtgaattttgctgttataaatatttagatattttaagaatgtgcagaagaaatgaggaatcctcagtacaactcatgcagacaatgttgttctaaatatgatttagcacactagacattctattgaacaatctattttggtcttagtaatcgttgatcaataaaattctgaacagtgaatgcaaatgaagaagttgggttctggttcaactctatccttatttctttttgctcctagatccagaacattttagtttgcacaccttgttagaaggcaggaaaaaacagtccaaacttcaaatgcttttggaatgctcaaaaacaaactataagtgaaggtcaatctgaatttttttaataggagggtctatctgaattaatgtaggcaaaaagaacttttatgtattaggattcttatgttcctgtttagttattttcctgaaatctaggaagtaattgatcagctcttataatgatccacagagttgtttctggtcttcctgtaatataaaattacaatattgttctatttcaagctgtatgtgggactgagattctgtctactttttaaaactacattacctttattttcaattcatattactgatacatgacatgccaaataattataaatcaagtcattacagtctgtgactgagtgactctctacataaggtgcttcagaacataactgcttcaaacagttgtatccatttcaattcccttttattgttactaatcaaattaacatataatttgttccaacacatgccaatctacaaacagaagaatggtatcatctaaattattctgtttatgttccaaatttgattatttatgttgtattagtatataatatggattgtctcatgcatggcatggctattgtttcttggaatataaactgatagattctctataatactttgagcaggtcccatctagcaacaaaatggtaagcatagccacttgtactgctatggctagtctgtttatgaggtatgtgacatgtatggctaactgaatttttttgactatcctattggggagtgcatttatgatcatttaatagtaaagcataaaggaatacaaatgggttgcaatgtttcaacagtgagtcaacatctatcacgtgtggttttcatgaacacatcagctatatagagctgcaaaaattgtacaagtaaaataaaaagaatgcataggacatggtaataaaatgcaaattccttcaaagagaaaatatatacgaagatgaggttaaaccttgaaattaagcacttttagtggcattctaacgtcatttcattatggatgtaaaatattacaactccttactatctttgtttgtaaaatttgtagtcttttgaactacaagtttaaatgtgcagtttggtagtttgttataacctatacaggttgtaacttatacttgcccaaagtattattatatatagcatataaaggcccatattcagcaggtgtaccagtggcaaatctagtacaaaagttaccgagggtcctatacgtactaatgatctaaccattgactaatatgataattagcatggcataagtcaactagaggagaacaatctaccgatggtcctgtgttgtgcacatgggaagatatacataggtatgcccctgaggcgtactgcttgtgtctgagaatgcatgattaaggtccgtactagatgatcaaaacttggagttctatgttatttctgtgttcatgacagtaaagttccttagttgtttcacttaagtcaaactgactaattaagtcaaaagaaaaatagtgcgattgatcatgcagtcaccaaactgggttgccactgaattttattgagttcaacaatctcaataaaattctttaacaaggggagaattctagtggagggcatcaatggaaaaagcaatgtgcaccactcctaaaaagctagcattattgctcatttgttgcaatttcatagtataagaatgcttagcataaaagcaaggcaacccatattttttttaacagattggcgaagttttcaaatttaaaggacgaggcaacattgttagcccaaaaagttgtccaaccattgctgcggctgttggacaaggatggttctgttgcggtataagcttctttacacttcaagcaagatgatttcctaaatacaaacttctccactaagaaaatatattgttgtttatgtgtgcaggagaaagcaactgacttacttggtttaattatgaaactcttcccatcatcagtatatcggcgtcttcaacaaagtatgagatactttatttgtaatctcctttgttgtttgtgaatttctttgtttgtaccagccacatcataaaagtatagtgaatttctttctggttattgttttacattttgattgtccagtgccattaaaatggagtgattagacaaaattagatgtatgctaacttgtacgggtgtctgtggcttttgatcgttcatattactcctttgcctgattttcatcatgaatattcataaccttcttgttcctttagacaggttgattgagcatttcctatataatactccctctgtttctaaatgtttgatgccgttgacttttttaaatatgtttgaccgttcgtcttattcaaaaaatttaagtaattattaattcttttcctatcatttgattcattgttaaatttacttatatgtatacatatagttttacatatttcacaaaagtttttgaataagacgaacggtcaaacatgtgctaaaaagtcaacggtgccaaatatttagaaaaggagggagtatacagaaagtcacactgattgaaagtttgacaccaagaaattgctgttatttcttga

SEQ ID NO: 63862 - DNA, 3233 bp, Oryza sativa
gacgccggcctccaagacgccgcctccccgacctcttctccacgaccgctgaccaggtacgacgccccctcctcctgaacatgagatgatgaatggatgaattgcagtttggatggatgacttgcttaaattgaatggatgaattgcatgattgatgaaatatatgcatatttgagatgtgaaatatatgaggtgatgaatttgcactgtttgtggatgaaatatatgcagttttagagctattaatctttttgtattagatgattttaggattaattttgctgcgttggctgaatgtagcatgattttgaattttttctgcactagtatagattaattttggccagtgatgttatgtggccctgctactgctcttattgtgcctacttgttcatttttttatctacaattgtttatatacatgatttatataccactgctattgttgccccctgtacttcttgttaaatggccaaggatgaattgctcaataacattctatctatacttgttcttttctttatggataagaatagattatctacacttgttgatttatatacccttgttgtctatgtgaatatccctctgttgttgctgtttatgtgaatttccccctgctgttgctgtttatgtgaatttccccctgctgttgctgcccctgtggcatatatacccctactgctgttatatggccctgctactgctcttattgctgctattatatggccctgttgttgctattgctcttattttctgcacttgctcttttctttatggataagaacagatgaactacacttgttctattttatggattgataagaggagactatctacacttgttcttttttctagattgataagaggagactatgtacacttggttcttttttacactttactttgggttgctttttctcctagcacctgatttcctctttttttttgccttcatgcaaatgatggtaattcatgcataatttctgagcaaaactgaggccatatctttcatagtataccccgtattatattggatctaatgctatttagtataatggttggaaatttataagatttttcgcgaaaattagaccatgacaacgcccagcgcaaacccgccctccccaacacctgcgaggatccaggaagaagcaaacccagccacggagacagttgccgaaggttatccctcgacaacgacggtcgaacaacccgaaattcatagtaatttataggataaattttcaccacatgaccacataaattttagctagcaccccttagcatatgttgccttctgtttgtgctgcagaattgccgcaggaacaacatacgtcgatgtcaggcgggacaactgcaagtaggtcgagtagaaatccgcggtcacaaaatatatggccgaccacagtgcaagttataagagaggttgacgctagtggtaggcccacggcgcccaggactgtcattggaagatggtctaactactgcgggctggcggcacgtgagaacttcgggatcctccataaagatatcggcaaggtcacagaagccgagaaagagtgagcttggacggcaatggagaaatggttcacatttccagctgaagcaaaggataggctcaagcggaaggcattccagaagatgggcaaagcttggaagaattggaagtcgaagctcttcaccgagtttgtcaacccgcccggcaatcatacgccgttcgatgaataccctcaaataactgaagcggtgtgggaggaattctgctctctcaagaacccaagagtttagggaatcaagcgaggcacatcgcctactgcaatagcggaatgagcacccatatcggctgggcactgcagggtacatcggcaaggaggcaatatgggcccaagaagatgcagccactgcagcagcaaatgtccctgccccgttttcagacatccctgaacaaagagctcgcaactgggtgtgggcaaggggtaaagtcaacccggacggctctgtcacatttgagaacaaaagtgatgttgtcgtctatcaggaactggtgagttcactacttaacctaactaatttccgttcgtataaagtagaagttcgtataaacgactcttttttttctagttgggcttggttgctgaacaagcttcacaaagcgaggttgagtccgcgctgaggaggcgcgaagatgacatcctcacaaaggcgctcggaaccaaataacatcctgggcggactaggggaattggtagcgatgtgccctggaagcatggactcccgcagtacagctcccaatacaggaaacggaaagtctccaaggaagagagggacgctcgtttgaaggccgaacttaaggttgtggtcattcaagaactagaagctagcatgaacgctagggtggaagaaagggttaacaaggtcctcgccgacatgaatataccccgaggcacaacacctgctgtgcatccaactcctcgtgcacaacacgacacgagtccatcacagcataggagtagttgtgcatccacagaggtgccggcccctggtctcctggtcgcaccactagctgcagtggaccacatagaggtaattgatgttatacaatccatatctattaaaaaaaacctttacacgttccaatattaaattcagactttcacatatgcagggtgtagtacagtgtgtcctactggcgagggtccacctaactttcgctcccaaagtcactgagggcatggcgttcaagccctcggttacagacaaggtccacggcgcagacctgctagctgggtatgccaaggtgtccatcgatacagtaaaggacacctggtcaggctatccgctgcacgtgccccccaatgatgaaatcatgactttgggcgatgcgcgcaagacgttcatacaatggcccaaagaagacatagttgtgaagatgactcctcgtccaagtcgaccgatggagctcacacctcccaagtctaagctatcaattgaggctcctcgtggaccagcattgtcggtacctcattctcctggtggagctgatatggacttggcagatatagctcaaagcttggctccaataaagaccacaagaaaggccaatagctccccaccacttgtcaagggccagaagcgtgaatgcggcaaggggaaggtcggggagttggcgccggagccaaaaaggggcaaggctgcgacgtcgatgccgatgagcaaagcggggaaggtcg

SEQ ID NO: 63863 - DNA, 1993 bp, Oryza sativa
gtaccccattgagccaatgccccttgcaacatccaccagcaatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattatttcgcaaatccaaaaatatcaaatgaatcaatgcaagttaatgctttcctgacaaaaatgctcgggttaatgtgtagctggcaagcatatctgtcaacctttaatcgtgcctgtcaatagccaatagatattactcgctagatgataatgagttcccaccaaatatacattcatgcccagttattcatatatgtttgagttaatcctctttgatatgtgcaattggaattcaatttacaactacagaaacgatttttgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccatattttctcactatactgcagtaaattggtctgcctcaaccatataagaagtatactagtataactctattttacagcgaagatagcatgaaaacctcgactagttcgtaaattttattctcaaatctgttagtggatttcaggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgacaaacttcataagcaataaaaaaatgaaaaccataaacccaatgtttttgccctatatacatcgattc

SEQ ID NO: 63864 - DNA, 611 bp, Oryza sativa
attaaactcattattgcaaccagttttgctctaaactcaactacaataaatccaatgatatctaaaatagatgcagcacggcggagtaatatgttgtatatagattggagagcaaagaagacgaaatttagcatatgttagtatgtacaataaaaataaccagaagaaagaaaataacagaaaaaaaaataatccactcactttccacatccaattcaacagccttgtaacttgctgccagctctgccagcaatcgcttcactcgggcgcagaaagggcaataagtcttgctatggccagtccaggaagaggaatgacacgaagaaagatcaaaattggagtttaggacagcataggtcacaattttgcagaagtagggagataatcatgttaaactctgttttatatgattgcttgattgggtttaatttgcatgatgtaatatggtgtatacagacaaaagtaacaattatttctcatttctttcagaagctacttaaaaagtgagcgcatattaaatcaactcgttccacattatacctgtgcatttcttacaaacaaaatatttcgatttcattatcagcagacaacgacgtgatacaatggtaaca

SEQ ID NO: 63865 - DNA, 4957 bp, Oryza sativa
gggggagattttgaactccagatcgttggggatttttatacaggggttagatccacccctttgtactcttggtatgcatttttttaataattttaaaccttttctttaattatgatagatctatgcataaaaatgcagaatcagcacccgttcatcctcaatcagaactctaatgaaccttaccaatgttatgcagcgcattctgggtggcacagactcctaatagctcttgcagcttcaagcagccgaaccagctatcccttttttcttacaaggatatgcacatcgagctcttgtataatacattaaatatttaaaaaatataaactttacatatagcttaaaacaagtgatctaacaaatgcagtggagaatatatatttcaatccgtggagtaaataatccatttcaacaatcccaccatgaataatatgaaaactaacagggtcttatatcttcttccttgaattccaaataacatagtactgctctttatagagagccaactaaacaactcgattctaatttcatggaatggaaacaaccaaaacaactggtagatagatagatagataagccgataatttcacccactctgttgcatcgcctattgttcgtgcgctcccttgttgggcttacgatgatagattgcaggtgatactgaacgaccataattacatgacgagtaagacacctgcaacaacaagttagtttttattaaatctaccattgaatatatttttattgtattttactttgctttgaaaatgttgttatttgatcaaacttgaataagtttgatttaggaaaaacccttcatcgatttgtagtgtgaaaaggagtacaaggtaaaaaaaaaagtctcaattgaatgattatttgtgttgtacagataaaaaaaccaggcaaatatctaaccatgcaaatatgcagaaatttggctagttggaaattaacttggagtgacccacgcatataagcattatttagagatgcacttgatactgcagtggtaagatgtgtgtggtttcaaccctgagatcacgtgttcaatccccaacatgctcgtaatttctcaatataacaattctcttacgtaacatagttgacacttgactgcaatggcataaaagaaatcatctcaatataacaattctcttacgtaacgatatagggggaggggaaaaaaggaatgtataactaggagtaagaagttgattgcacgctgatatgctaaagttcataaagagttttttgggttttttttaagataatgaataacctggcagctgcatcaaagacgtacataggctatcatgcattactgtacgccaagcaaagatagaaaaaaataacgttcataaagatacatcatattaaacgttgagtgggaggcttggtggacctagcattatataatggctagtgcatgaaaaaaaaggttgttgattaggggaagaaatcagctaagtacctgagttagttcatcacaatagtaattcgagcgctgcttgatttggatagtccttaagtgcctcttcaataacagccgtgttctcacccatgtaatcaatggttacatgccgaagggagtggaggttctccaaacctaaatcatttaagtcacccctccttagtctggtcccaatacgaagacaaagcctttcaaggtggggcatagctcctggttgaaacgacggcatcatgcagctataaaagtgaaaatcttttaaactccgaaatgcacatgcacctctgtggatagtgagcttttcctgcagttgttccgaaacaaatgctaactgtagcctgagaaagcgaagagatggaagctcagcgaggcgatcaaggtggtcagactggagatattcgaaacacagacaaatggataaggtggtgaggcgggagagcatcgacgaattgatccaacatgggaatgctttcatatacgaatggtgcatgaacaacctttggagaccgaaaggaacctgttgcatgtctatgatttcttcaaaactattattatttctcaaatctaggtcttgcaaattggtgaacctttgtatagacgtttgaatggattcctttaactcaaatgttttttcactactgaaaacgatcctaagagtccttagctccggcaaattagcaagctgttttattacctttcgggtagcttctattacaagctcctgtaaagatttcatatcccccagcatcagaccttgcgccagcttcacttcgccagcaaatagccgcaatagtttccttagtttgacaaaagacattggaaacactaccttatgagatttaaaagtaatatggtgttcttgatctagcacctcttatgtccagggtttcgagagattctagttttccaatgctttcagggagctcggtggcactatagcaccctagacgcataaatcttaggaggcgtagcttgccaagatcactaaaatggttcttgcccataccactgcagtcctcaatctgcaacacacgcaggacatgaaagctcgacaagggtggtatcgagtcgaccttgccgaagatagtgagtgaccttactttggacaattgttctcttgcttctggtgaggcataagatttgttgctgttatggagagagagtcggtgaatcttcttcttcttctgtgttgtacatgtacatttacctgcttgttgaccatctgataaatacgttgtaacaaaatcttcttccgctgacagctgatttattagctcaagcaccatgtcatgtactctgcactcatgtaccttaccatcttcgtattgaaagtaagtatccatcggctggatcaagcttcgattgatgagctcgctgaagtagctctctccaatctcctgcaagcttgtccctgcaagtcgtgtttcatctgtaataaaaccctctgctaaccaaccccatatcaaaacatcttttctaattagctcatcctcaggatatttgcttagagacaacaagcaagtcttcaaatgaaaaggtagatcgttgtaactgaggcttaatatcttccgcatgttgtccacatcaaggttgttctcaagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccaccgcctgcatgttctgcaacgaccttgtttcgcgtggttacaattattttgctaccaagtttagcatcttgcacagcaagtttgatagtatcccacgctgattttttccatacatcatcaatcacgcacaagaacctaaagatggtagcatatacacatgttattgaacctagatataaatcatgtgaagcctgtccaaaaaagataggaatatgtatcttgcacattgaatgtcgaaaatgatgtgcagctttaaatgtgtaattttccaacaattttgacacaataagtgcagctttgtgaatttctattcacaaagttacaaagatacttaattatgcgtaaatagggcagatttctgaataactatgtgttccattggaaaaccaaaactttatttacaagccagttatattataatagtataaaaacttgagctaggattcccggttatattagaatacaataaaaacttgagccaggactcttatttgtacaacaaaaggtatcttcaaataatgataaaaggtaggtataacatagaaatgtaccttctattgttgaggaagtctctaattttgtcgatgagctgcttcgtttcccatgtttcatctatgtgggaatacattttctcatcaagttggagaagaatgttcttgagaatcttgtttatatcaggattcaaggacaccgaaacaaaacaatagctgtcaaattttgccttaagctcctgaaataatgaattggcaagagttgtctttcctaagcctccgaatccaacaatagaaattatatttgattgttggctggatgagccgtcatattccaagagttgcttagttagctcattttttggcttgctaatgccaatgagttttgttgcctttcggtacatagcttctaggcgagaatcaacatccacaacagttggcctggcagcgatgtcatcgactatgcacctgtcacgacgctcgctgaccttcttgacctggtccatgatgtctttgatgacaccgtggatctgatggttagttttgaacttgttgaacaaattggtgaccttcttgaagctcgtggcaggttcatgccccttgcactttaacatgaaggtgtcgatggcatgctcgatgtcgtaagatagctctcttaccttgctggcccagatcttgacctgctggtcaagttgatccacaagagtctcagccaccttgtggagtgctgcgttcatacctttcaactctttctcaagttcttcgatctctcccttgacacccttttgcagcttgtattcgccaaccagcagctccccaagcttggggaggagggtgttcattgcccctgtggcgatgttcatcttggcctatctgatgttgaatgcctgcacgggtacacacagatgcacttaaatgagcctcttgagtttatcagtatgtatcaggattcaggaatgatcaagcaaccgcacaaacatggagaaaaacgacatctgaataattaagctgctatgtagcatgtctaatcgagactagattgaggtaagaaccgtgtgcttgctgcatcacctaatcgatccaagcaaagctcatcaccgtgagcagcgcaagatagcgacctctcaacgctatacggtatactagtaacaggaaggaccaa

SEQ ID NO: 63866 - DNA, 1654 bp, Oryza sativa
ttagaaggcgtagctaaccgagatgattaagatggttcttgtcaattccactgcagtcctcaagttgcacacacgcagtacatgaaagctcgacaagggtggtatcgagtcgaccttgccgaagatagtaatggaccttactttggacaattgttctcttgcttctggtgaggcatagacttattgctgttatggagagataatcggcgaatcttcttcttttgtgctgtacatgtatgtttacctgtttgttgaccatctgataaatacgttgtaacaaaatcttcttctactgacagctgatttattagctcaagcaccatgtcatgtactttgcattgatgcaccttaccatcatccaacagataatagacactcatcggctggatcaagcttcgattgatgagctcgctgaagtagctctctccaatctcctgcaagcttgtccctgcaggtcgtgtttcatctgtaataaaaccctctgcaaaccaatcccatatcaaaacatcttttctaattagctcatcctcaggatatttgcttagagacaacaagcaagtcttcaaatgaaaaggtagatcgttgtaactgaggcttaatatcttccgcatgttgtccacatcaaggttgttctccagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccaccacctgcatgttcagcaacgaccatgtttcgtgtggttacaattatcttgctaccaagtttagcatcttgcacagcaagtttgatatcatcccacgctgatttttcccaaacatcatcaatcacgcacaagaacctaatgatggtagcatataaacatgttattgaacctagatataaatcatgtgaagcctatccaaaaaagacaggaatatgtatcttgcacattgaatatcgaaaatggtgttatcaaattattagcaaagtgattgcaagcaagattttctagaagttacaaagaaaagattacgctgtgatttaaaatatgaatgagaaaactaaatagtatgtttgtcaatcgacaatgcatggctatcaaacttctctaattcgaaccatagaattattatcttttgtctcataagagagaatctttgtttttaacttctaaactctcctataaaatagcttgacaagatctccatgtttcaatcttctgtctaaatatcgtgatttgttccagttactacatgttattaagtgattatgtcgtattttatatagggttgacaaatgaatctgaatgtgggaaatgctagaatgacttacattgtgaaacggaggaagtacaaatttacatgggcaatttttcagcaattttgacacaataactgcagctttgttaaattctattcacagtcacaaaaaaaacttaattatgcgtaaacagagcaaatttctgaataattgggtgttccattggacaaccaaaaccttatttacaa

SEQ ID NO: 63867 - DNA, 1602 bp, Oryza sativa
gttttctctaacttcgatgtagcagttatgttgcattcatttttgagctttgcatctagtacatttgcatatatccaaagctttttctgccctaatcaatataaaggtcgcggtataagatttttttcaagagtgatgaagtttttcatgaatttgcagtaactccgtacatctattcatgcttatttggagtctttggactaagctatgtttttatcgttgcacaatatgtcattcacttctcatagaaaatatagatttttattgaaatcttaggttagaaatgttttttttcatggatagattttatagtattagatagaggttttaaaagctgtgcttctgataccagatcagtcagatgacattataaaacattaatattgcttccaaccataaacatgtaaaattgtaaatctaatttccaagttttccttgttctttctggagaataactgtttatttacgaattttttagtacttatcatgcttcgaaactaccatttcatcatcattgactatatctcattcttttcttctgtcttaaggatctaactgtggtgtaaaacttatcactttgctgcgtaagttagtatatattatagagatatctaaaataaaatgtaaggaatattgtcttacagcatggtttgttattagtattcataacattctgttcacatgaatgcagttaattctcctggaaaacatcgagaatttggaggattggatactggtgatgatcaagcggcgctgctaaatccaggatttaaagcattgacccaaattgtccaggatgatgtgttcagagaatttgagtttagacaatacatatttgcttgccaggctaaggtataagacatgtcgtaaaaaaatgagtaactgaatgctattttttcctatgattttttttgtcaagtcagtaatattttttttcattcttacttcattgcaatctgttcttcattgctgtactgcttggttctttttttattaccagttacatgcccgtacgttgcaacgggatcattagattttttttaagggtggtttttttataaagagagggagcatttttttagaggaggaaggacaacgactgctcttttaaagtagttaagatgagttggcaatgtcacagttagagaataccattgtatgtgtcattgacatgtgtgtccaggccccacatgtcattctcacatacaattgcaatttgcaactcacatatgcctagagtgctactgtttaatggcgtagcggtgctctttattgctcaatacaaacatgcacactgttttactcaagtggaacatgttacataaaactagacatccagtgccagaactttgttctgttttagagctagttcaactgaaccttatatattgcctttatactttttccatttcaccattttgcagttattgtttaaattgcatcgcccaattgaggttgctgcaagaggatatgcttttgtggttagcttttccaagacgctagccttgcaggaggtatgtacattctctgttttattcctctacaagcaaagtttatgttctagaaagactatattgtgtgaagtgtactcaagtaattctg

SEQ ID NO: 63868 - DNA, 3849 bp, Oryza sativa
cgcagatatgttttgttttttttttggtgcttcacgactggaagaatggccgatgatattgggttggtcatcctgtagagagaagcatagattgaatttggaccagaattaaacagcatggcgcttactaacccgcgtcaatgttacctgtctcctggcacattttgatttataaaatcgatttgaatttttggtcgattttgtggtactggggttgattttgtttgatgttcagtttctataatgaaaaacatctggacggacgcgtagtctaatgtgatggagaatattgcaagcccgaatcttaaatcgataatcccttatctaatgtaagggacgatctattgaaactgctaaggtactctatatatacttgaacatacgtgacaacaaacagtagtaattgtaattgacataccaacagaaataattcccagtgaaaaaaaaagttaacagaagaacggtaatctccatttgacctacatagtactccagctcgcaatgacagatctgcacgtacaggaatgaattatcgagaacgaagtaactcttgtgccggaattctggtagacttcaaaatccagtctatcacttgatttgatatacacggagaattatgttacttatcttatggtacatgaaacaatggaacacgttctgaatgttactgacgaaaaagaactcatctgcacaaaagaatgtctcggcaaaaacagcatacatctcatccggtgcaaatggcgatacatctcaagccgaccagtgtaagtggcatttctcttctactacaggctacaagcctaacatacaatctgtgtatgatggatggatcaagccggtatgcagtatgaggtgctcagtgtcggaggaaggacgcacaccaggtgagggcctgccgggttgcagcatgttggcctcgccgacgtgcggcaggcccagctgcggcggatggacgtagccggacaccagcggcacgcacgtcaccgtgatctctatccttgaacctgtttgttgtggaacatgcgcgcaatgttattcacaagggcttgtaggcgaactgaaaatttggcattgcaagatggaaatcgatatatcgagtttcggtgtctgaactcgaaattattagttaccttgtttgtttgacagcgatacgtgaccgcatttcctcccaccaaccatccaggtctgtggggtggcgtcgacttgataaagtattttgtcctgccaaaaccaaattctagttcagttggaaggagaaaacaatttcatctctcttgtcctatggggcctgtctactgaagcaatgtactcacaagatcataaccattaaagtactggtacacttaatgaatgtgattttaagcaaggctcatatggagacttacggctaacagagaggcatgctccgggttcttcagcctttcaaccctccatctcatgttgaccagctggccaaccctcaagcagtccgaagaaaacggaaggaacccaactgccacacatgggtccaggacagggcgcttcatcttcaccgcaatcttgaatacaagctcctcagaatcatcaggtttaacacgaactggagagtgtgctccagttgttctgtcaccggatattccatacttaatattcaacatgctatctgcctttttagctcatccatatctggaatgtgggatgcaaaagttatattcagtcaatcatccatgtgtaagagcaaggatatataacagcaaaaaagtgtgaccctctcataagaaaatgataattttcttttttggataggaacacaaatataattgccatgttttttacatctgattttctctttgcaagatagaagggagatatggaagatgtaatcaagaaacatgggcagtgtcctgtttgtgaacttgaagtctcacaaatctaaacacatgaaagaattaggtgcaccagcagcatgctagcaagagccagcgattatagtatggtaatatgcaattagaaatacgctaataccacttgtctgtccctaaaagattttttggatgctctgatattttggttataggaagtgcaacagatgaattgcaagtggcaactgaagatgataagtgtgatatttaaaaggtctcacctcctaaggcacttaaacgtattacaaataagattccagctctcgaagaaggagcaataaccagagggaacaagttcgaagttggtcgtccatctccctttcctgtgtgttcaaatccagattgcagatccaaccatatatcctttacatgcagagtggccttcacttcagaatgcaatatcacctggacaccaagaaaaatacaaattgggattcaagaatccaagaagactgaatgactatcaatacatgaagtgtctcagtgaacaattgtgcagagagttgtacctgcagtagtagagttccatcatagcacttatctactacgcgtgtgctcacatggaatgggttagtgaaatgtactgcgatagtcctggaaataaaatcacaatggtaaatttattttatttggacccctcaaaaaatttattttatttggtgtacctaaaaaatcaaaatatgggaacagaaaaaagtttacctttcaaacacttgattaagaaaaactccaaattcaagcttgagagcaatcattctcatcccatctactatgctctgtttctgaggggatgctgcacaaaaaaaggacaatacaaaggtcaaccaattgattgaaacatacagaaaataaaatattcaatcaactgcctggaacattctaatatgctgaatacattacttatttattttgtacaaacctggcgatgcaccccttgcaattgtatcatcaatagcacgaacaggaaaccatacaagagtagtcacatcactagcccagtctggtatttttatcttcccatcttcaatagggaccttctcaaccttacgagtatcagtggagcttgatgatgtcttggaagcatcagtaccaccaacatgctccacatcacttccataagtttctatctcaatcatctgggactcctcaattttcagtccagcacccgcatctatatgcaatatgccatctttcaaagaatagtctattggcttgacaattaacccaatccactgaagttcattcataagcaatgcagaggacacagcaggagtaatatcaactaaagcccttggttttctcacctgcagtaattacagaaaacacttgaggcaaagcccaatataatatggttcgttaattacaaaaatgtttattctgttagttgatatccatcttttagttgtgtcttgtgagttaatagtgactaaatttttgtgacactccagttaatgttaatgtcatcaccttcaaaacaggccttgttggcttctcaaagctcatgaattcatcagtgtccactggaccatcttgagaaaatccatgcgatctgaatgatagcttgccaatctggcccgtcagagcacccaacacataggatccaggcttttgaggaggaatgtcgaaggtgatgatatttctaccgggtacaagaactcgagcatctgaactctttatcgtctgcatgacatggaaacattaggtgattgaaaagaacaaatgcactatctggacctttttacgcgttatagcattagcactggaagttataaaacggtgaaacagaagtctaattgcaaccatactggtataaggctataactaacatcccacaaggaaataaacaataagcaaacagtaatgtaatagcaactcagctgtaccttaagaccttcatctgcactagaggaagccgacaatcttaagctgagagactcgagtgtgatgt

SEQ ID NO: 63869 - DNA, 1040 bp, Oryza sativa
catgatcacatcttgaaacatcaacgctctgcaatgaaggaaaatccttggaagttagaatggatcaatgttaacaaacattcagtttccagctaaataaccaaagtccaatttgtagaagagtaatgaacatatcataacagatataagaatgtcatagtttccactttctaggaaactacaaacttgaagcatccttacatcataactgacatgaaaaatgtgcaataaaatcctatagaagtaagtgtcaccattgtcacacagtgattacctgcagtgagttgctccccttgcctagtaattccaggccatcatcatctatgcatgagcaacaaaccattgccaactcctcaagtttctcaagtgaggatattgatctaagggattcatttccaacctggtccagcaaaaaaaaaaatctgttttagttttatagaacccaagtacgtcaagaacataacgaaatggaaattgtacatcaatgaatagctattcaagatggagcatactgcagcaaggacataaagaagcaaacatccataatatcgacgtaaagcacaaccattgtactgtaaatgttcctgcttccagtggtacattcttcaaccatgtcaagaacagctgatcagctctatctgacctagtcaccccatttggttactacatatcaaggttggttgaacccaagctcaccctttctagccaactgaattaacggaaaaggactcatcttcttgccattttattcagaagttatgtcttgacgaaatgtgatcaagcccaatattaagtactctgaaactcatgctccagttacttccctattagcaaaactgttctaaacacaccatgaatccaccatacaggaatccacaacagtaatctgctgcaactaaatgaatcaggctcaaaagaagcaagtgtagatgtcccatggtaaatttctcgtctgattccaaaaggacaagtaactagtagcaaattgcaagacttcaaccttctccaggtacaaactttttcatatctggacaaaccac

SEQ ID NO: 63870 - DNA, 5147 bp, Oryza sativa
tcaattttaaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatctcctcggcatctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatgtaagtaactttgacaaatgcaagaaaacttacgactttgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctgttctccattcatcaatgtatctattatgctctagcccccagtctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacactaacactgctgacccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcttgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgtttaaaagcctcaatggaaggaccaaagcaccagaatgcacgcataaaaatttttttggtcactccatcaacgttgacaaccctatcaggatgagtatcgatatggtagaccatactgggattcctttgcttaatggcttgcagcaaagtgggcaaacggacatacgcttcaccccattcaccgtaaatgagcttcatagcctcctctcgtgcccttccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccaactggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacataaaagtaatcatctggattcacatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacgacgagaataatatgtcacaaaattcttctcaacgtaatgataagaatgagatttgtttagatccaaattttctacggtacgaactaactttgatgcaaacacctctagagatctaaactgagactcttttaccaaatcaaagtaaacttcccattccaact

SEQ ID NO: 63871 - DNA, 2084 bp, Oryza sativa
aggcagagcctccctcctccctttgccgcgacgcctcagctcccctcctcctttttcccaaatcggcaagggggcaagcccctttctccccctcctttttccccttttcctcccgccggcgtcatcctccctccctcctgtcgccgttttggccgctagccggagcgccagctcgcgccttgaccgccaaagtcggtttccaaaccgacattgccgccccctataaacccaggcgccctcccttccccttttcccctcccaatcttccctgtttctcgcccgcgccattgccgtccttctcgccgaccgcagccgtcgcgtgtgtgccggaggagccggtgcgcactaggacgcggaagggaacttcggccgcgccctctccttcctcttctccggcccgaggccggagagattactcccgcgccatcggcctctcgtcacagcgccccgacccgcacggtagtgcccctctccgttcttcctcctcgctccatctccccccttagtcttcggtggtagcacgagtagactccccgtagctagccggcgccgccccaaccattgccgtcgctcgccgtgtgctcgccaccgtcgccgctcgagctccgtagcacccgcacgtcgccagcctcgatcggcgtagctccgcccaatccgacgctagcatcggattcccgtggccgcgtggatgctctcaccgccgggaatcggcccctcgtggcctcgtcgccgtttccctcttccctccccgccggttgtcgccgccgcgattcgccgccgtcaagcttcctccggcgaatccgagccgttggctcgtctcccctcgtctcgtgcaaccacccggcgtgctcgctttcgccggtatcgccgtggttcgctccgccgctcgccgctgttgtccgccgtccgttccggccggcgtcgtcgtctacctcccgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccgccgcatccgttcctccgcagaccgcgcgcgtgcaccacgtccctcccccgcccgcgcgcgtgcgccgcgtgctccctccgcacggtgagccgagccgctgacaagcgggtcccacccgggaccgcgcacggtgagcccggtccaccggccctctctctcctcccctcccgcacgcgcgcacttgggccgccttgggccggccggcccatttagctcggccggtccgctccttttcccttgggccgcgccctagccgcccgaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgcagtttgttgagttgtcccgtttcgcgtgtagtttcggagcccgtgtcacgcccagaaattctcgaaccagaatttctaagctgaatgtgcattaaatccctgtccaggaccagccagggtacacaaacgataattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccatcgctacaccacgttgc

SEQ ID NO: 63872 - DNA, 561 bp, Oryza sativa
caccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggttggattggcggcggcggcggcaactcaactatgggcggcggcatgagggtggtggtcacgggcacgacggggtacctcggcggccgcctgtgcgcggcgctggcgaccgccggccacgccgtgcgcgcgttcgcccgccgctccagcgacgcctccgggctcccggcatccgtcgagctggcctacggggacgtcaccgacgaggggtccctcgccaccgccttcgacgggtgcgacgcggtcttccacgtcgccgccgccgtcgagccgtggctccccgacccctcggttttcaccaccgtacgcgtgctgattcatttctgatgttttcctgtggcaagtaga

SEQ ID NO: 63873 - DNA, 70247 bp, Oryza sativa
ttctccatgcctgcgccgcctggagcagcatctcagagacgtccagcgtcggctcgcccaccgatcgccgccctgatacaatcaccacactgaacacacaaagaggaccaaattaacagtcacgcatcccaggcattcgacgaaacccaagcagaggacgtgacgaacagaaacagagggcgttctcctaccatcctccgccgcgccaccgccgacggccaccgcgttcctccccgtccccgtccccgccgcgtccgctgtcctcgtcggcgccaccaccgcgcccgcgcgctccgcacctcgtccgcctccaccatgagccgtccacgtcccttcctccccgcctcgcccccgcattctatcacccccctcgcctctcccacccgcagcagccacgggacgacggggacagcgagacggaagcgcggccgcgcccgcgcgagcgtcgccgcccccgccccactccgcccacccgcttctcggcggctcgctccgccgcgcggcggcggcgatcaacgcctcccagcgatccatcccccgccgccacccgccctgcaaatcaccccaccaccaccaccaccaccaccacgcccaaaaaacccgcaccaaattagctgttacacacatcatccaacacgccatcacatcacaacacgacgaaccgaagcagcgaacacgaagaacaacacagaggcgaggcgtacggactcacctcctcgtcgtccagacaccggcggcgagagagcgcgcggcgaggccgaggcggcgagccggcgagcacggcgacgcagttggggtttttgcgcgagcagcgagagagagagagagagagagagacagagttggtggggccgagaagagaaggatgggtgatgattggtgaggcgaggacacgtggcgggcggacgccgcacctgaggctgaaggattgactcgggtccgactgtccgagaccaaactggtccggctcggtcgcggtgcacgtggctgacccaacgacgggtgggttgtgtgtttgcttgcaacccgcctggcgcctcctgcaggtggttcgctagcttctcgttttatactggtgaggtttgtactgtaggagtatttactgcggcgtaaatttttactggactggttagtgggacgttattgctgtaatgatattgttctacgatggttgatgctgaaacgactgctgctactcctgccgtttcattttgggcctattcattttaatgtcattttttattttatcaaattttagtaaagttgctaaaaaaagtggctatatttagtttgctgctaaattttagtaactatataagaaatcctaccaaaattttagcaaaatttgataaggttttttttttcatcagagtgaacaggcacttcatgatatcattagtcgtttagtggaagaaagcgaggagggagacgtgccactggagcccactatttttttttagattgagttagaatatctggggtgtataatatctattttatatagtttatgagtgtatttaatttctaacggtggcaaaagtttagaggggttaattcaaactttttcctagttcttactggggtaaaaacgagatgggcattttccaaccgcccatgtgactcgaggctcgtaggaagaatacaggacataaaatggatattcaatattatccgaattagaatccgaatccgtgaaaagatatgcttgtatttcccatgttattaaacacatatggaaatatattataagtccacctacaaggctacaaacatgataaaatattgattaatcactattttacaagatcataggtaatattgtatatttttttcttaatttatctcttttaatactttaattgtccatctatatttaatatgcatgaattgcacatagaaatagatttccgtgtatgaatctgattccgaggaaataatatgagataggatacgggatgagtgatatgttatctaatctaacactatatctgtacatggttttaaattaaaggaaaaatataggttaggataaaaaatgccgtgatccaaccctacatgaccccattttaccctagttcttaccatggaataattcagtcacgacgggtttacttgactccaattttccacacgctggatcaagccgtccacagttcagaactgagaacacaaaccacatggggtcatctagcacggaacgaggcaggcaatctacctgtactccttgaaggtacacatgccagaaacggtaagggtactcactgaagtttcccgggaaacaggaagaaagagggcaaagcttatcttttgcaacggaatcatatgtccactactaccaagaagggtttcctaggcggctagaatttcttttcacgcacaactacgaaaaacatattttgtagcaaccaaaataggttattgttggcagtcataagctccgccacataccaagggtccatacgggtggtagagcatccgtgcgcgaatttcttttcataaatggttagggcatccacccgaaactagatgttggtaaaaattagtaggatttatatatacggctccacaaccatatgtaaaaacttgattttcttcatccagagagagatatggtttgtttgttatggaaggatagtggtttcccaccaatttagctttgatggtttacttgactccaaatttccataccgtgtgtcaagccatcaaacaatcatatatagcacaaatcacatggactgtttggtcatcttgcacaaaatgaggcaagcatcctacctgcacctctagaaagtagtaccagtagaaaacggatacatgcccaaaacggcatccattattccattaagttccccggaaaacacgaagaaagagagggtaagcatatcttttgcaacggaatcgatcgaggtcgaggtgtcttaattattggaaaccatatgccaatatcttgccatcatgtatgtatttatgtgtagtggtgtgatgatatatatatatcgattgatctacttaaaagaaaacgagaaatgtgaaaattataaaccacaagcaacctagtgctttactggttgcacctacctacccttcgataaaaaatggaaaactattaattggtatagctaggttgtacattgcacgaaggaaaattttggtttgtgctaagagtcggaaaactgtctaagtctatactttgatctatgtaggctaggagaaattgttaggtctaaatgttagtacgtactgcttttctatgttccggctatcaatgcgtcaggcgcggcagtggcgacggcgatgacgggagctcgggcggcagtggggctagggtttttcttttggaattttatatttttgtgatttttttctttttacatgcggtcggcttaagcgcccgctggttgtgctagctgcatgcaaaaataccgattttcacataccttttcacgcatgtggctgcagcaaccgcatgcaaaaatcagtttcacccgtatgcaaaaacgtgttatgtagtagtgatggtttacctagtggaacatacaaaataaaaacacacccccacaatatttcgcaaatggtggtataaaatagggagagaaaaatacatatttttagcaaagtcaatttagccttatggttatcaactactacctccatcccaaaatatttgacgccgttgacttttttaaaaatgtttgaccgttcgtcttattcaaaaaatttaagtaattgttaattctttttctatcatttgatttattgttaaatatacttttatgtatacatataattttacacatatcgcaaaagtttttgaataaaacgaacggtcaaacatattttaaaaagtcaacggtgtcaaacatttaaggaatgagggagtatatcataaatatactgataattttactagagttaccaactatatcataaatataaagataacaaattcagtaagacatcaccctgcaaaattctaagcaatagatactgaccataacatgctcatgaagaaactggctatcagtatcatcggctcctgcctcctgggtgcactgcaactatgcagcacgcagatccgtggtgaactgggtcaagcaagcaaggcaggattctaatgctcaagtgaagatagaaatatgtacaacgccgcagaagtagatctagcactgagagagtaacaatgatcaatcaaaattggagcaataatcaaaacacatctggaaggatttgtggtgttgcatccaaagccaagcagccagctgaaacaccatggccaaagacgactggccatgcatatgctaatgtttggtattggagctgatctaatacactgtataatttaaataattatgtgattagtgggttggtataaaacataagctagtttgttgggcgaggcattggctccgcctctggggtttagctagcaagatagtaacacagaatgtcctttttattactatacggaagaaaatagtggtactggttctgtttggtaatgctgcattacagatgtagccggctgcgctgcacagccggagctacacattttttaccgtgtaatgtagctgctgcagtctaaacaagtactctactatattttgcaatgtaaattcactactacaaaacatcaaatagatatcggtactataggtgccggaagtgctaaaaccggtacctataggtctttttccactttcgcaggttgaaatcgcaaaaaaaaacgatacctttaagcaattataggtaccggttctaaataagaaccgacacctattctataggtgcccccttttttttaaaaaaaatggtacctttaatatattatagatatcggttaattaaaagctgacacccacagaaatcgagccgagccggcaggccccaccacgacgagataaggccgaggggataagaggttcgctcgcttctcgatctctctcttgcccctctctctctcactctctcgctcgctcgctctcgccccctcctccttctccccacatacggtgtcggcggtggtggcttctctcccacgacagatgcggcggtgggcgaggcggcctcgacggcggccggggtggcaacggcgggtggagccgcagtcgaggtcggcgtcggcggcagaggcttctcccaaggacggagtggtggcggcggtggcggctcccacgacggatctagcctcaacggtagccggggccgcatccggggtcggcgtcggcggcggaggtttctcccgcgggtggagcggtggcggcggcggctcccgcgacgaatccggcgacgtatcggcaacggtgatttgtactataaatttgattttgtttctatgaaattgttgagggatctgtgatttgagcttctttcacatgtgatttgtgtgaaacttttatgatttgtgctttgagggatctatcattggatggatcaaagatggtgctttgagggatatgtcttggatggatcgatggtgacagtgtgtgaaacttctgtgatttgctttggatcgatggggtctcgaggtgatggggaacggctcgatgcatcgagacccccccccccttttttttggattcttgggaccaaaaaggtgccggttcctaaaccggcacatttgaatattgttggatagtagaagagagagatatactgtgaatattagacacgttgtattgagcctcagggggccggtatatataggagtacaaggggaggagataaggaaggaatccacacatatcaatcctatcctaatatgactctaactaccatatactctaacatccccccgtagtccatgcgtgagcaaagcggacacttggattggagaagaaaccagcaagagtgctcaagacgaatgattgccctttgtgccatgtcgatgtagccaaagcgaaggatgcgaaggacccgtgggcgacgaagccgtgcgtaaagtagccatggtcgatgtagccgaagtcgggaagctgatgtcgaggtacccaagccgcagagcgcgcatggggcgccgtagagtggtcgtggacgcacaggagggcgtcatggaccaaggtgcgtgaggatgcactggagacgatgacggtgacccgatcgcggcagtcattgaggaagatgatgccaaagagccgatgtagtcgaactgtaaagaagagatgtcacgccgggtttgccagactcgggaacaactcgggacaaacacgcgcaacagtgttgccaatatcgtgccggcaaggcaagggaccaccgtgaatcatacgcaaatgtcggaggagactagcaaataatgcctccgggacagtcgtggcgtgagaatgacgtagagggagaattccggagcagcgcgcagttgctgaagaagagcgaagtgtagtcaagaaagatacgacgacgctggcgatgaaacatgctggacgaagaagaaggcaaagtaggaccaacggcctggacagcgacatcggtagctatgtagaggtagctagaccactggcctagaacggcgacagtggcagcttggagacacggcggcgatgctcgaagtagacaaagaagactcgagtggctgacgatgaccagtgcggatgacgaggttgtcgatgcacgaacgacgatgaagacgacgagacgggcgacactatgacccgaaggggtgatacaggtgtagctccatgttgatgcagcgacgtgaaatccagcggcggtgaggccacagtgaggaggacgtctctccgtggaccacaggcggcaacactgcggcccgagagggcgacgcagcggcaacccaaagcttgatggcgtagtagatatgctcgcagacgatcagttgcagaagtcatcatgtatgtgtgcttgatcaggtgatcagaccgaagttgcacacaacggaacaatgaagtcgaagccgaagttgatgccgatgtcggagacacgtagatgttaacgaggcggtaggcgacacaaacctgatctctggtcgggagaaagaagaaagatacaagcaacaacacagtagcagcagtccacaccacaccacagccctccaacgcaactcatgcaggtctggtcaccatgacgtcaacgaagtcaacaagcctagatatctccacaccaatcagtctctctcctctcacttggcagcaacgcacgagatcacagcagagacgatggctagtcaacagggtcaaaaggaggcactgcagaaagtggtcacagggcgctcggccaacgactgtccagccagagatgctgacggagggcgtcggcgcagcaagacggaggcggtgcggaaggagtccggcggccgggtggagaggtcgacggggtggtgccggcagagcgcgccaggccgggggcggtcggggctcggcgacgccggccgtgcacctcgacgcggtgaggaagaagcgaccgtccacccggcggcggcggggatggctcgatgacgagaactcgcgacgcgacgaccggtagatccatgcgttactgcggctgatgcttgactcaaaccaccatgacgccgacgagggtcactggagaagatcgagatcgatccctcacgggcaaccaccatgacgacgaacccaaaaaaaaaaggaaaacaaaaaatggtgcccgcccccgtgagatcgaaatgctccccggggcgacgagcagaagcgcgagcggcggcgaccctacatcacccgcttggataccatattgatagtagacgagagatatactgcgaatattagacacgttaccatctttcgtcggtcgtccaaaaacataatagtcctagtttgaataggaatcgggactaaaaattattaaagattatttttagtcttagttcaaagaagttggcgggtctgagtcaggccccaattatcttttagtcctgattggtataaacaaccgggacgattggtataaacaaccgggactaaagatctatttttaataccggttgtttatatcaaccgggacaaaaataaacagccgagtcgcgtgccgatcttatcttctcggtatcccctcccctttcgttctctccttcattaagactcggtatcccgaacagatcgatcgatcagagaggcctcttccccttcctttccccttcttccaccttcccctctcctctgatccccctccccgcctcctcctcctccttcccctctccgcggcggccgggcggcggcggcggagcgagccggccgcgcggcaggcggctgtgcagcggacgggtggcggcggccatgtggcagccggtcgggcggcggcggctgagcgagctggctgcgtggcaggtggccgggcggtggcggcggcggcccacgctggatgaggccggcggtgactggcctccctaagtgtgaggccgggtaagttcaattgttaggagcgagttcagatcttggctcctgacactaaggagcttttttttttattttgtgaattgatgtgtagatttgtttgttgatttggggatgattggtggattgcggaagggcatgtatagtggatgattgtgtatgatttgtgaatggttttcttggatgatttatgtgtgtgatttttgtgtgattgtgctcgagatataaacaacaaaacaacaatgaaaaaaaaaagagaaaaaaagtaacaccaaccgagactaaagatccggttatttcaactggtccggattcatagtcccagttataaaaccgggactacagggggttaccaatcgggactacaaaaggtttcttcggtagtgtaaggaaggattacaaataggaaggaattcacacatatcaattatattctaatatgactctaactaccatatactctaaccaatattcatatatgtgccgcttctatggtgctggttgagaaaatcggtaactatgtggggttcctaaccggcactgatgtggtgtagtgattttctatatcttatggtttgatatctccctgcagtgatcaagctaggcatcaaatattgaaaccaccgtcgatatgttggtggagacgcagagtggagttataggtgcataagcataactacttatcaaatgtagttcggttgtgcctaaggctgtgcatgttcgatacattgagttgggaactaatctcttgcgcatgcaaaacacagagcgacttattagcacataattaattaagtattagctatattttttaaaaaatagattaatatgtttttaaagcaactttgctatagaaaatttttacaaaaaataaactatttagcattttgggaaacctgcgtgcggaaaacgagaaagaatagttgatattagatgacaagttttatagtcacatctaatattatccatatcatcaactaatttactaggggacattgtgaaaaggttgctttttacatgaggggtcgttcatcctctctctcctcttttctcttctctaccttatcatttaagcttatgtgttatctaggagctcgtgggctcgtgcttagatgcttatagtacttgccgatactgatagataaaaataatctcgttaatcttattttataggaaggatgtagagtattacggttggaataagatcactttgacttcctcaactgaccaccaaatctaaatcatatccctcaaccgcaatactagaaattttgaacccccaacttacaaaaccggtacaatttgactcttttggtggttttggagagtggttttgctgatgtagcgcacacgtggcagtgttgacttggtcttcgtcccacgtggcgttgacgtgacacttatgctgcattaaaattaaaaaatatatgcgaagcccaattgtcattcacacaaaaataattgtgggccccactgacatgtggttcctacatgtcatcctctctctcaccacccttctttttcctcctctctcccttatttctctctctccccttgacatgagccggcggcaggtgggggctcgagcggcggtgcggtcggagagctcggcgaggagcgcgttgacggagagcagcgcggcggtggagcccgcgatgacaccgagcacgacgcctgtggtgcccaccaccttcccgggcaccggccactcgatcttcgacatctcctgcgcgacgccgacccaccacccgctgctgatggccgcggtctcggcctccttcagctccgccgccaccgtctcggggctcttctcccctcctcctccttcccggcctcctctgcgccgtccaccaccgtcatggacgcctcctgctgctcctgctcttgccccttcttgttctcctccgctcttgcgcccttggacttggagccgcgagggcgaggcggccgcggcagctggcggcggcggagcgggagagggatagggagatcgcgggagggtagaaggtggagaaggaagcgcgcgaggcagcggcggcggcggctgggacgaggcgggcggcgtggtcgccatggcttcccggtttgatgggtccagcggcccgtccgccaccgccattcggagctctggatctaggccgtcgccaccgccgattcggacgccgctccccacgcacaaagagaaagagggagagatagagaagggaggagagggaggaggaagaagggataaagagaggatgacacgtgggacccacatgtcagcggggcctacaattatttttgtgtgaatgacaaatggacccacatatattttaaattttaatgccatgtaagcgccacgtcaatgccacgtgggacaaagaccaaatcaacgctgccacgtatatgccacatcagcaaaaccactctccaaaaccaccaagggagtcaaatcgtaccgattttgtaagttgggggttcaagatttctggtattgcggttgagggatacgatttagattcggtggtcagttgagggagtcaaagtgatcttccattacggttacggtaaatagtttatccgatccgtttgccttggtggacggcccaatacatcatcacggcctatcgaagttcggcagcccgtacgggcccatgactagcgaccacagtccgggcccacacccacaccgcccaaccaccccactcccctccccgccacgtcgccattcttcccgctcctgacctttctctacccttctcctcttctcttctcctctcctcccccaaataaccaaaccaaaccctgtataggctcgtataggccaaggcagaagcttcccaaaccctcgctctgcccgtcgatctccgtcgccttctgatccccgcgcgcgcggctgcctatatataagttgcggtgatcggcgggcggctgcaccggcatggggctggagatcatgacggacgaggctgctgctgcgccttcgcccgctgcggcggcggcgcgtgtcgagatttacccgctctgccgctactacttcggcgccagggatgttgccgctggtggcgcgggtgcggggttggagaccgccgccgaccgcgccctccgcctcaaggccaagtacgcacgcgcgcgcgcactacccgccacctgctcgatcaaatgcgtgacgatcatgtaattttgtgtgtgtggtttgattgatctgtgcagcttcgcggcgcacgggctccggaccagcgtccatggcgtcctgctggttgagctctttgatcatccgcacgtgctgctcctgcaagtcaggaactcctccttcctcctccccggtggccgcttgagaccaggggaacaaggtgctcatcaatcatcattgctgcaatttcccaagttttcccgtaaaaattttaggaatggattgaattgaacctactattgaattcttgccatgtgcaagtgtctactgccgagtaggatgtgattttctcctcgtgggagataatgctagtgcaccggtacacttgcaatttggatgacacgtgtgttgcctggtatctctgcttcagatgtccaagggctcaagcgcaaactttcaaccaagttatcggtagctggacatcaggatgacgaagacggcgacggggacgacgaatggcaggtaactggagtgaacagagatgttcagtaatgttgggagtgagaccaccagtatgatccagcaaattattcatccttttcacgttgattatcggctatagattggagagtgcattgggatgtggtggagatctgagtttgatgctgctccatttccatatctacttccaaatgcccgtgcaccaaaggtaaagagcttgacatacactccggttcatccatgaaccatgtggtttcctcaaataatattaatgtgcttataacctgagtgaatcattttattgttgcctgtcatgaaggaatgcataaaactgttcttgattaaactgccggtgtctcgccaatttgtcgtgccaaggaacatgaagctgctagctgtgcctctatcccagattcatgacaatgctcaggtcagtttggttatcaccatccaacacaagggattttaccatctttttttaagctcagctgcttcagctgactctttttttttttgcaggtatatggctcaatcatagctggaattccaaacttgttatcgaagttctccatgaacatcatcagtgactgagatgcatgccacatgccgttaagagctgtcacggctttacatgagactagcatattcgatctagtagtagaacatgttgtgtataaactgtacctggtagaaatataaactttggaattcacgagctggtgctgtcctgtatgttgtgcaatcttttttttttcttttactgtatagaggtaatgtattgtatttgtatatgttatcaacaccaggtgtggtgttatttttgtaacccttctgatatggctgtagaaatgaaacagttctgtacaagatttgtgattttcattgccagtcctgacaaaagctgaaccaagcacacctcgctgcgaggaccaaacatgtcttttcgattgcccaagcaaaagatagagatagaactaaacaaactttaaaatatgatcgttagaacagccacacccggcacaacctttcgaagaacatttgtgttgtacgatcctccatgagcgtacaaatagctttagcccaaaaggaaggctacatgtcgtgctgcagcagctcgttcactgtctgagcaaggttaggctcgctcctgatgctctcgatccatctcgcgctgatacggaccctctcgaggctctgcttcagtgcacgctcgaacgatggtttggttttaccggcgaagaactcggaaacttcagcagccttctcctctgtggtgaactgatcatgcagagaaaacggcgaatttagcagcagagcaaggagaacaatgaagcaaaaagtggtcggtgacttcgcgtacccgtgaaacagtagatttgacgaagtccgatatgagtgaacttgatggccaggtcttcaagacatgatcccagttttcctgcatcatgcacagatgggctcatggtcataaaagtacaacttactctgaactcctaatcagacttgctaaaaataacagaacttattaatgtaacttcttcgtttagctcattattactgcctctgtcccataataattgtatttataggatttgaatttgtccaaaaatagttatcacaacagaatactaatggtctcattaatcatttcttattcaaatttctctctattttaccttcaactaccctcccactcttacctatataccatttaataaggggtatcatagtctttcttcttaaaccttaatatatgctaaacaacctagaattacaattattttgggggcggaggtagtatcaaatagtgtgttatgcaggcagcatctcttctataaagtggaaaaatgtgttctattgttattcatacgctacaagcttggatttccctcgaatagcagagagctatgcagaattgtggactcgtgaatgggtttggagatttaaatctcatggaggtgatcatcgaaatttttttagataatggaataagtttcccagccattggtaagggcacaaagctcattagcagcatactcctatttggtgcaactgcataaacggcttcagttcatctgtcagaacagctttcctatgatgtactgtgtatctcagtaaaaccttttgcttttttgttttctggttggctaaaagagcaggaccaatgatatttggtaaaatagattgattgcgccagttttgggtgaagagacctaatcgtgcaaagtgtgaacagggagggaacatcattcaattgcagtaacttggatattggcacggtcggtgcaaaggaagttttgataatttcatcttccctatttcatctgttttagttccatcgttaacttttaacaaattatttgttcttgtattgagatagacacctagcatgcattggcatttggcagaacaattgaactttgaacccctcacaacagtaaaaatatatatatattgagcaccacatacagtgcttatgttttttctttcaaaaatatcagaaatgtgtgcgttgtttatcagataactataataatccactttaggtaccctgcaactataataacataccttcaaccaggcccatgcaacttctcgtccttctaagctgataccaccaaggacataaaatgcatcttgattccgtacctaacaagcaagagagagattagattggcttctgtaccaatggtgtataatggttctcattctaccatttactatctggaatcatttgttcagaataagtaaaatataaatgattcagagggttaacctcatcggtaagcatgaagtttagtgcctcaagaacaatatccttatccaggcatgaagacaatgaacctaaaacagaagaaacgttactttccaggacaactcatcagaaaattcctgctgtcgcttaagctagacggttggaatgcacaaacctaagatgcgtgacttctcctgagcttcagctgtttctctgtagattttcaggagggcatcataaccagctctgctggaggtagtaacagtccgcatcacagcaagatatgaagcctgcagaccaatgcatatcagtatgctagatatcatagaggtaacactgcagtagtatgttaagcaaaagcctgaacctttctagtgtctgggggaagaatgttagttttgcggtcttttatgaagatatggaaccgcctaactccctcatttatagtctcatcatgtccaagtttgacaagggcaatcaagagcaatgatctaagcattacatcaagatggctctcgccctccttgggatcccagcctagtgttctgatatttagaagtacaagaaggatttcaatatgatcatagaaagaaaacagcaggaatatagtagacagaagtttattaacagaaacaaattcaccagtggcatgcgccaactcagaagtaaatatacaaatgcacataaatgataatatccagattcgtgaaatccagataaacatgatgatgaaaatggtaaaacattaagtttgttagcatacttggcagctgatagaagaagattgatcaaaagctgtttgatatctctggacaattcaggagtagcatcaactgatattttatcaatgcctaagcatacctgtcaaaaaggatgcatgtatttaatattgagaacaatagttgataccatagaatcaatcaaagatacaaggtatatgatttcattggaggtggcgaaaggtttacttacagaggttacatgtgaaagcacagtgtaatcagactcattgcgataagcattcagcaggcgaagcaaggatgtcagtgtttgcttgcgagccacagaaagggagtatgaatcttccacaatacctgcagcaaaatattgtgtttctgttgtcaaaatcttgacaaggatatattatacgagtagtattgaaaattcatcttgtcattaccaatcttatccattaaagagagcttattggctttgattgccttttcaagtccagctgcaagttcatcatcatacttcactctataaaatccagtttggtcaacgttcaatttgatccaacagttttcacccttctctcctccggcattttgggaggcagtgaggtctatatggaccttatcagtcttgcccttcaagagaaactttttctgtgcatcatatgagccacaacatgatgttataggaacaatccacaagcctggaccagaggatccgtccgatagaaactgtgcctgtaatagaacagacttcagtaagctcctctttttgcaatatgaaagcactgatatgggccagaagaacgaaattttctagttccaatacttcgaaatctataattttgccagttattggatgcatttgagaaaaaaaatacaaccatacacttgtgaataaagacatcagcagaccatacatgaataacgaaagataacatgaaacacaaagcacactatgatattctcatctccagttattatggttctgagtttctgatcaaggtgacatgcatgttgtcctaaaagtgtgtatgaggaaaggtgaggtcctctagacaactatgagaagttaaaaacaaaagaaacaaactaatataagattagatgtatgaataaaagtagaggttctggaaagaagcgatcctgaacaagtgactagtacagctaaaacttagacatataccacctcaaatccaaataaaagtcattttagtcttttactcttttcaatctctctaagtgcaagttactgtagaatttttgaggcagttttctcttttttccctccattctctttctacttgaaagctactactattatgaataaatggatcgtgtttttaatggaataaatgaagggaacaacaccattttgctacttccttagttcttgggaataaggccaaaaagacttagatttcagattggacgaagcataaggcaatggaataaggcaaggccgatggatacatatattcagttcttcatgtatgttggtataacatgagaatgagaaatctgccagaaaacctgttcaaggtgcaaatcatgtccatctagttttgcataaataacagggtatccttgttgcttagtccatgtagtcatcaaatccttaacaggttccccagattcctcctcaagaacagcccatagatcttctgttttggcattcgagtaagcatacttctttatatatgatgccaaagctttctgaaagagtaaaaaattcacaaaatcagcacctgccgaagactaataaattgtgataataaatacaaagtcaataacatgacacaatctcatagaaagacaacaatatgctaatatgggtactaaaattctaaacgttgttaccgagtattcaaaagaaatgatgtaattgtaaaattatgaatatcttttctttatttatttttcctgtaaagagactcttatcttgggtatagtaaagctggatcaatcttcatactttggtctaaaaacttatgagtatctttcatgaaaaaatcactcacaccattgtttatatatctcaactatatattctacagcctttggtaaaagttgatatgacttgttgaccgcatgcattctatgatatcaccttctttactggaaagaataaacaaaaactaaaaaagaaaaatccaaactcaagatattcttcagcagattcaccacagatttgcaaaatgaccagaaacaaagtcaaagcaaacaattacgatgccctttattatttttggtcaacaaaattttcttaatcaatctgagttaaatgcaatctggacttctgtagagccatctagcgctgagttgtttatgaagaatataaatataacatgcgtggataagagtgtcaattcaagagcgctgatatactagcagcaggagatgctggaggctggaccattgcagaaaacaagattttggtaaattcattcaaggagaaagaagaacaggatttaacctgaaaacgctctgcaccaaggtaactttgcagcatgcgaatgacggaagcgcccttatcatagcttatggaatcaaaaattgcatcaatttcagaggcatggtttatgtcaacctgaacgaacataccaaatagccagattaacaactgggacaaaggtgctaactctgtgaagacagaaatagtaaaaaatgcatggcagcatattgacatatttgagtttctacccaaaaaaaaatctaatttctaagcatcaacacctgaataaattaagcaaagatttataaaaatatcaaaaattggttgtattgtatgactagtcagtattagggatgaaaacagagcagatagttcccgtccgctccggagaaaaacgaatacggatacctttcggatcggataattcttggatagttcggatacagatacgaatacgaatatggtatcggagtttctatcggatacggataataattcagatatccgcagaagccatgaggcataccccgtttctttatctttttagattttaagagtagttcatctcttaacactagtccacactattaatattatttaaatttttaaaaatatttataaattatactacattttatataaaatgagctaattatatatgttgatatttgtttctattagaagttgagttggcttacgtgttccgagaaaaaatttgtttccgtatttgtgtccgatcatgttcgattcttattcgtattcgagataatccgtatttgtttctgtattcgagctatccgtattcgtttccgtatccagcaaaaaaatatgaaaacgaatatggtatgagcattatctgtccatatccgctctgttttcatccctagtcagtatgcatgcacaatttgtatccttgttaattcacttatcttactgctttcatgtacttccatatctgtaatgcatatttgtgcagcatcaaaatattatgtttcttatccatcagtgacttcgccaaagcatactgaagaagattacctcaataggatgagactctgcaagtgcatccagtctgagaccagaggtcgtctcatcaagaaattgtgtccagttattccattctggaaataatgcttccacagccaaataactcacctgttgaaacatatggaataattagccggtaagatacacaacaattggacaatatttctaatttctcaaacaatagttttcagattgaatacccaggaagcaaaaccctcatttagccacaagtgagtccaccactccatggttacaagattgccaaaccattgatgagccaattcatgtgcaacagtgattgcaacctaaagagaacagatgttaatttttctttctttctttcttttttaaaaatagcagtttacctggccaaaactacacatgaggattcaagtgcgagactaactctccaatagtaaatgaaacaaatgaaattgataaagataaatataggcataacctgttgtttattggatgctgaggataacagctcatcataaagtaaagctgtttctcggtaagtgaccaacccatagttctccatagctccagcagcaaaatcaggaatagcaaccatatccaacttcggtagcgggtaaggagtggcaaaataactgataaaagaacattattagttattgtagtgaaataggcaccatccatggtattctgcctcatctttagaaataaagcttagaagcaagactatgttggaagcttactctttgaataaatccagtgacttcactgcaacatctagtgcaaactttccttggttactcttgccaacttgagtatacacacgaactttggtgcctacattaaattaacaaaagccaatgaaaaaatgtgtaaagaccaggcaaagaagggacatatcatatagtttgaatgaaagagagcaaacaatggagacagaaactgaaattctaccttctaatgttgagccctctatgtaatcaaataaaccaacaactatagccactagataagttgacataagtggcgattcctcataatagacggtcttgagaggtccatgaactgtctccttaattactggcatgttggacagtgctaccaactctgatggaacttccagtgttagcttgaacttagcctaaaccagaaataaccagacaagaggtaatgttattttagataattgatccaaccttccaaattctacagagcaaggagccaaggaccatgaaaatattagttaagacctgtgtaaaaactagaagtgcaaactgaatttttctttcattacaatattttcctgtctgaattacatcaaaacactcctagggaaacaacattgtagcatgttaaacaccttaaatgcaggttcatcccagcatggaaaacatcgtcttgcatcagcagcttcgaactgtgtaactgccatatttcttgactcccccttgtactcatacttgctgcaatcaaacacggaaacaccacccacaatgcattaaaaacagatcacaaggatataaagaaagtacaaccggtgcactccaaactacactgattatgtaatgtatacagctttgttacaaaaatgaagataaaatccaaacatggaggtcctggataatatatacagtatttatacatcacactccaatcatgaatcttggtgacacaaagacaggacaggagtaaactaagacttacaaatggtatatagcacaggaaggtactagttacatcaaattgtggcaatttcaaataaaaatggaaataaatatcccaaaaactatgtttgctatccaagccctataatattacaacatgccaaaaaaatcataatcaaaactacattattaagatggatatacatatgctaatgctctatagggcctggtgaacagtgggtgctaggctgcgagttatggatggtgttatggtagtatggagagcagcatactctaccaatagcgtatagtgtgtgttttgaagacaagatcaggatcctaggcagacacaaatggttcaataagtttaatgaagagtgtttcaggattaacaaagagtggatggtcgatcattataagataagattgtagattcaagctcacatcctaaagatcctgagatcttagtcactttctaggacattaccaaataagatatagatactatccattgtcttagcacatcaagcatggcaacaatttttgaaccggtacacctagcccttgttgttaaagttcatgtgccaatgctattgattgcttccaaacacacacttgcagtttccatcaagtcactgctcgaagcctagttactcataacaacgaatagcagcttcggacctcatctagtaggtgtgaaccccccatggttcataggtattcaagtggatacccaagatatttgaaaacaatgcgttatatcataaagcttatcttattgtactggtttaaagctttcttattatatatcatgtcgagggttcgattcctgcatcctcaattcttttttctcctctctttattaggtgttcaatttttttgtcttctgtttgttaggatttcaatagcttgtagtaattgtttgttagaatttcaatagcttgtagtaatactagtgttaggtgtcttggactcttccatacatcctatgtagtatgtaatatttttcttatttcctcaagtttcaattggtcgtctccagcacgaagaatagatattcttaagtcttcttttttaactaatattggagtaagaatttgaaccaattatacattttcagaaaagtagcctccaaaccaaaaaaattctccaaattcatgtaaatcatccaaactatggaaaactatttactcatttttaatggcatatcaaaaatgatttttcatagatatcgtgacattgttctctaaaactcgattctctatctagaaatcccacgtccgcgactaccatctaataaaccagaactgcaagctgttgctgctggaatgcctgttcgcacctcatgtgaacgagagactagcaacaatcaccagttatctgtaactgaaagaggtggcaacgatacctcctgtagaagcctctcatctgatcgttgagcgtcccggtgaagtccatcttgagcacgccctcgccgatcggcagatcctggccgaacccgatgaccacgatctcgtcctcctcgaactgcaccacctcggaaggcaccaaatcctacaaaaccccatcatacaacgattgagcgaccctgaaacgaacacacggcaacaacgcaaacagacacggatggttaacgggggaggcggtgcgcgcgtgcctggaagcggacggaggatccgtcgacggcgagctcggcggcgttgaggacgaggaatcgggtcggggcggagacggcgacggcgacggcggcggagccggagaaggcgcaggcggcgaggtcggggcggaggcggaggtcgtagctgagcggggaggcgcaccgcgggagccgcgcctggccccggaactgctccggcgaggccgccatttgcggcgggggcggtgtggcggtgcggcggtgcggcggcgggagttgcgacggcgagtgggggagtagagtagtggggaagggagggagggaagaagacgattatgcccctcgccgccggctaaaaaggaagggaactcttgttcggttgcttccgggccaggataagcaccttggggccgccacgtgtacagagcctgaataggtttagggccttttggcccggacccagagggaaccttgggcactgttttaaaagcctgagatccttaatactccgaccccgtttgatagggttttaaactctaactccagcaagagctaactcctatagaaactgaagtgggtacgagagtgtttggctagattagtcagctccactccaccacgttccttgtaggcattttgtcgaacacatggttggcatcgccttgctactgtcgtcgccgccgccacccacgcgtcgccctacacggccgcggccgctgtcgctcgcccgctgccaccactgtcaccactgcccgtgcaccaccttggccaccacaacccatgcgccaccgtggctcgcgcgcctcccgtgcaccaccatcgcccacgtgcccgctgacgccgccgccgcccgtggctctcacgcgccgcgccgtgccaccaccgcctgccgccgccgacgttgacgccgtcgtccgtcgctggctcgttgttgactgctgtagggagggaggaagatggggagagagaatgggaggagaggagatgtgaaggggtagttcagtggtatttttgtgtaaatacataaaaattttaaagggtagtgggtcttttgggtggagtggagctgtggagcagcaaaaatccagctccacccccatagttgattttttaggagtagctctaccagctccacttccaaaaatggaggatctggactgtttggcgcaactccggctctaggtaagttggagttgggagctggaactatgccaaacggggcctccctctgtccatattataagtcgtttgacttttttttagttagatttatttttttagttagacttatttaagtttgcaagtttaaaaataaagtaacattttcaatacaaaacaaacattatatcaaaatatattcagtgttaaatttaatgaaactaattttatattgaagatgttgaaaatgctactttatttttctattaacttggtcgtacttaaaaaagtttgattaagaaaaataaataaatgacatataatatgaaacaaagggaatagtttattttctaatttttgagctattaaatcagaatgtggataagagtttagacggtttggggaaaacgaaaactattattgatcataaaattacatggactttttctataaaattgaaaaatagtttccgattcaccaaactaattcttatctatttctgaaggaataaaaaaaatactagaattcttaatttttcaaaaattttctcattgaaacaatcaaaaattaagaataggttttgttggttaaagtcaaaaatttttcatataattttttattgcatatgctactacattttttttcatgtaagtttgagtactttttcgtattattttgtaaatataaatcaagtataaatttataaaattatttcatgtttaggatagaaaaatcaattttaagatggaactttgtttaaatatggaaattaaatgatgatagcgatgagagctgttatatttttcatcaacgaatgagaaaggtaactgaaattttacaaatgacctgaaatctaaaccctccctgcttaaatgacaatattatatcaagacaagatttttaatggtgtgtttcggtttgccgcttatcaaattattttgacagggtaataaatgaaacttgccatatagtattatccaactaggctccaaagcattgcaactgaggatccctcgagtgtgttgcatgttttctttgtagcatgagaattatgcacaaataaatatcaggacggttcacattgaccctacaagataggtttgatttagttcctaaaattcttttacccaaaaacgtcacatctaatctttgaacacatgcatggagcataaaatatagataaaaacaaaaactaattgcacaatttgcatggaaatagcgagacgaatcttttgagtctaattagtccatgattagccataagtgctacagtaatccacatgtgctaatgacggcttaattagactcaagattcgtctcgcggtttccaggcgagttatgaaattagttttttcattcgtctccgaaaacccctttcaacatctggtcaaacatccgatgtaacacccaaaaattttcttttcgcgaactaaacagggccatagctcagttcatcactcgtgaaaaaaaacatatatttatttttagtgttaaaaatgagggatgtaattaaaggagctctttcttctcaaatacgcaagagagttggcatattattgcatcggaaaaggagaaaacataatacacgacagactcaacgcatcacgaacgcaccacaaacaaaaagaaaaaagattacaccctaaactaacaataggatctttgacaccaaagatcaaagatggcttcttcttgatccaccagttaccaagcacaacatcaattatttttttatgggaattactgttatgtatttgtccaacagtatggcatttattaaaaaaatatttacatcatacaaaaggacatgaaaaccgtagaaaaaaattacaaagattgtaatcaatcaagaacattgaatcaccaaccaaagaaagaaatcaaagcattgactgagcccttgactacaatgtagtaacttctacatttgttagagttgattcttttaactctctcgttttaattcaacctgtaacagtctctcactcatgtactcttaatttggatgtaaaggaggtacacaacttaattctttaaaaattaatattgattaccaccaagtttaaccccctatagcatcaatgcagtagctttgttagagttaattcttgtaactctcttgttttaattcaccctgtaaatagtctctcatgtatggctatatatattttaaagtttgcatgcaattgacagtaagaattatctcattccatctctcgctctcccagttctttatactttttcatgcctggtatcttatgaatcatatataggttgttatcattataagacaattttcattaatggaatagatagccaggtaggttttcttgctagctagtagtactacagaaggaaaaataaaatgatgctattcttagctgaatgagactttcactcttatcctcacaacagcatgcccaaatccatacactatcctaattatagagctcaattttagtttgtatatatccatagaactcaattttagtttgtatatatccgtactacttgaaattggttttgttgtccacaagagtcaaggctcacagaaatctcaccacagataatcttgttagtttcttgagaaaggcaagctagctaagctcccattccctctgcatttgaatctttgatttgagaagcttcatatctccatttcatgaaaacatgactggtgtgttaattccaagctaatattgtgaacattgcatcatgttctctgtcaatgcagatggaagctgcagatgtagccaaggaacatcacaaggaggagaaaaaggacaaggtaaacattcttctggttttttgaaaaaaaaatttgttgacaggataagacttattctcactcatgattgtgtgagaatcataagaaatgacagtcgaactaggagagttctcacaataatacaagataataaatactagtcttcaaaaccaaaaagaaaggtgatactatatttgatgcttacaacaagaaattctcaaacaatcacactttagtcacacaaccatgtaacattgctcaccaaactctgacgaacatctgcactcctttttgcatggcaattataaatcatcatcatcaaggaacacgccaaagaggcgaaaccggagaaggagaagaaggagaagaaagagaagaacggcgaagaggcggcgaaaccggccaaggagaagaaggagaagaaagagaagaaggagaagggcaaggagaagaaggagaaggtggaggagacgacggacgtggccaagctgcgagccaagctggagaagctggacgccaagatcgacgacctcaaggccaagaagcaggagatcgtggcccgactcgtccagctcgaggagggtgcgacggcaaatgctgctgctgcagatgcggcaccacctgccagcggctgaggaggaggtgatctgggattcttaggcagttcttgcaattggacaagaggagaaattacaaacattttcagacatttgcaggatttgcagctagtgacgatctgtttctgaatggaagctttggtacagaaatttttgccttcttacgatgatgatggtctcaagtcgtctttgctgaagaccatggcgccattgagtgttgcttgtatgatatgatcaggaagtgaaatttatagcgcaaatgagtttcatttgcaagatggtgttggagattatgtatgtgtcacgataattttacgacaagatcgattcaaattttctaaaagaatcaattactacagaaatgtgctcctatacctaatttctctcgaaatttatatcattgtttctgcatgtcctgtaaacaattactagcagagtaccagtagagctgaagaagtgaagaaatgcttttttttccctcttgagttcgtgccatccgttgaaaaacaaacaggaaaaggcgaataatcttaagcacagtttcacgattttcaatgcagaaatcccagattcccatctccaaacctccgagcattactaacaatccaccaataatctatcccttaaactgaaaatagaaggtgaaaaaaccgcttcctccaagagatacctaaattgaatctcaaaaactaaaagtgggctcttctgttaaactaccaacataaattgttaaccttagttttttttagaaattgttaaactaccaatagaaatcgtttttttagaaattcgagtggaaggaggggattgggagtcgttctctcgccctcaaatacacgtaccgagaaaattggagatgggaactccaaaacgtccagagctcttttgggaatctgttggaccagttttttttaaccaaaatcccaaaaaattaggattgaggatggaatagatagactgttggtgatgctctaaggcactgcactggcagagaaaaaaagtatggtactccctccgtttgaaatacttaggccaaaggaaattcataaaaaatttaaaggattttattcttatagaaaatttttctatatatccctttgaatcaaaagaataaatcctataaaaccatatgaaatttctatgaaatgtctcttcccagacaagttttagagaaaatttaacataaggtagaacctcatggaaagaatatttctccttaaattctggtgtttttcctgtgacttaatcaaatggtcattcctatcttctactgtgttttacaatcctctgttcctatcttctactgtgttttacaatcctctgttttacacttacattcttgttagaatcatatgttttttttctattcctccgttttttcattcatgtaatttaaaggggcccttttagttgtagatttgttctgtcttaaccatcaacttttaaaaatttgtatagattaacaacatgtgaattatattttatgaaagcatttttcatagtaaataaaaaacataaaccttatgatgttaaacgaatttttaaaaattaatggtcaaagctacaaaaaagtataacttaggacaaagcagcaagaacgacaggtaatctcaaaacggagggagtatttgatatttctccacaagcagtattaaactctagcattctggaaatcatcatgacatcacataataagatgggacattacttaaggtcactaacatcaacatgcaaataattccaaacagcccggtaacacttaggaattatttacagaaacatgcaattcaagaagtatattgacactcgtctagggaaataacctcaggaattactatgaacaaacggtactgaagcacgcgtgcatgtgatacttacaatagaacttcttttgcctaagtttttatctcacaaaatatcgaatacgtagataaggtattactgcagactttcgtaatgcccaagaaatccagaacatccattccctgccatcctcttagatcaatttggcctggagctgaccatctcttatctgcgcagcgatatctttgacggcacctggcccgtgagggatgaacactgaagaggacttggatgaggctcctatctccttcatggtgtcgaagtattgcgtaaccagaaccatatccatgacatccttggcagaggtcccaggcacgttctcggagaaggcaagaacactgtctctcagcccatccactatagcctgacgctgccttgcgatacccagaccagccaagtacttggattctgcatctccttcagctctcttgatctgaagaatcttctctgcttcagctttctcattggctgccaccctcagcctagcagctgtatcatcaaataacagcagttaaaactatgttgccgtccagcacatttacagccatacagctcatctttagaaaaacaccagaccaaccaaacatatatgttgcaggcccttaaaaagcacgaaatatttacttgactagttgaccaacacattttttgttgcacacaatgtaatcaataggttgcagttacatgtgcctgtgttacttatgactgttatggtgcaagtattcacgaagttaatattcataatatgttatgtacatctatatataacttttcagtgttccatctatatataacttacagtgttactgtgttgaaagcctaaaaatatttgtggcaacaattttcagtgtttcagtataaaacttgaataaaactagacaatataaacatggttttgtttctcggaaagagaatttaacattttcatgtctaaacaggagaaaattgtttccaatgcaagctcaaatgtcaagcataaacaccaagccaaataatgtctctgaagaaatggaatgaattgatgttttaattaatacttacctgcgttgatttcattcattgctctcttaacatgctcatctggttcaatatcaacaataagagtttgcacaatctcataaccatacattgacattgcctacagagtatatactaggtcagtataaaactccactatgctctagatgaccaccaattattgaacacaaaccttttcaagctcatcttccacagcttttgcgatctcattcttctgctcaaatgcatcatccaagttcatctttggaacactagccctgatcactgcgaggaagaaagttctgttagcattgaacaatagaggcaaaacatagagaaggtaatcagaagagtatgaactgcaaatgcatcggatgcatgaatgttcacagcatacaggaaccttaccatcaaaaacatacgactggatttgctccctggtgttgctaagcctgtaaaaggcgtctgatgccttctcagcaagagcacggtattgcacagatgccacaacattgacaaaaacattgtcctgcagatatccacaaaatggtatacatcgtcagagagctcagaaaaggtgggtttattctttgatgcatcatgcattagtgtaagtgaagaataaggaaaacagagatatgtgcacataaccatcatcagtatgttatcataaaggagtaaacgaatggaacaaaatgcaagaattttgagaaccattttttatcatgcctgacaattgctccagacacttgccatgaaatataaaagaaaccagagttaagaaaataaactggggaaccttagtctttgtttcacaacggacatccagctgctgcacacgcaaggaaagatatccagcgatctgcttccctatgcaccagggtaaaaagtggcatccaggctcaagaacctcatcaaacttcccaaaggactccttgatggctactgtcgattgatctacttgtaccaaaccgagtgcttgacccatggcttatctagaaaggaagaaatgcagaattacaaatggtgccatatgctaacgaaacaactaacaactgaatgttttgccataatcttgcttatactccgttggtgttaacttctccaatggaaattcatatttcaagtttttagtacatacaaacagaaacaaaagatatgaattaaaaaagataaagccatggcttcaaatgaagatgaatgtatgtcaggacaatagattgcccaacgcatcccaaatgaaaagtcaagcaattgcaatttcagataacttagaccaaacagtgttgcaaaaaatatgtatatcttgttgaaaagcatatcatgataacacattactcaaacttatactgtgtaatcattccctgaaaaatgcctaagattactactccctccgggctgataatacttgtcgttttggacaagggtgaggtcaaactttagaatatttgattatataaatcatttttaaaatatttgtctttcaaatatggtgactacatatatagattggtcttaaaaagtactttaatatgatcatatatttgttaacacttttttacatattataataggaaataatggtcaaagttgttttttgaagaccgtgcgcttgtccaaaatgacaagtattatcagcccggagggagtacatcacaggctcacagaagtcaacagggtaatagatgtagccatacaaaagaaaagaaaacaattcaccatagaaatgcagtaatgaaaaagaatgacgcaaaagaaaacctatacgtgccgatcaacttagtgctgatagcctgataggataaatctgcttcaggatgttcttggccactacagactacagacaagccaaatatatcatataaatagttgaagctaaagattatgctaatcctgattatacttgggggaatgattatacttttgattaaatgccagcgcaagccagcaaactctggcgatgcaagccaaagggcagacgaatcaaacaagacacttgccaagcaatcattgtttgataaaagtcaagagcaagaacccacagggctccacacgacgaggtgacaactaagaaagtcacaatctttagcgagtagtattcatctgcgtcataactaaacaagaataaacaatacagccacttggatactgttgttgagaattattattatttttagctgaggtgggtacagttcgacgttaacctccatctcatggcctagtctagcaaaaaagatgtgcttgacttgactgaaaaaacctcctgaaatttccaagcagtatgtggacaaagctggaacagcacaccatcgaattttacccccactcgcaaagcgcaagccctaaatctgtccgcacagaaagtggaaaaaaccaagaactcaaaccgcgtccaagaaccaaccgcaattcccaggctaaactcaaggaaaaggaccggagaatcgacgaaattacccaccacccgattccaacatccccctccccctcccccctccgacgaaattatccgcccaatctcctccacgagagctaaatccgtccccaaaataataaaaaaaagaaaaaatctagaggaaaccccaagaaacaaacgctcgccaagaaattccaagaaatcgaggtcggggctcgggctgggcgcccgccgaaggggagagaggctggagaggagcggggtagggcttacctcgaggaaatctccggcggcggcggcggatgggacgggatcgtcggagtggcgacggttgcctcggcccctcccaaaaaaaaaaataaaggaaggggattgaagtatagaagtgaggagggcaaattctgaaaatcgtgggggcttccgccgctgcttatcaagtataaaccgtccctgtttctttgtgcctatccgcaagcatgccaaaattaatactccctccatccaaaacgagaactgcttctaatattaatactaatgtgacatatcagttttatgttgatatttattcgacggatggagtacgtcacaaataaaaaagctaaaattacacctctatccatatgattagtcatcaaagcattttctcgataaccagaacaaatacttcatctataaaaatacttaatctagtattctagtacaacgtatttgaacatactatattgttttttttttttgataaaaatgagtatacgctagatgacacattcgcaggtgtgctcataagcatttgtatttgctcggaaaaaaataacttcctttattattctaaaatataagtatcggtagagttttgatatttataccgtaatatattttttaaaatatatattctaatgaatggaaatctatatatttcccgtcactaagatgttaggaaagaatttaacgactaaaataactataaaagagaatattttctctctacctttcgtttcgctaaagaaactaaaaacgcttaaagtttgaaacgggtgatgtattaggtaaagtcgtcaatctatacaatcgtagtatcttccaatgccaatctacatactatagtcaacaatcatgcggataagacgagtttagtgccaaaaggaagttgcgggtcagagggcaccggatcacagagaaaattaattggactgctagtggataggagttgctgactagggggtgtttagatacacggcggtaaagttttagaatgtcacatcgtatattatatatggtatcgtatggagtgttcagacactaataaaaaaactaactgtagaatccgtcagtaaaccgcgagacaaatttattaagcctaattaatccatcattagcaaatgtttactgtagcaccgtattgtcaaatcatggagcaattatacttaaaagatttgtctcgcaaattagtcgcaatatgtgcaattagttattttttagcctatatttaatactttatataggtgttaaacgttcgatgtgacagggtgaaaaattttggggcggaatctaaacaggacctaaagacgtttcctaattcttactccctccgtccctaaaaagacaaccagctctcctaatataacgaatctagacaaccctctgtccagattcgtggtactaaaagagggtcacatcccctcctatgttgctttttttgggacagagggagtatgcactatcctccagggcaatctgcacttattgctagtagatataagcggagtttttattaaaagaatatccttgtctgttacagtgaaacagcatcggactcaccacgcgtcgtcctcgtgcaggctgcgggcggcttgagagccctctcatctctcctcttctccacctcaccgttgtcggagcacactgcctagagaacctagcggtgagtcatgatggtggcgacgaggctaaaccaaccccgatacgcttcacctcttgtgcgggtgaggcggtgtggagcttggcaagccaggagaggctacagtggtgaaccattagtatggggttgctgatacaacatcatcacgactgatctgatggggtgtccctagtccatcatctccacgtcaaatatgactagggtcaaacggcgggggcaatgggaggctggcgtggtcaggccaacgacaattaatggatggccgacctcgccggtggcgacaatagtgggaggcagtgctgggcagccggcatggcaggtgggcgtgacaactagtgcactcggtggttggtgtggatgacaacacttgtgatgatggcatgtttgttatgttttttttaaccttactgtgttgtaatgttgtaatttttgttatgctatatcaaaataaaactttgcactatatcaaataaaactttgcaatatctaatgtggatcattttaaaaaccttgatctcaaatatttcattatccatcgttaaattcaacttggccactaacgatgactttttatacggttagactactatgattgacaaatctatcttactatatagttggtgctcactaacttctaaaactcaatatgcaagtatgtcatattatcatccactaataattattatctagagtattttaaatatcatgcaaacatgacatatcatttacaattttgttgaattttttagaactcaatatgcaagcaatgtcaaattattatcttcacatcatttccagattatttaaagatatacatttaccatttctataatgtataacatgtattcatctacatatctcgtaacaaagcgcatggtatcaactagtaatattaatgttagcatgcaacacgctttaataataaaacatcttttcagatatttaaatttgtttgtgaacagatcgtgatcaaaatagaaatagtatcaagcaattatttagatgagtaaatttcacaaaacttctcctaataaaattcacaaaactatatatatatatatatatatatatatatatatatatatatatatatatatatattgatcaaactatcataaaactacatatttaatgcattgtatcacaaaacaacaaatttagcgtaaaatttatcaaaaaaaactacagatttaaagccaagtatcacataactatatatttaatatcgaagttatcacagaactacagaatttagaggtcaaatccttagcactatcaatatgtttgagctataaacgttgcagttttatgattaaataaacactaaacctttagttttatgataaatttgctacttaatctatagttttgtgataaacttaacactaaacttgtagtttttttatataacatcttaaatctatagttttgcaatagtttgatgaaaatatttgtagttttataaaatttactctatttatatcaaagtgcaaatagtatcaagcaagtatttatgaatggagggagtatgaattactctgtttttctctattttgaccttgatgagatgtggagtgaagttaactagttcggaggtatggatggtttactacataattaattatgtattagctaaaaaacataaaaaatacattagtatgattttctaaagcaacttttctatagaaaatttttaaaaaacacgtgcgcgcaaaaaataaaggagtagaagttggtaactcggaaaaaagaacatagcctagggctagttcgtttcctcggtttggagggagatttccagagcacaccaaacaagaaatattattagcatatgattaattaagtactcatttcatcttattatatagaggattataccttttttaaaattaataaagtagcaaaaggacatgtgataggaaaaaaaatgatgggtgaaaaaagtactcatttcgtccctaaatataaggtattttggttggatgtgacacattctaaagcctatctagattcgttgtactaagataagtcacatccaaccaaaacatcttatatttagggacagagggagtagtacaaaaggtagatgagagaataaattattacaaaagtgaatagtgatggaataaaacagtacaaaagttggtaggttgagaatacaataccagcttaggatcccaagatctcttatattttacaaaaaaaaattgaaggaaaaaaccatctatgttatgggatggaggagtattaaatattttaaacatgaaaaataaatttatttgatttttaaataacttttatatacaatttttttccatgcataaatttaatattttgaaaagtgtactattataggacgagaaatttgaagtttagagttaaaagaaaataacaaattgttaattaaagtcaatataacaacatattgttattatattgtctaatattattataccctcttgcacgtatggatattttcatatagtaacttaggagttaataatgtcttatgatataaaatgaaatggaggtaataacttatcataattataaattgaagtgagtagcggataaatgctactgcccccaaaaccaattaattactcttcatagttcatgctttactagaaacagaaagtcagttttgtaaaatttgcaaatgtcaccctaggaaacacgagaatttaccatccacccccaccaatccatcgcccatccgctggctaagctacgcccactcgatcgccgctaaattagctaaaaagctacttaaagcaagctcacgagaggacgtgggcggcggcgcgcgcgtccatggcgacccggacgaacacgtcctccagcgtcgcgtccgccaccccccacgccaccaccggcgccgcccgccgcgccgcctccaccgcgcccagcacgccgtccagccgcgcccctcgccggggcacctcgaaccgctgcgtcccgcccacgccgtacaccttcgccgcgccggggcaccgccgcgccaccgcgcgttccaccgcctcctcgtgccccgccgccgtcgttatcgtcagcgcccgcacgccgccgtacctcgccttcagctgcaacatcaatcaatcaatcaatccatcaatcaatcaatcaatgcacttattactgaatagccggcaaaaaaaattcaaactttcagatgaattaattctgcatttgctttttttaactgagtttttgaggtgtttaaatttgattacctcctttggagttccgaggcactggaaattgccgtcgacgaagatgccgacgcggtcgcagagctcctcagcctcctccatggaatgtgctgaaatgttcagtgttcatgtatataaattcagttctagttgctaaattagtcacaaatattgcagtttgcatgtatagctggaaagaaaaaaattaaccaagaggaggagtaattaattactggtgagaatgatggtgcagttcttctttgctctcttaatgacattccagagattgctcctcgatgtcgtgtccaatccggtgctcggttcgtccatgtaaacaacctgttcaacatcaatggaatcaatgagagatagttacagcagaagttttttcagagatgtgagtggaagggaatgaagaacagttcatggtaaatttactacctttgggttgccaatcagtgcgatggcgacactaagccttcttttcatgccaccactgtacttgttcaccgatttgtcgccgaaaccgctgtggaacagatttacactcttcagggattcattcactgcctggatcaagaaaagtaaaatctgatgatcaaatactagaattgtttccaatgtcatgtgtagtactacaaatggagtgaacatttgcaattttacttgtaagaagtatagtaggagtatgagatttgaaactcgcagtttgactgtataaagctagtgctgtaattttacatgttctttccttttttcatggcttcaattaaactaccttcagtagagcagcacctgtgagattcttcagtcggccatagaacattagatgctctcttcctgtcagagtttcccaaagcaaactgcacacacattgaacaatttcttttttgttggcaatgatatcactaacaaaaccatcttcagaagaaatgcaaaagaactagccacttgagatcatactcgtgctgtggacatacaccaatgtttgcatatatttcattcatatctctcctcaaatccatcccatgtatgtaggcagttccataagttggcgccacaagtccaatcatctgcaaatataaattggtccaaaaggtgtatttgttaggttttttcatgttatttcactactaggaaaaatggataaatttaagtactacttgattcatgtgaaaaatgagagctactttgaagtgttgatgaagcagatataaatgctattttgacaaaacatcataagaagcacaagaatattgtgaaatattcaccatgttgatgaaggatgttttccctgccccattgggaccaagcattccaaaacactgtcctttgcgcaaagcaagcgacaatcctttaacagcaagcttatcagggtttccattctttccagggtacaccttcttcaggttatggcatatgatcatattcctcatgtccatttccttcagcaattttttcaccaccttgcgctgaaaagtagaattttgaacaacaatttatgacagtatccttgttgcatattatagttctgcattacttcattatacttctatcttggaaaacgccatctattaacttctatagacgtgtatttaatcacacctattgcagataaaaaaaaagaagcacgccaattcagatggattgagatcctctaccttcgaaatcaccatgcctttgtcccacatgtcagtgacaaagtcacatgactttgaaggtaggtgatcctgatcctattcggatgtatgcttaactaacctcaaggaaaacatcaggttttgccatatcagcaaacacctttctggacctctgtttcactttgtctggtatgattgttggtgaagagtgctttgttgacataaacccaaagaggaacagtggatgccatgtaggtctatgatccagtaaaaatgccacaggaagcagaagtatccattctatagacattagaagcaaaacatctttcatcccattgatggggtcattcaagtccctccattgcatcccaggctttcccatttgccttcctgcaaatgcatactctgcgagctcgtaaaatcctcggtagagggcgaacccgggaacaagctccattgtcacaagccattgttctaataaacaggtagaatggtagtttttaatgagtatccaataaatattcagaataattcctgggaaaaaaatttatatgggaacaattgcagaagtgcttatacttacttgggaatgtaatatcttcaatgaacaattgcagaagtgcttctccaagaaggcttgatccaaagacataaatgtaactaattactgtaacacagaaaatatttgattctgaggtcacttgaagagctatagaatgaacagaacagaaggtttgaattttactaaccactagcagacttgacagacgagaagaaagacgcaagcagaaaggcgagcacgatctgaaggttgatatatagaaaatagaatacaaattgtatgctgtagctatttaatctgaagatatctagccctgtaataccaaaaagagttctctcagtgatttcgaagattactcgaatgtgctaaattctcaatttccatactctgtagttaactagcacagtacctataagggacccaaacatcacgaagaacatcatataagctgctgaaagggacaaaaaataggcgtaagatatcatccaataaggtccatcctttagcccatgcatcttcatcatcagtcttaaattgtgctgcttctcataaacaagatatgtcaacattacctgaaaaaaccattgaaataaattggtaaataacttatgtatgaatccaagatagctttgataagagattgattgtgggacgcgataaagttaactcactggaaggaggagttgaactgtccatgtaaagaatagtgcatcaaggagtgtggtaaggtctagcctgattttcattgcagcttttggcatttctttcaaatattccaggcgcatttctacattaggtcctcgaagaaacttcagatatgcggtggatgcctgatgaaaatgcataacagtagtgataatactaagttatttaggacctataacagatgaactcatttttaggaaaggactctgaaaaaaaatggcacatatatccatctgggcaacaaaaacaacacaaatgacaagaaccatgaagtgttgttgtagaagatgtgctgtttttgctacagtagccttgttttgatggaacagtacaggagtgcaccatgccttttatgtagcacttccatttctagttcttaccatatattttttgaatgcgggtatccccattttccattaagcgaaatggtaaaaatcatgttttccggttcttactatataatgattgatatttctttagttcagataaatgccctttaatattcaatggagtattcctctacctaaaagtgaaactgtaccacaacaggcaagttaagtaccatattaaccaaccgtgcaacacgcaaaactgtcatgggatggtgtccattgtccctgctgaaggtagagttgtatgagacatacacatgaaacctcctcttgcttgtatcaagaaaatcatagcctgcaaaaatggaccttaaaataagttagttgttcaacccgccaaaaaaaaactgaactgctactttagtagcacagttgcaaggaaaactaaattaaagtaccagcaagatattcgttcgatgtcctcctcttattcccacccttataacccttatacaaatggtcattcatcaccgctgaattccggcaccacagtgataaaccttgaacgcacttcacatctattacaattaaaataaaaaggagtgcacaaatgcacaagtaattcagggttgaaaacatttcatgctagttgctacgacttcatacaagcaagaaacaaacaatcttttaccgagttgaattggcatcgcatcagaacttctagaagtattgtgcgaatcccatatacattttctttgaatcacatatagggtactattgggcacaaatcctggttctatgaacaatacatgcgctggtaatgtgcttgtaccctggaagaagaaatattcggtatcacctttccatcacaaatcagagttaaaaaagtatcgaatcttttgtgtaaaacgccactgatcactcaaaatttcaaatattcaactcacagggactatttttgataactcatcaatataagatgaattgttggaattgggcacaccaagatagtatgaaggagggacatctgggaaaaatccccttccaaggcctggcaaaaaaaaaaagttccattcacaacaacaaaagcaaaagcaaaagttgtagcaaaacacgtgtgatgtgtgtgcgtagtggtgtttgtaaggaaaatgatcctctggcttaactgcatgtgtaattgagccactgacatgtgagctatagtaaagtgagactcacatgttagtgacttaactgtcagaggatctgcttcctacgtgtgaaatttgacattatgccattgtcacaagtgggtttcgcccaaataccattctccaaaagggattcgataaaatgccattatcaactcatgcctactcgctagaatactatttgggaccaaattacccctccactcctcttcttcatccatccacagctccattccctctccatcaaggatagtggcagcggcccggcgagctatggccatcgcctcctcctcctcctccctctccaccggggatagcggcggtgccccggtggtctccggccatcgccacctccaccttctcctccctctccactagggataccggcggcgcctcggcgggcttcggccatcgccgcctcctccctctacaccggggacaatggcgccacctaggcaagctctggctatcgcggcagggagttgagtgcgacccctctcttctcgtcactacgcatgagcggctcgtgaaggatggcctacatcaagcattgcctcgaccaggttcgccatcgactccagtgtaggtcaccttgtcgtgcacaccgagtgccgatgacgtggcctctgctttcttgctaatggttagtgccctatctcgctgactttgggcctcaccgactctacctctccctctagttgttggcccaccggcatttggtcccatcgccgatctgctctcctctcctctctcttgtcatgtaaggggaaatgtttggactagctgagaggggggagaagagtggagggtaatttggtcccatataatattctagcgtgtaaccgtatattgatagtggcattttatcgaatctctttttgacagcggcatttgggtgaaacccacttatgacaatggcataatgtcagattattcgtgtatgggtgcgtctttcatacaataaagaaaaaacaaatttaaaaaatcgaaagaaaaaatgcagaggagctacatgaacaacataaaaatatactacatttgctggtttgcatgcaccttcagtcagccggcggttctggccggtggtgagcacggcgaccgggcacggcgcctccgacgcgccgctgccaccgtcgccgcgacacctcgccgggtgcacgggcgtcagcgcgcggtacggctcgtccggcacctgcgtcaccgccggccacctcggtggcgccggcacggcgcagctgagcgcctgcgtggccgtggagtgctgcacgccgcactccgtcgccgcgcacgcgcccgcgcccgcgcggccgccgtcgcggcgcacgcaggcgcagccgcaccggaacggcggccggtccagctcgccgtcgatgacggcctggatcgtgacgagcagcacgcacagcagcgccgggaacgccgcgatcgccgcgttcgccttggcgttcctcctctgccatcccaagaacacgaaaaaaattcagcaagctcttgataacatattaacatctcaagaaccaaacattatcttcatccaagaacaagtttgaaatcgatttcaagaaccggattcgtggatggatgaaacagcatttgcatcaccatcacctacctggaaagagaggttcttgaggaggagcgcgtggacctgcctgaagaacctggagcaagaacctgccgccgccattggagcaagcttctccgagctctgacagatcaaactcgacgcaacaacaacgatcgatcgatcagcaagctcgcatatatagcaaattagcaacggtttgcagatttgcagtgttgactcaactcaaaccgaccagctgatcaccacggcgcggcgccgtgagaatcacgcgtcggttgccgccggggcatcaggcgccggacagggagagatcagcggaggattgcagatgaagcttcactccttccatggcagcaggcaggagcactctgatctcactccaagaaaagctgcgtcatcgtcccttaactatggcgggtgttacgcttgcattttaattgtttaactcaagcttcgcagtaactgaagttttgcttcatcagttacatgaggagagcagagagattgacaatggcatggctgcattgggatttgatccatgtgtctagcaaggagtgacatatatatgtatattaaatatatactatatagttaattagtgactggtcctaaattcttcagagtttagagcattgtcacagtgcagaagtcccttctatgaattcagtttactagccacctttcttgttttggagttcagtttgggacttgggagttatctgaactcatggtagctagtagctgagacatcaagaagagagggacagggattgatggaataagacaagccttgtgttcatcgcttctaaaacggtactaccaaatggactaaatcttgtggttgcagtaacttcccatgactcatctttcaaggaatttagattatcatcagttcatgcttccatttttttttatccccttgttattctattttccctctgatgctctgttacgcaagagttttcgttggtacgaagactgatgctctccatctccacattgatctcattggaagaaagaaagaatggtattaaatgatattagcagagataggtttaggttcttgagtactactcaccttgggttcgtcagtaatgtgatagcttcatgtgaacgaaaggtatcaccgtatcagtactgtagagtgataaaatcatccttggtgccggcaaattcaaagatggatcaaaggaaagcacagttaccaacataagcaaattgacagtatcttagtttagaagttagagcaacctcccttcgattccagcaaattgacttttgtttacagcatgacatactaagcaaaacagttgacagatgtctgaggactcttatatctcctccgtttcaaattacttgacgttctagatttgtcctaggtcaaacatcaatttctctaaacttatatagtttaacatcataagatttatattttaatatatccatcacaagaaataatttcatgatatataattcgcatattgttaaactatatagatttatagaaattaatgctcaaaaatagaaatatttgatttaggacaaatctaaaatgacaattaatttgaaacgaagggaatatatatatgagagtgatatgacttgtacttgttccatgtgaatatagattttagatcttacagccaaaaatctaatgatgcattctaagataatatatgttgtgtgacttctgtaagtcctggactattagaaattcaaagagagcagatgactgtagatgctttcctccaaggactcttaaaaacaaaatcttcaggttcttattttttaacaccaagataattatttgactaatgacaatagtttattcttgtggttggaaccagcgcactaaacaaaaacacttcatgtggtagctgcacaagattacagcatctgaaatccccaatcaaataaattattcagatagatcagtacccaatgctattttgcttgcaatttcagttacggccaccctataattactggtcaaaattcaaaagattgacaaaataacaagaccttattcagaggcacaacatctcagtatgagaagaggtttgaatccattatctatcctattccaaataaaataatactctagtttttttttaaaaaaaaattccgatgctcccacaatgaaatgatcattggtaactatagcagtataaaatcagaataagtggtctctttagttctcagaagctattaatgtattgttcaggatgtcattgaaggataatgaatcaaagaaagatacaagtagggactaggtaatgtgctttcttaacattgttttcaacattttactaaataaaataaaatcgcatatagctttctgtttgcgggaaaaaaacccgatatagttttaaatatgcacattctgctcagctggttttagtcaaaatcaactaccactaaggccatgttcggttaatccccaagagggagggattggaggggatttattgcacacctattgtgatgtggaattattccccctcaaatccctcaaatccccttcaaccccctctaaacccaaaaaggcctaattggtgttatacattacaatatgaattccatggttgctaaatatacaactttaccatactacatgaacaactcaatcacaatgccaagtaaaggttagcatatagttcaaacaaactatatacaacacatgatcctatgaaggaaaaaaaataaccacctatcgatccataatattatttacgcgatcacattgactccttgtgctcctttggcaaccttgatgaagacatcctccaaggtggtgtcgacgaggccccaagcgtgtatgctgaactgtctttttgccttctcaactgcatggaaaacgtctgctatcttcacctcctgttttggcagctcaaatttctgcgtccctgatatgtgatatatcctgtttgcacttggtgacaaatgctgaaccagctgtttgacctcctgttcatgttctgaagatgttgtcatagtgaacacatatgtgccaccatatctagctttcagctgccaaaacagaatgcaatccaaatattcagatattaacaaatgtttataataggcatgttacattaagtgtatttatttgtttttgcaggtaactatgtaaattacctcctttggattcccaaggcattgaaaaccaccatctacaaaaataccgagtctatcacatagcacctctgcctcttccattgaatgtgctgaaaaaaaacatactggattatccactattattgttcatataggcaatttaaagaaggtcaggaaagctcattacttgtaagaatgatagcacgatttttctttgcctccttcacaacattccacaagttatttcttgatgctggatctagtccagtgctaggctcatccatgaaaacaacctaaaagaactttttcagttgcacattccattgcattatgtgcagttgaaaatcaacacacataaatcatattagtaccttggggtccccaatcaatgagattgcgacactaagccttcgtttcatgccaccactgtacttccccacttgcttatttccaacaccaccgtgaaacaggttaacattcttcagggagtcatcaactgcctgatagtatgctatttgtcagttcaaatattgatatattcatgtgtaatattggaattgttaccacaagacaaaattaacacaccaatttacagtgaaggaaaataaagagatgagtgtgaagataactataccttctctaattcagcgcctttaagattctttaatctcccataaaacaatagatgctcttttccagtcaatgtttcccaaagtaggctgtattttaagcagcattagcaaccacaatatattttgcaatggattaccataaaaatggtactaaataaattagttttagagcaagaatcatactcgtgttgtgggcatacacccatatttgtgtagatgctatccatatcagtgtttatgtccatcccatggactaatgctgtgccagatgtgggtggaatgagcccaatcatctatggaggaaaaaacatggaaagtatatgccaagtaaggatcgtgcaacattgtctattttttttgtcagaattgaagagctacttgttgccactgtaccatgctgataaatgatgttttcccagctccattcgggccaagcataccaaaacattggcctttagggagggcaagagacaaccctcgaactgcaagtttgtccgggtttccatcctttccatggtaaaccttcttcaggttgtcgcatatgattgcttggcttgcatttggttccagcagaagttgctcgactacctctctctggatacaatttagcaaaatcaggaatgaaacatttatgcaatttgagaatatgcaacaacacgatttcaacatatatacaaaatcaggattaacttacttcttgggaaacatcagggttgtccatttcaacaactactttagacccttgtctcccaaagctcctccgcagtgatacagcacgatttttgaaacgtttcaagaagaacatgggtgttttacgggctccactacccaatgatgagattttatccaaataaaatgctaatgggagtagaatagcccattcgacaaccatgataatcaagacattgcgcattccattctcagagtccctcagattagtccactccataccatttgttcccattgcatttccagagaatgcatattgaccaagctcatataaccctcggtacagcgaaaatccagggatgatttccatgactactatccaaccctctttgaatggagaaaacaatgctcgtcatgcataagatataaaaaacaatagctaaaataaatagaaaagaaacctactcggaaaactagtagactccacaaaaaacctcagaagaaatgcccctagtaagccagaaccaaatacatatatataaccaaccactgcagcacagaaatttctcaaattagtcatccacgagtcttctttggaagttgagcatttgaatcacaaacctgtggctgtttttacagaagaaaagaaggccgcaacgaaaaatgcaagtgcgatctgaagatttatgtagatgaagtagaaaacaaactgaatgccgtagttatttgttttaaagaaatttaaacctgtaaggaagaaagttaattttgtaagcatgataaatttatttgcaaaaatacaatggattgaagaaatttccagttgattacctatcaaggatccaaataccacaaacactatcatatagacagctgatagagcaaagaagtaagaatatgatatcatccagtaaggctcatccttcaagccgtgcatcttcatcataattttcagcttctgttgcttctcgtacacgagatatgttaagataacctgggaacaaaatgaagtaccaactaatttgatgtcctctgcaacttatgtaagagttaagaaaggttgcatctcatactcactggaaaaagtagttcaatgatccaggtgaagaacagagcaccaagaagagaagagagatcaaattttggtttggttcctacttttggcatatctttaacgtattcaagcagcatctccactccacttcctttaagaaatttcatgtatgcattggatgcctataggaaagatggaatgagttgtattagtagttgtagtgcatatgaaaattgttagacttgaggtagtggaagttcagtgtacgtaccgtgttaaccaagcgtggaactcgtagcaatgagatgacgtcatatgcagtgttgttgttatatgtagagttgtaccaaatgtttatttcaagaccattgttgtttgtgttcagaaaatcatagcctttggaaaaaaagcaaacttagacataaggtaaggaaccattacatcaatagtggcagacacttttctctgaggggatcagaagatgaaatcacctgcaataaattcatttgtctttcctcctccacctcctccaccttgctgtctataacctctaaatagttcattattaatttgtgatgcactttcacgccataatgataagccttgaacgcagtctatatctggacattgcgaaatgcatatcagatttggacattttcacaggtgtaggaaacatatatgaaagattgaagggacattgacagactttagtcttactgttgaagtataacactggaattcaacatcaacagaacattgctaatcaaacatatttaaatctagatttttatagtcaaatgatgttatagaactttatgccaatatggctttggtgtcttatttaataatgcctcccccagtcccaaatacatgttgtcttgaacatatacacagtttctaaaatgcatctttgaccgctgatttctgttgcaatatatttataaaacgcgatagacctataatattacaaaagagcatttcaaaacgacttgtatttcttactggagggtataactgacaaataacgcggtacgactactactctttttaccaggcattaagtctgactattgataatgacgaggaatactgtgcaattccaggtccgagaatataactgtgaccagtgctgaggtagtaattccaaatggcaatgatttttttataatattatcataattacctacttattcggtataccatatgcctttacttcctagtacatattaaattaaataagttaggcctagcaagttaccctgttttcgctacctgcttccttcaaacaaagatgcagctgaacgaaaaactgtgaaaagaaaagcaacttactgagttgaatgggtacaggtccagctttgttagaaattgttcgtgataaattggacgaacactgaggctggaccacatataaagaatgccctggggtaaataccggctctatgaactgcgttgtccatgtccatgtgtctgacccctaagacaaataaatccaatcaagagctccacacattagagaacatggcaaccatgactaatgactgtacaagcaattctgccattaggcacgaataaactcacagcaacaatcttggagaacgcgtcaagataatccgtgaaattcagagagggaggcacagcagggaacaatccaccccaaagacctgccaacagtaaagcatcaatgaattaatgaacacttttgatccaaagattgaacaacaaatcagatgtttttttccccttctagtatgtcttcgaactaagaacatactttgagcaagcgagcggttcattccggtgacaaggacagaggcagggcaagaccctgtgtccctgcaggtcgggtcaggcaaaccgtcgaacggctgggaggcgatcctgacggcccgggactcggggcgggggacctggaccaaggccggccatggcgtcgggctcttgatcgggcagctccccacctggtccagcgtggagtgctcgacgccgcactccgtcctccggcaggtcccgtccggcgcggcgtccacgcaggcgcagccgcactggtacttgggcttgttgatctcgtggttgatcaccccctggagcaccacgaggatcacgcacaggaacaccgggaacaccgtgatgcacgcgttcgtcttcatgttcctcctctgcatcaaagcaagaaatcgcaagcaagcaagaaacggtgaggaaatcgaaccaaaacctgcgaaatcggggagacgcgccaagaaagaaagagggaggaggggacctggaagcagaggttcttgcggaggagggcattggcctgcgtggcgaatccggcggcgcccctcgacgacgacgaggaggaggtgtctgccatcgtcggaggcgaaggaggtggggggagaagctacgctgcaccggcgatcgccttcgtctccgggctttatagccgccattttcaaatggctcccgccaaatctgcgtcgtcacgccgccaccgtaaagggaagaagggggggggggtggtggtcgctctccgcgagggaccgtattgtaataaagagaagttgggagggggttggatgcaaaatctgttagccgttagggtcactgtcctccgtcagggaggccgttagcccacggttcagtacacactgcctcctgaaatctgaataccgttagcatgtttggtaataagaaaaaggttaagagatcactaggatgagtgccaactgccaatgtactgctaaggacgaattgatcaagagttgctatttggtgaaatctaaacatgtttgataagaaaatacttttggcatttcccgcttgtgttaagtgttagaaacatgcgtaactggcctttttgtcgaaactaattattggagcatttgtcgagactttgggtgtcggtccgttgttattacgcaccctaggtttgacgagcattatgtaaaaataataaatttactattggcattcactaatcactaggcttggattcgaggcgaagaaagaacaaaatctgcgttgaagaacaacaagatcgaagaggagaaattaattgcaacgtgcatctaaaccatgttatcgtgaagagagaatctttgacaaatcaaatgaaatatccaaaaaccaagtcaaagtcaaacatgtagagcgagaggggaggatttcgtacaaggggcttgtacttgtacctcacaaagtgacaatggacttcaagtgtgtggtataggttgaatttgtttaaacaactctgttatttaagttggaaaaacgataccctgcggcatgatgggattccatatacgtggattgcaaaaggtccactcgtattgtataatctgtggaagggtaggacttgttaattactccatccgtattttaatgtatgacgccattgactttttaacaaacgtttgacctttcgtcttattcaaaaaaatttatgtaattatcatttattttattgtgatttaatttatcatcaaatgttctttaagcatgacaagcatttttgtatttacataaaaaaaaattgaataagacgaatggtcaaacattggttaaaaagtcaacagcgtcatatattaaaatacagagggagtacttgcttaacatttccttgggcaccaagagatttagtattaaatttattgtgctattgatcatatgtggttgctaagatgatgtgggattagcagacaaattaaattacacttagaataatatccaaacaaaaatatatctaccgtaaacctcgcaatacttcctcgaagacctaaagaaagtgattttatacttacatattctagtgtaatttttttatctcacctagcgtaaatgtgatacaagcttagttccaaattttatgctggaaatgtaaaataactgtagaatttcacctaaaaaaactcttgaatttaacgtggtgcaacatcactttctacttaggtatagccaaatttggcatgtattagtaattatatttttttactaattgtgctgtctattgtattttgtgcttaattattgcacaccagaatctctaggagtggacagctgattgttttacaattagaggggaaaattatagatagaatgtcaaaagcgatgagcttaatttgagaaaattccaagaaacaagtagcttttcacgcaaaaaaaaaaaacagaagaaacaagtagctcttggcgttgattagtaatcaagcagggtatatagccccaaagcaaaagaagaagtaggagtatattacacataagaaaaacaaaaagtccatttatagtcaccatcacacacttggtcacaaatcacaaaacttgcatctgattgttcagatcaagtacaattcaagcacgaagacatgtcaaaactaaactattatatcacgcgctgaagaattttcatgttgaacttgtttcgctaccgttagtaactattcaattcaaaatttcaaatatggcataaaagggttcttttgatcacatggtgtgccctcgcatatatatgccaaaactatcatgagaccacatccagtttattgtaattattaatcgatttcagaaacttcacttgagttctcatagctagttgtaaatatcgccgttggtggtcaaaagataagaccattagtatattatgaaaacgaacgttgataacagcaaaattgtcaacatatgtggcactacgagcgagctagcatgcacatgtaatctatcaccatcacacacatgcaattcaaacttggattatttgtgatcccaattattttgtacatttacaagtcacacgtattggataatctgtggttgaagagatacgagtttgtccccgtgcagatcatgatgtaaaatcagcagcaaaggtacataagcattctatatatattcttataataataataatgaaaattttcctcacaaaaatggaatttactatgtacatttttgccctgtttagacccaaccccaaaatttttcaccctgtcacatcgaccgtttaaacacctgcatgaagtattaaatataggctaaaaaataactaattgcatagattgtgactaatttgtgagatgaattttttaagcctaattgctccatgatttgacaatgtggtgctacagtaaaaatttactaatgacggattaattaggcttaataaattcgtctcgcggtttactgatggattctgtaattagttttatacccgatgtgacatgccaaaactttacacccctagatctagacactccctttgggtgcctattcctaatatttgacatacagatatgctagaaatttaacactaaaaatgacgtaacttaataccttcttatagtcctaagaaaactattaattggtactaacatgccacattatctaaactttgggcgccatatttggcatatattagtaattaaatttttaattactaaatttcctactatattgtgcttactgcacatcagcagctctaggagtggacagatcagcatattgcaattgggaaaaacatttcatttttgttatgaatgttccatatgatctttaaatagataactatcaaattaagttacaggctaactattatttgagaaaacacagagcaaccagtagctcctcgtgtagattggtattcaagaagagccaaacaaagtcctcaagaaaaaaaggagaagaagagccaaacataatatattatacagcagagaaacagaagtccaaatagtcatcatcaaacacatggtcacaactcacaaaaacttgcatctgattgttcagatcaagttgaattcaagcatttagacatgtcaaaactatcatatcatgctgcagaatttccatgttggatttgttctttaccgcgtgtaataaaacaacacaaagtttcaaatatagcataacggttcttttcacatggtcgtgccatcacacacacacacacacacacacacacacacacacacacacacacacacatatatatatatatatatatatatatatatattcctaatttgagtgactatcatgagatcacgtcgagcttgttgtgattattaatcagttttaggaaccttcctatgagttctcctagttgtggatatcactgtaggtggttagaagataagagttgaaaacaaacgttgacaacagcaaacttgtcaacatatgtaatactagctactggctagctatcatgcacatgtaatccgtcaccatcacacattgcaattcaaacttagattatttatggtccaagttattgtgtagatttatataagatctcatgtcatggtaacatgtcatgttgcggaatgttggtattgttaaggctagtaattgtttcttaccaagcattgaaaaatactaaactatagtcaaataataggagtatcaagagctctttgtagatgatgtatctgtacctcccaaaaattatatccatgtgaggctcacttgtctgaactcaattatcgaagcactgaatttggtggaagtttcgttatttttggagcatatataacttaacctacgcgtactttgttcagtttaattatgctctcagacatgaactgttggccaaatgccaatggtattagacattggggagtctatttggattttgtttaacaaaaggttaaactaaaggcccataacctgggactgccaattggattggaaagtctaggtatctgctggtttaacttaagctcatgggatataattatcagatgaagctatacacgcataattaggtgtcatctttaaatttatataaggctcaacttgtgttataacccacgtatatataatttatctatactatataaagaagctaatcctgtgctattaaaagaagccaatgatgattgttagtgattttgcccccattagcatatctttaattggtctatatttttctgccaaacaaatagatcatttgtgaatatttataaatttcatacatagaggacaaacagtcaaagtttataaatgaatttagtccccgtgcttaattatttaaaaatacgaagtactccctccgtttcatattataagtcgtttgatcaaagtttttgagatttgacagtttataagaaaataacaacatttacaagactaaatcagtttagttaaatttaatattgaatatattttgataatatgtttattttctattgaaaatattagtgtaagtttgattaagaaaagagtcaaacaatttataatataaaacggagagagtaatatatacttaagattatttgatgagaaagatattaaaaaaggctaggatattgtctatgtgataattttttaaaaatatagttaacatgggatgtaatatttttttttattatgtttgaagacctaatttagatagatcctactcaagccacagataagagagaagctcatatgtatgtatgtacaaatataataaccttttaatttttaatttgaggattttatgggaaaggactaatatagtttgttttcaagcatacgaagtatgcatgtttttctcagcgaatatctctcgtacgtatgttttccgccttttttttacgaataattatacgtatttatccttctcttatatgtacaggaatcgggttttccatgaccgcatcccttctaatcgtacagcatggaactgatctccatgctgggaatagcatcgatggagttagtttgcatacttacttggcttaaagtatgtttacgataaagttggtttgcacgaggcatactaagaacatttgtagagtattcaatggacttttacggtatatataatacttcttctgtctcgtaatatagttacctataggatcggataagaccctacgatacaatgaatctagtcgtaggttcttacatacgaggatggagagagtatataagatgcagaagggtagtacagtcatattttccaatagaccctttgttcatctgataccttcactatgatcagtactagtaggaaattaattaaatgcaagttgatcttcttcttaattaagaagaaagttgtcgggcatgcagcaaccaatgcaagctaggaaataaagtaaaaatgcataaatataatgcagtttatagtaaggatccatggtcgatctccatacaacttctttaaaccaaagcatgacgacgttcatttaaccaccaataggcactagctagcttaacttcatctccaagcatccaatttccaaaacaaaccaaaaagaaaaggatatgatccaagggccaaataaaagtacagttaaatttgaccgtgcgacttgttcaaactaattaactagtaataattaattagtgcaactcttgcatggcagttctgtcacactatttatcttgcaattaatattgtgagacacatgaactgatcagggcattcccttgcatcaggtcaatggcatcacttaaaatttgataaccagatgcaacctgctgcgattgttaattgactgactcacatggcagacaataaaccgtgagcagatacgccgtctgtttttggtgtaggcagcctcaatctttccgaacattcgttttggatccttgaggactagatgaaagattccattaaatccacttgaaattgaataaattagcgctactacaaaattaatttttctggacgagaccctccttatatagatcataaatactatatagtctgcaaaaatcatttccccgtgttaggtttatgagccgaacacgaaaattcattttcgcagacgggcccattaacagtattttagtatatgggcctgttaagtgacccgcatgcgaaaatagcgcgcatctctcccactcccatctctcccaactcttttttcttttctccccacttatctttttccggcatatatattctccccttcccactcctcccactccctctccccctctacccactcccagcgatggcggcggcatcggctagggcggcggtcgcagtgacatcggcgagggtggtgtcaactagggtggcggcgacggtctcctggcaaccatggggatggcggatccgtcgccggccactgcggggagggcggatccatcgcccgccaccgcggggagggtggatccgtcacttgccaccacggggagggcggatccgtggctagccactgcagggatgacagcggcgggcctcgggtaggcgacgacgatgactgcagttgcggcggtggtctcccagcaacggcagcgccgagagcagcgtcggatccgtcgccaccgggtctcgggcagctagatccatcgctagtgaccgcggggacaacagcagcgggcctcgggcaggacgacggtagcgggtcttgggcaagacggtggcggttggattagggttcgagggctagggctttgatttttgttttattttgttgcaattttatatttttgtgtacggatgacttaagcgcccgcacatccaccgcacgaaaaaatcggatatttgcagactttttgttgcagacgaatgggtgatccgcacacaaaaatgctgttttggccgtctggaaaaacctttttttactagtgtggtttaggtaaatttataatattcgtgtccccaaatacctcctctgttcacaaatatatgtattctgaatgtttaaaatttgttcataaatataacagagtactacttattatggatagttagattttagttatgtagaggtcataactctacagatattaaattttcactcagctggaaacatctgtttcttttccgttgtttttttaagaaaaaaactgcacaccttctttcaaagaaaaaaaaagattgcacactgtttgattggatcttgtttgcctaacggtgatctctcatgcaagttgcgctctgtggtggtggtgtttgaatcttctaaagatgaagatgaagatatagattaagtgtttcacgcaaaacaatatggtaataacatgtgattaattgagttctaattattataaacttgaaaaatggattaatctgatattttagaggaactttcatataaaattttttcgtacgaaacgcaccgtatgtgtgatgtgtcatatgtgtgcagcacacatcgttccaatcagtcaaagaatttgtgtagcattaagatctgtggcttgatgcgtcgatcacaattattatttttaacttgtggcatttaatttgtatttagattgcctaaacttttggttgatcacaatatatagtgaattgtgatcgatctgatttctttggagcctaaactttgcatgcttgtcgccaagaaacttccttcgagaaatgaacatgtatcttattattgtttggatgtacgtagatcaacatttgcttcagataatggcaaccagtaattaattggccttggtaggatgtgatctagcttgcttctgatcgacctaagtacagctgacattaattttttttccttcgttttgaggtttgactcgatgtgaaaatattataatactccctccgtttcacaatgtaagtcactctgatatttcccatattaatattgatgttaatgaatctagatagatatatatctctagattcattcacatcaatatgaatataaaaaatgttagaatgacttacattatgaaacggaggaagtagatagttgtaacaagaaaaaaaaatagtatatgcgaataggattgttgtgtacagtataggcttaaacaaaacaagaacataattaagtgggggaaaatgttcaaatactaaaaataacagcgagaaaaaacagaggccagttggatatttcccctttaatttccacgttctcaactgttggccaatgcaatattccgtttcctattttttctttcaacataaaccaaagcaagacgaataaaggaaaagaaaaatgaagcgacgccacctttcatcaagttttaaaaatctacttgaaaaaagattagattttggactaaaagatatcttactagcaaatttgattttcaaacttcttgctagtaaataatcctactttactagcagatcctttcgagtttcaacaatattttacccttaggctcgctcgcggaaataccaacaaactcactaagggacaatgacgcatttctcttatggccagtcaaggatttgacctagaaaattcaagtcatgtgagcctctccttccatatctatcagaaaactctgcttgaagaatattatagccagatcctacttactgatcttccctggataattcaattcaaagcaaaagcgtgtttttgcttgcatatgcaatgcacatgtaatataatatcgatcttcttccatgagcttagcgtatcatgcagctgacttctatcttaactacgaccgttgaaattattgtttgtagcgcccatcattaccataaaacactacttaagggcacccgtaatagttatctataagctctctacaagagatccatatcagcatatttttctacttagaagagattaaatgaagagagagagcaaaactatctattaacctggagatagtctatagagaaaaacgaggcaatgcattagagaactatagatacctatgtagacataccattgaagtggtttactattaatctagtctattgctgagatgtacatattttgtagataacatattactttaccattgcgggtgctctaaggtgagtttatcagctcctgtgttgttaattaggtcaacacactttagtgcccaagaaattcccacgaagttaagcagcgagcagcagtagacgcgtcaaattcttcacctccaagcatcctagtaagtcgtttatcgttccacacaataatgtatcattttttttccgggaaatgcagtaatgtaattcaaacatatgtaactaatattttttaaataatttatgaagtagttagaaaaagaaaataacgtacgtgcgctgtgttatttttttaaaagaaaatactcttgccatatgaaaataattgttattttaggtattaaatgtgtctcaataagaatgatattctagagtagtccttgttctccaatcacctatcattcatttttttcccatcttatcctaatcattatttcacttccaactatccctggtgtaatagagagcatatatctaggtcatactccttaattttgactgtcaaaaggaacatttattttaggaggagaaacattttcgttacaccaccaatatatagagctaccatccatgggatgaagtagtgcctctttgcaattaccaaaatctatgtttgttttaaagaagtatagatttcatagcttgggaataaatagtctacatgcttcatttagtggcacccatatgtctggtgatagtaggagtagatggtgacaccaatttcaagtctccacgtgtcagttggtgggtggtaacggattcatcactcatcaccatcattagagttttttaaaagagttgaatagttggtatcaatataattataattaattattataaaacttgttccatgtaagcctaggggagggtatttaactttttctttttacaaaatagctttctatctaagcttaaaactcaaaagatacattttattttttattaataacatagtttaaaaattaaatacccaccgtgaaaatcatgcgccgggctctacccttcacatggtttcacgttatcaaccaatcagagccctcggattaaatatcactagttacaggggataaccgaaagaagaggacatgatcgaagactaatgcaaagtagtcctactactccctccgtcccatagtttttgagttttttttacaacgtttgaccactcgtcttattcaaaaatttttaaaattattatttatttttttacttactttattatctttattatctatggtaccttaagtataacttttcgttttttatatttgcaaaaaaaaattaaataagacgagtggtccaacgttataatcaaaaactcaaaattctcttatattgtggacggagggagtatacacaggtcaaacctgcatgaatccctaggctgtagtacggttctctaaccagcaggatggacggcctcggaaactcacaaatacgtacgtcgacggcaacacgttttttacagaaacagaactcgttcaatctacacttacacacccacaatttttacaataatacttctcgatcgagtcctggtttatggacctttctgtgtttctttagaatccagagggcgtaggtaaaaaaaaagcttaactgttctctggctcacgcagtcccacagcttattagccgcctaaaagttgttaactatacagtaatttttgttaatttgcagatgatctcttctaaatttattatcatgaccgttcaattttatcatacggctgctttcacttcacatattgaggatatagtttcagaaaacaatcaaacgattaacattgacgtttgccgtccgtttgttggcttagatgtaggtaaggtcgtaaggatacttccttgctattccttctgagcaaagaaacgtgtatatatttgggagctttgaaatgcaaatattatttttttaaaaaaacaattagtatggaaattgtatgtctagatttgtgctgaaaagttgcttttattataggacgagactaccgatcaggtgccgcacccgatccaggcgtgcaaaaatcaggtgctgtcactagtggagaaaccatctttcgtcggtcggccgatttccacagtagtcacggatgcaataaaaaccggggctaaagatgatctttagtcccggttcaaaagggtaacgggcatatttgatctttagccccggttcgaatgctgtcagggcatgtcaggccccccggaatctttagttcccaaccgggactaaagtcccacccctatatatatatatgtcttcttcctcctctagctgcccgagcaagcttcaaaatttcttcaaaaaagaggggaggtcatgccaaaatttctattgaatttattttggtgattacatacaaatcggaggtgtctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccagcggtccaaagagtttattgacggcgtgcactattttttgagagtggccgaagctaacaggcaaaggggttttatttgttgtccatgcaataattgtaagaatcagaaggagtattctgcatccaggactattcatttccacttgtttgagtcagggttcatgccaagctataattgttggacatcccatggagagcaaggtgttgaaatggaagaagatgaagtggaagacgacaatattccggactttgctcagtatgttggatttgaagaaaatcaaatgggcgaggaggaaatagctgctgatggtaacgacattgcggatgatcttggtcagatgttgcaggacgccagggaggactgcgaaagtgaaaaggaggcccataaattggacaagatgttggaggaccacagaagttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagtttataagatttacgcatgtccgaacgattatatcctatatcgcggtgaggagtatgataacctagaagcatgccctatttgcaaagcactacgatacaagattagacgagacgatccaagagaagttgacgggcagctaacaaagtagagaattcctgctaaggtgatgtggtatttccctataataccacgactaaggcgtttgttcaggaacaaggggaatgctagaatgttgcgatggcacgctgaagagtgtcaacaggacaggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctctccccctggctatgcatgaagaggaagtacataatgatgccgattattattcaaggccccaagcaacctggtaacgacatcgatgtgtacctaagaccactggtcgaagatcttaaatagttgtggaagaaggaaggtgtccccgtgtgggacgaggacaaacatgaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttatattccttgcgattccttgcaacaaaccacccggtacggaagaaaggcaagcacttcgaacataaggccgatcaccgtacgaagcctaaacatcgcagcgggaaaacagtgtttgctatggttaaagatcttaaagtagtgttcggaaaggggcctggaagccagcctatagagagcgaagatggtcacgtggcgatgtggaaaaagaactctatattttgggagttaccatattgggaattcttggacgtacgccacgcaatcgacgtgacgcacctcactaagaacctttgcgtaaactttcttggcttcctaggtgtatacggaaagtcgaaagatacactggaagcacgtaatgatctgaagcatatggaacaacgcggcgaccttcacctggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgacgacacaactgctaccagttgtaataaggggtatccttccagacaatgtccgggcaacaataacaaagctatgtgcattcatgaacgcaatttcgtagaaggtcatcgatccggatagattagaagcccttcagaatgatgtggtgcaatgtctcgtcagttttgagttgatatttccaccttcatttttcaatataatgacgcatctgctttgtcaccttgtgaaagacatccgtattctcgggcctgtgtacctgcacaacatgtttcctttcgagaggtacatgggcgttctgaagaagtatgttcgtaactgtgttcatccagaggcaagcatcgccaagggttatggaacagaggaggtcatcgaattttgcgtagaatttatcgaagatcttcgcccaatcggggtacctgaatcacgcaatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttcctggcgaggggaccgtctgggtcgatcgcaacattctagggatatgagatcaatgggtacacattctacacgagagcccaagacatgaagagcacgaaccaaaacagcgctgttcgtgtcgatgccatgggatacgatggaacaactgccacgtattacggtgccatcgaggatatatgggaacttgactatggtcctctcaaggttcctctgttccggtgccaatgggttaggttgactggtgtcacgcccagaaattcatgaaccagaatttctaagctgaatgtgtattaaacccctgtccaggaccagccagggtacacaaacgataattgttgacatacagatctacgtcttacaaaaatatgaaagattacaaatgcagcggaaaaagataaaagcgagctgagcctgaagacttgactcctgcagcgagcgattccattccacaggcaacccttgacggcagcgatgaaaccaacctcttcaagacatctccaactgagaagaacttcaactctggtgtgggggaaaagagcaagactgagtactacccactgtactcagcaagtcataccggaagaggaggtatgatgcaggatataaccaacggaggctaggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacactagttcattaagctaaactaggggtgagactaatcacggtgaatctggtcgaccgcccataaccgcgggcacgactattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggtagcccccctttcgtgccgcggtgaatccggaagccgatcaaccggacaccccggccgacccaactccatcacgcccaccctcgcctgggtacgttggctagagaaaagctacactacaaacccagccgttgcccacactggcttgtggtaagtacgataagttcttccagggcatcccgcgaaccggtccttaatcgccatgggcacgactagcaaaaccatgcacccacagcccaccatgtagtgtattttaattaaccaacaccattgcggtggcactaatccaaagctattgccaataatcaaagtctatgctttagtgtgatccccttttgtgcactagttgaactaagcatggctaagcatctcctaaaccagcatctagtcattttaatacccaagttatcaatggcgtaagggaaacaacatatagctgagtaataggacccatcccacatgatattgtaaaacaatgcaatatttaatagaaatacgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaatgcacacaagcaaaacatgctataagactactgaaacaggaaacaaaaccatttttaatggattctatacatttttatgaatttactgagacttgaatggtcttaatcggagctcggatgaattagttatgatttttagaagattatctgtgtttttactaataaagaaaaagccttaatgtatttattgcgcaatattgccccagggctgacgtcagcaaggggggaggcgccggcatgcgggccccatgagtcagcggctcaagagagagagagggaggggcgccggcacatgggccccactggcagtggcacaaggcgggaggggcgcggctggtggctcggctcggcttcaaagccggcaggccaagcatggcaagcgacggcggcacgcgcggtcgccggcgacggcaaccggcggcgcggacggcgatggcagacggcgcgaaaagcggcggcggcggccgaagacgacggtgcgcgcgcggaggacggcggtgcacacgggagagagggaaagagggaggagggggagtttctcaccgaggttggccggcgcgagtggagacgacgatgaacgacgacgacgagcgacgggaggacgatggcgatgggcggacgatctccgggacctcctagggaacaaaatgggaaggattagagggagatgggtggtctacggcgggcagaaaccatggccgaaggcggtggcaatggtggtactcaccggcgcgcggggagaagcgggccccgacggtggatttggccgggcggatggcggacgcgacggctcacgggatggtgaacgcggcggcgtcgacggtgagactcggcgcggtggctagcgacggctagcagcggccggagcgcggcaggagggcggcggtgatgggtgtagcggtgcgggagtgatggagggcacgggagagagcggcggaacgaggaaaaaggtggaggggagtgcggggaagctttattggggctcgtgagagatggacgtggccggggtgctcccgatttcgccggtgacgtgggaggtggagagagagtgggaggggattcaaaatttgaatccaccccttgtgggctcgtggcgcgggcgggaaggcgtgggcggcgtcgcggcgacgtgggcgcggggcgcggagtgggcgcgggagcagcgggatacgcggcggcatgggcggtggtttcggcggcggttggcgcgggcgtgggcggccggaggttagggaaagggctgacaggtgggccccacctgtcagcgcccgagagggagagggaggccgggtgaacttcgggagtgggagggaggagcgggccggcgcgggaagaaatgggccggcggcccaagaaaaggaaaaaggagggaaaagaaaagataaaaaggaaaaagaattttcccagggatttaatattgcactttgcttattttaattggttaaaattatttccaaggctctgaaaattccactaaaaatcctgttagcatattttgacatgtagaatccaagaaaaattccacatgccgattccgatgattatttgcatttattaattaaggattcaactctaggttaaagtaaacaattacttcggacgatttattttatgaatttagagcaagggaggggaacttcagggcgtgacaactggtgaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttcgatgggcaatcccctttcacggtgacgattgaccctagcatcctcctatcaaatgaagacaccccttactcacgcagcgatcacaaggagggaacaatagttaggagaaagtacgtgcggtcaaccgtcaccgccgatgtaatgccgtaattattgtgtacacgatgtaaactattttggatgtattgattatccatataaatcaattgatgtatggcataatttactatcattcatatgctacatttaattgactatcattcatatgctaattataattgactagagaatttttaaaagtattaaatcattcatgtggcatttacagatgttaattagagtttttcacaatttaatttactatctttcatatgctacttatatatgactattcgaatttttaaaaggtttaaatcatgcatgtggcatttacatatgttaattagagtttttaacatttaatttaatataattcctacgctaagtatatatgatgattacaatttttattaattttaaatcatacagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcaaaaataatatgcagtgctataatgtttagtcccggttcttaaccctaaccgggtttaaaaagaatttgaaaatagcgggaaaagatctttactcccggttgggg

SEQ ID NO: 63874 - DNA, 14414 bp, Oryza sativa
tacaatgttgccatcaacactgaatacactgaatacataaaagtaggaagaacatgaaggccttatttcatcatcttttcatctttattcatagtagaagaaactgtaatagaaataccatcttttcatctttattcatagtagaagcaactgtaccatcttttcatctttattcatagtagaagcaactgtaccatcttttcatctttattcatagtagaagcaactgtaatagaaatacctcccaagttcctttcatctttattcatagtagaagcactgtaatagaaatacctcccaagcaggaggagcagcatcaacaatccttatccttgacgatcgaaggtaatttgagcgtgaaagtaataccaccattgttgtgttcactgactttgattctcaggtagtttgagcgtgaaagtaataccattgctgtgttcactgacttttcttttcagtttttccagattctgcgggttgcacgttccccccttgagttcgaggtgtgtgagactctgcagcttacggacccctgaaagcttctccatgtgagtgaaggaccaaactatcttttcaagcttatcagggtttcggtaaccaaaggtgacgctgataataatatcatcttcaatgataaggtccatgagattcccaaaactccagaaccggagagcgccttctgcaaatgaatggtagcaaagcctgagatagcgtatgccatcgagcctgctaagtacatcgagggcgccctgattcaaaaaggtgtcacgtagagttatcttggcaaggtgatggagctccttgatcctgggaggcaacctgcttctgatgctacagatgtgtaggctctccagaagctttggaggtctcagtaaaatagcatcaatagcatcccagttacccggtggatccattcggattgacaaggacagaagacctctatggagtttgtcaacctgaaggaataaatctatcaagctagctttcgtgccagatagaaccacacccagcttcttcaggtgctcgagtttgtcaccaatgttgttcagttctgtagcactgttggaaactttgacatgggacaatatctccatcttttccatagttgcaacagcacgaggcacgcagacagtggagaagaattccttggacttgacaatgtctttgcctgggcagacaataatgcacccagcaagcaggtgctttagcattggcagcgctgtgtggaacacctgtacccttgttcctcggatgtcaagtgtctctaagagcctcagctgacctatttgcttgggcagttgggcaacatctgtgttccggagacttagatacttgagtttgtgaatcttgcatacggtatggaggtcgtttgccttgaggcccttacgaccttccaaatcgagtacagtcagcagcaaccttgaagtgctggaaagtgagttcaagaaccttgtgatattagagttagccggatggagttgcatgccgttccggattgagtagaggagatccaagtcaagtggcaactggttgttgagcaataggtcctcaactgtcgaagactccctgtctatcaaatcggcaaccacaggatgcacagtgcagctctttaccttacgtgcaccgctgagtccagaaggaacaataagcttctgtctgagcatggcttcgaaacagtgcccagcttcaatctctgcactcgactgatccacttgggtaatcaagccttgggcaacccatcgtcttagtaaacttgctcttcggacgccatcgggcatgctgattccacgggtgaaaacggttgaataccataagcagttcttgtaattatttggcagtgcttggtagcagaaggccattattctgtcctgcctcccatgatctgtatattctttaccaaggcttgtattcaggacctgcaactggtgttccgtcgtttcaggattgtagtagagggcatggaggaacatcttcatgcagaagacatcagggcagcattgggtgaggatattgcacaaaattcctttcaagtgtctgtcatcgtatctgtggggaagcagggcgagcgctttgttgaggtaaatatcaacgagagagtagattaccggaggcccacatttggcagagtcacagcaatattttgccatcttactatcatttgtgcagagtattactgcactgtcagagcaacccgtcgagctcaacaattccaggacctgatgccataacactgggtaattcaaaccggaaagaacaagcagcacattttcattgctcaatttcttggcaagcctctgcctgtcttctgcctcattgtctgtctccctttctttcgggtgtctcagcttgtcaaccatggcctttgtaatctccgagagaatcggaggtcgttggagagcaacgtggagctcctcatcagtccatggattacgccagtgactcttgtaacgcttgagcatggtctctccaacagcagcttcatccatgccatcttgcacactgattatgacgaccctgatatgctgctgcttgttgccaccgtccgactggggcagcagcggctgctggtcatcaccatccgactggggcagttgctgctgctgcttgatgccgcctcccgactgcagaggcggcggctgctccttgtcaccaccctccgactgcagaggtggcggctgctccttgtcgccaccctccgactgcagaggcagcggctgctccttgtcaccaccctccgactgcagaggcagcggctgctccttgtcaccaccctccgactgcagaggcggcggctgctccttgttgccgccatctgactgcagtggcagtggctggaccttgtcatcctgcttgtcgctgccgtcagactggagtggtggctgcagcttgacacagcctcccgattgcacaggcggcggtggctgctccttgtcatcatgcttgttgccgccatccaacagaggctgcggctgctgcttgtcgtcgctgttcaactcctccggtggcttcacctcaacgtaaagatattctgtgaacggcttgagccgcgagagagcctcatccacgctgccgtagtcgccataccagccatcctcgagtatggcacgccgggaaggattgttccagctgccagcattggtgcgcctctggttgcgcggcctcacactagcatccctgggctccattgtggtggtcacctcgacgggaagctggtgatgagaaacggcaatgccgtacctcgcctgcctctcactaatttcgcgtgcctggatcttgagctcgcggatccgggtgacgacccggtggcgagctaccatttcccagggcagccaaccgcaacgcgcgctaccagactgcgtgtagagctcaacgcaatttctggaatcgaatgcaagctccatgacctgcttcatccacgggcggagctggtagtcaccggcagtggtactccccttgttggccacgatgtggcggagcacgttgttcatgctctccatctcttgcatgatgaactgcaggtcctcacggaccctgccaagcagccgggcctcgtcctggatgaggcccagcaccaagttgacagcgccaaatgctatgtcggccatctcttcttcttagctctagctagcttatcaatgatccgcctatcttccgatcgatcaacagtggcagctggtagctgctaccatccggccatggcatgcaatgcaataggaggtaggagcaggaagcaattcccacgtatggttgataaccctctcctctcgtctcacggcagaacaaaacaggactgcttttgtttctttgtcagcaggatacaattcgtgttccaacattattccagcctacgggccatttggagtccagccatctctcttgtcgtaagctccttgtgctattgcctgcatcttctctgccccttctacaatcattttatgctttgcttgtgatctgcaaaagagcaattcggatggtatctaacagccgcctgcccctgaagcaaaagcagctgcatttcttgctttccaaagataccagcttacagctgaacacccaacagatagctagtccggcccatttggatatcttcaattagaggcagaatcttgaaatttgattaatgctgggatcagtgtattctttcttccagcattaggctgtgtttagttctgcactaaaattggaagtttgactgaaattggaagtttaaagaaaaaagttggaagttggtgtgagtagaaaagttttgatgtgatggaaaagttgtaagtttgaagaaaaaattgggaactaaacaaggccttaatcaagttcatttgtattagtgtatcccagcatcaatcaaaattcatctgtatctattgacagctcactctctccttctatgtctcaagctcctctcgtatttattttccaaggaaaagatgttttgcaaagtgagattgggtgtcaaaatcagggaaaggctcatactaattctcatgctagcactcttttactcttttagctgtaccttccgtgagggaagagggcatcttcgctcttctctattttgatcttctccacgaggtcgccactgaaatgtccacacaaggaggagatgcatttccctatttgcgcctccttgtgattccaagccttgcatctaggtaaagaacaagcatctcaataaaaggagcattccacgctgagtcgctgactgacatcccaaccgctgcctcttacgtgctgattaccgaacagcttagtactcatgttaataacaccaaggtgagttggctcctccaattttcatagcttgcacatttgacaatttggtaccacgccgtgaggatttctcatccgttgaaggacctaagaactgaaatcacaaattcattgtgtgcaacaaatcaataaacagctcgagtcaccgatcccaaatcttcccaaatcaattggagtagaagagagtctaatctactatgtatagaactatagattgttgaataccgaccttcctcttagatcctccatctccatgccccctcggtccgcgccatggccatgggacagtaggaaggccgatgacgggagatgggagggccggtcacccctcgtcgctgggccggcgcccggcggaggcccaccggaggtgtggaggcgtggagaaggacagcagagcgagcgacggcgagggcggcggcggcgaccggcgaaggcctgcacgcctggatgcatggatggaatgcaacgctaggggctgaaggctagcggcgtcgccggaagtcgtcgggatggcggaacggccgagccgccgcgccgccgaggagcggcgcggccgcattgcgtgtcggcggtaccagttggcgagcaggtcgagagagacgagaagttcgcgagctgatagactatgggccgtgggctggattgataattttaaagtctatattaggttcctcgactatggctgataggctgagcttgaattttctcacccaaccataataaaattttaaaattcagatatgccacataagtcacatccgacgtggtgccatgtaagtgcgtcctaggtggcatgatattgggtagatccacgtcttttcatatgaaaaagagaggagatatagagagagagggagtgctcacaagacatgacgttcgacagtgtgtgaagtaagcagaggtccatgtctgccaacaatcgtgttctttggatctgaagtagtgacggaggactagatccgatgacgcttcacgggctcaagaggtgtgaagaccgagacccgcatttcatgagctcaggtagcactgccaccgagacccgcactaaactgccaagatatgtataccgccggaccctcatcactgcctttacccaatgcacattgtcatccgacaagctatcgtcatccttgtcaaattaattctatgtatctcgtcctgcgtgatgcatatctcaggcctggactttttgtcaatcgttcacccattttttatgaacggttaattagttgttgcaagggttcacccattttttttaagaaaaaaaataccaatggcatgagctttgacgaatatattaagaagaatagagtttacaactacaaagtctaaattgctatgaaacgaatgaaacatatcagataagctcaaaaagctaagagaaaagaatcatagcagtctgaaagcatgtattttggtctatttcttccataattaatcttacctctctctgcctccatggattttgcgtaaaaaacccttttgtttctctctagccaagtgttccaacgggaggttagaagagttccaacgatttccttttgcttggagtgaggattcgtgcttgctagatcattctactaggattatattgaggtttccgggcctggcagcaagattctttgcccacatatgtacacattctcaatcaatctattgccgcatgagctttctctacaccatggtatcatacgcttttgatctaattttcttccactaaccctcttgttgccggcctctgctcgacatgcccatccccaccctactcctcgccgccgccttctctatctagcatgctcacaacgccgatcttcctcttcaatgtcattgccgtgcagcctctggcaataatgattttgggtttagaatagtttttaagacctatatgttagttgtgatcgttgtctacctataatgcgtctaaattttggattttgatatctcaagaatcagataggacaatcctattgttcttcaattcgtgattttttatatggttttcatttacatgttgaccgtggcaaactaatcttcgaaccatttttaggcgtcagcatcaaaggagcagacaagtattacggcacacagtttttgcatcttgtgtgggatgttgaaatgtgtgttcctatgatcaattgcatgtgtgcccagcggattctcaagacaatccagcgagagaacaactgtctagtgttttgagttgaatcctaagaacgtgacgagcaagcctattaattgtcaactctcaacacaacagtaatatgagagactaaaatatcatgagtaggaaactagatcatggcactcttggcattattttggtagcagcgtgtcctttttctaaaataactgagctcttcctttatgacaatgaaataatattctgggctcagctgcatgggatcgttttcactaaattttttttgatacggagttctggcctctgaataggtaaagagaagttctcgacggcaaggaagggaacactgaactttctatgattttcaactagtttaacctatttaaaatcagacgatcgagacggaacatgcatttcatatttccatgtgaactccaacaactcgaccaaaacgcatacagattacagaatacagcagtggatttcagagcactactgcagccaacgatcgacccagagattcacatgagcagtataaataacattattgcagactggaattcctaatcaaacttaacccacagccatggcagaaactcctgctgcagcagcagccgtggaattcgggcctcatcctcatgacatgttgacgctcgacggggaacttttgcgagtgctcatcaccggcgacagggtccgcttggaggagattttgagagaagcgggtagctatggtggcgacggtgaacaccctggggatggtggcaatggaggatcaccacctcatgaagttcctccattggtggacgggcaccgcgaccctcgaagggatggcccggagctgatcgcgattaacttacccgatcatgcggcaccagccgtggtggtggaggcagggttgtcgttgagcccaaggagatcttacggctatctgaagaggtgcattgctgcctgcagctggagctccatggcacgctggtgtcaagcccgagatgctcccgctccccacccagcccggggccgcggggtacatccgcggcagccgatcgcagtggcgcctgcagcgcgacacggagcgggctgccttctcggagtgacgagcaacgggaacacggcctgcacctcgtcgccagccgcggccacgccgagctcgcggcgctcatccgcgtgagggcgccctcgctcgtcgccacgcgcaaccggtgcctcgacacgccgctccactgtgcggcgaaggccgggcaccgcgaggtggtggcccgcctcctagatacgcgcaccggcgtggccgaggctgaggtggagttggcggcggcggtggcggaggcggctctgcgggtgaggaactgcctgggcgccaccgtcctgcacgaagccgtccggcatggccataccgaggtggtgcatctcctcatgtcaagggcgggcgcggctgagctggcctccgtagcatccgacgacggcgtctcgccgttgtacttggcggcgacgaccggctcggtgcgcatggtccaggagctgctgcttcgtccggcggatgacgggagacgacgatcatcggcgtcgttcactggccgggagggacgtacggctttgcatgttgcagcaactaaaagcgcaggtaatacgtcatccacaacgacaactctgctgcttctccaacttctggtagctttatattctccttaaaacggaagatgcgtctgatgattgaatactgatgtccaatacattgggcattttgcactggcacgtatagaagagatttttttttctctgttgtttcacttgcgacagaattttaggtttttatctttcgatttttcgttcataggatgttgcatcaagattcatatttctatagatactcagttacatagtacttttactcagttacagtgccctcaaattcagctacaatgcattcacattcagttacaatgcgttaaaattatattttacgactatttttatctatagatatacgattttaacgtgtttatcccttttctttttgttatttcattcaaaacgggttgtatccattggttgaaaattttgcaagatttaaagctctaaatctgtagaaagattaataggtagtctttttttctattggaaatgtttgatggtttattcttatgcactaattgtctcatgatctatggaaaatcctgtacatggattactgttgtttcaacatgcagattttttttctaattcctttttttcacttgttccttatgtcaaattcgttgggttacttttttttaagacatgtactacctcccaaaaatgtaaaggattttggctatgcatttgcgtagccgaaatcctttatatcttaggaggatggatgtagtatgttgtttgtgcttttctcactgagagagtttctccagagctagcctccatctcctcccacttcggtatcgcgacgctatagcctcctgaccctaagtggtgatggtacttcttcttggcggcattttctttgtttctttccatcatcgcctgcccttgttcacctgtcttatatgcaatgaactcgtcccagtgatcccttagctttgggaatgtgtcgaagttcggtgtctgccccttcaggatatatttcttgtacagctctcccttgaagctctgaaactgttctgccattttctttagagtccaccttttcactttgtcctctgtacccgcgggaagggtgaatgtctcgagcattgtggtccacagcatctctttctccgaatctaggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactagctgcttccctccgcgattgtatcgtacaatatctgtttctcatcacggtcagccatctgttgatacaagaaacatctgctaagtcatgagacatttatgttttaacaatctaagtcatgtatgctaagtgtaaatgtcgtacattagaaccctacacaaccttacgttctaagtctaattacaaatcgtgatataaactaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataattacatactaattctaattacaaataaagtaatattatattaaaactcaaataatattacatgctaagactgaaagagtcatgtatgctaagtgtaactgtcgtatatgctaagtctaattaagactaaaattgtcaattgctaggagtcgcaccaatttcgtagtcaataattaaatactaagtctaattacaaataaaataatcttatattaaaactcaaataatattacatgctaagactaaaatagtcatgtatgctaagtgtttcgtgcgtatatactaagtctaattaagactacaatagtcaattgctaggagtcgcaccaattccgtagtcaataattacatactaagtataatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacatgtcttttctgcaagatacaaaaaatatgtattaggataaatgcgaagtaacatatatatatatatattgcatttcacgttcacgttcgttcgctcgttctcattcacgttcgttctcgttcacgttaattcgttcgatcgttctcgttctcgctctcgttcgttcgatcgttctcgttctcgttcacgttctcgtggcaacgtacgttgatgtgttcgttctcgttcatgtgttcgttaacggcggtgtggcggcatcgggccagcgcttggcgcggcggcgtggcgacggcggcggcggcgtggcgttgcatgcggcggcggtgttgcgcggcggcgaaggcggtggtgtggcgtggcggcggtggcgttgcgcgcgtggcggcgaaggtggcggcgtggcgtgccggcggcggcgtggtgcggcgtcgtcgtggcgcggcgtctcgtggcgggcggtgcgacggagagagagatcgagattggagatcgatgaagggagaggcggcggcggctctcaccccagagatgcggcggcggtggaggaggcggaggcggcggcgaggacgatgagctcgagacgacggcgagatacggcggcgtcggcgcggggatttgccctaggcagtggcggtgaaggagagaggccgagagagatcgatcggccgaaaacgctaagtgttgggggagaagacgagggcgtgcatcgggaatatatatagccctcgatcttcagtcacggttcatgagcacaaccgggactaaagaaatcgatctttactcccggttgttctcaacagccgggactaaagatatctttagtcccggttgttctcatctagtcccggttgttgagaacaaccgggcttctagtcccggttgttgagaacaaccgggagtaaagatcttttcccgctatttcctaattctttttaaacccggttagggttaagaaccgggactaaagattatagcactgcatattattttcgcttacatatatgtttctaaaatataagttaatgcattaacattatttaaagtacaaagattaatgacaattacttcgaaaaattatttttgtctgtaataaattaagtggataaatcgtaataagcaaatatatgacttaaaatgaataaaaattccaataatcatatatacttagcatatgaatgatattattaaattggtaaaaactctaattaagatatgtatgtacatactgcatgatttaaaattaataaaaattgtaatcatcatatatacttagcataggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaaaacttttaaaaattctcttgtcaattataattagcatatgaatgatattcaattaaatgtagcatatgaatgatagtaaattatgccatacaacaattgatttatatggagaatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccaacgatttttcttttgcctgggagaaccacttgacgcttagtctcgtcaggccctctgcccttatttcctttgctagacatgtccttcacgaaaaagacttgcgttatatcattggcaaggacaaaaggttcgtccgagtatccaaccttgttaaggtcaacagttgtcataccactgtcatcaatcattacgcctccaccagtcaacctaacccattggcaccggaatagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgcgtacccattaatctcatatccctggaatgtcgcgatcgacccagacggtcccctcgccaggaaggcaagttgttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccatagtctcccttcatggcgtgattcaggtaccccgattgggcgaaggtcttcgataaattctacgcaaaattcgatgacctcctctgttccataacccttggcgatgcttgcctctggatgagcacggttacgaacatacttcttcagaacgcccatgtagctctcgaaaggaaacatgttgtgtaggtacacaggcccgagaatacggatctctttcacaaggtgacaaagcagatgcgtcattatattgaaaaatgaaggtggaaatatcaactcaaaactgacgagacattgcaccacttcattctgaagggcttctaatatatccggattgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttcttcttcgtgcttattattcgcttgatattcgtggagtatccagacggtacctttatgctctccaagcattcaaacatactttccttctctgtcttgctaagagtgtagctggctggactcaagtaatggcttcctttctcctttggttccaggtgaaggtcgccgcattgttccatatgcttcagatcattacgtgcttccagtgtatctttcgactttccgtatacacctaggaagccaagaaggtttacgcaaaggttcttagtgagttgcatcacgtcgattgcgtggcgtacgtccaagaattcccaatatggtaactcccaaaatatagagttctttttccacatcgccgcgtgaccatcttcgctctctataggctggcttctaggcccctttccgaacactactttaagatctttaacc

SEQ ID NO: 63875 - DNA, 1169 bp, Oryza sativa
ggtaaatcttgcaacctaaaaaaaaaatctgataatcaaaaccttaatatttatgtttataatcagattttggaaaggcacctccatgggtaagaaatatcacgagagcttccacactgcaaacatggccaataaatgtacttcaatttgtatttgtaacgcttctgaaaataatcaaccacagttgtagtaaaattttctttagcgccctcagcaaacctaaaaataatataaggaaaaattttagtaagcataattaagggggaaatattttgttggatagatgcttagcgtatgagatcaaaacttacatgaggtcttccaagggaacgacagaaagccctttaatcttgtatcttatggttttgtctgttcgatgggtggtttcaacaaaaacaccctgcagtgctttctctacctggcatttacaagaacagcaatacaaaatttaatattgtctaaactgcattataatagcaacatgactaatgattaaaaattaataccttgtcatattcctctgtagaaaatagttggttgacatcagttctattcaaaagctcagccacaaattccaccactggaagaggtttataaaatggtgctgctggtatatctaaacagcaacattatacctaaattagtcttcaaagatagagacaaaaaaatagatagaaaaattaaaaggcagcatttgttactgtacatccagaaaatacggtgtttgatgatggacaccacaataacgaagctttgcttctggacactaccaaaacatggcctttacaacaggacactaccttcatttttcttaatcatttttgtcatttagggctggtttggtttgtggcctaaattggccttaccaatttatgtcaatgtcaaattttggtaacttttggcatggctaattttggcaaaggaaaaattgtgtttggattgaagccaaaatagcctaaattaactattgaaatggcctattttcttaggcatgccaaaatttggctccaaaccaaatagcaataaacactattgaaattgccaaatattggtaaggcccaatataggcctcaccaaaccaacccttagagagatctttgttaaaggacaaaaatgcccctagcccactacccgtcctcttgccttggcctggttcattggacccagat

SEQ ID NO: 63876 - DNA, 14826 bp, Oryza sativa
tccgtctactctagagaaaaacgaatacgggatacctttgggatgggattattcttgattggtcggattccggttccaattacagatatttttctcccggatacgaatacgaatatggtatcggggtttccgtcggatacggataataattcggatatccacataagccttgtgacatatcccatttctttataattctataaccttcaatatacctttttagattttaatagtagtccatctcttaacactagtccatactattaatattatttaaatttttaaaaatatttataaactatactatattttatataaaatgagctaattatatatgttgatatttgtttctattaggagttgagttggttttcgtatttgagatactccgtatttgtttccgtatccggcgaaaaatatgaaaatgaatatggtatgtgcatccgtccgtatccgcaccattttcatccctaatttgtatgatatttaagatactctagacaataattgctagtgtgtgatgattgtcgaggagtgatactcgtagaccggataaattgggtattggggtacattggtacgaggatctacatgatacgatatcaagcaaacggaagacaagaattatactggttcagaccccttgtcaggtaatagccctagcccagtttatatgggattaatatggaaaagccacaaaatacaatgggagtagatgaatctgatgataccaacgagatcctagtcgatggactcgacgaaatctcccggcaacttggctccgtatgcttcggcttcataaactgtggtggatgtattggcgatgagattcgatgccctttacccctccaagggggtcccttttataccgtggatcaccttggtctccaagtaagacccggagatatcggaccctatacggtacaacagaaactctatcctctccgagtatgaccgtgttaatcactcgacccgtagagatattttctataattcgtgacggattcctacaacgcatacggaaacaacccgtgtatgtgaaggtataccatactcgtatattccatactcactccttcccaaattgatcatcatataagtttatgcaccaagaccaatgttaatttaaatcatatcaataaagacaccatacacacattctcccacagtgcatgcatcgattaaaacctaatgacaattacaccctatcatgcacacattcatccatactgcattaattgtattccgatgaaatccgtatccatacagttatataatgatcaatttgagaaattttggattctattacatgatgatcaatttgggaggataggaggtatgccttatccgtaaccatgataatgatgtacacactttgtatttgatttaaaataccctagatagtaattgctagtggatgatgatataacatccttgcatgttgaattttagaagttagtgagcatcaactttatattaagatagaatacgtgtagaccaaattaagcaattacctagagatcatttttttaaagaaatggtcaataaccattaaccaatacgatccttgaagtttcgctctagagacgcggtttagttcctaaggctacaaataatccaaacaagttctcaaaattaattatttaacttaatattgtctttggtcccaaaaaatgataagacatgccccacgtcatcctcgcatgtaagggcagtaaggttttgaaataatcattgttatatatcatataaaaatatactattattatcctatcagtttgatttatccaactaaacgtcgatacgcgaacggcggccgcatcatcgcagccttgcacatacgatgattgctccagttcacatgtgacgccgtggcacggagaaataccaacgtaccatttcattgaacttcgccaatttctctcgtggttgttttcttttctctttttttatggtatgtgagggtagaatggttatttcatccctatcattgcatgtggcacacctatgaggtatttttatgggtctaatgactatgttaagccaaacgattaattttgggaacctttttcaacgatttgaaacctcggggactgaattgatccaggaatgaaacttcatggactgtattggccattcacccttaaagaaatacttcctccgtttcataatgtaagtcattctagtattttccatattcatattattattaatgaatctagataaatatatatgtctagatttactaacatcaatatgaatattggaaatgctagaatgacttgcattgtgaaacggaggtagtagcaaaaatacccttctgttgctaggaatagtaaaatgtccggtcgttactgtggactcaaacaacatgattattttaagtaagggtcaaatacccaatacccggactcaatttagttcctaacatttcctattatccaaaatagtcctacaaatttagcatacgagtagttggatccaccggtgcatgcgatgtcatctcaacatgtaaggtcaatatttaaatgtccaaagcaaccctacatttatcattagaaagaaacaatcaaaaaggaaaaagaaaaaaagggaaaaaaaagggccggcccggccagcgttgtttcgtccttattagtttcattaatttgttttgtttttctctttatttttccttagatctattttttttagtttttgagactaccaaaaaaattgttgcaagtttttcaagggaaaaactttcaaatctaaatataatttcactatagctataatataacttatatataagtattaaaataatatatacaactttatatctaacttatatagagattacaatgtagctacgtacagtgcagttacattatagattacagtgtaactatagtgtaattataaattataattacacaacaactatattagctatagtttcatttgaaagttttttttttgccaaaaacttgtgacattttttttagcaattctttttttatcttaaatggcatatataaggataggatagacatttagcgcttaccttgcatgcgggatgaggattacatggcatacgaagtggtgctcccgatgagtccaaggaatatattgtgccgcataaaaaaatatagcattactttgcacaatatgaaacaacaagaatatttatgggacgcgctaagtaccatgaaaaatgactatatatgaaatatatagatagtagatttaattagatccatgcctttgcaaagtctatggttaatttgaaaatctactgacactattgattcatttgtaactatatatgccattacaatatatttaaaactagatccatgccactttgtacatctcgactatgatttgaattgtttttttgtcaccgtattttcatgtggatcgaagtgcccatgcccccgatactgtgggactcacatatatgcgcgtggcatggtgcagcggcgtgcggcagcaagggtgaggctcccgtcatgtgcgagcatgaccgacgtgacaaccccacctgctgttgatggaagatatggtgcaggaaggacgatcggggagtattcacagtgttaggccggttgtcgatctccagggcatgtacaaccaaagccatccttagagtgccatcactaactgagcgtactctctgaaaaacatattcatcccttaatggaggataccctaggttggaggataccctaggtgggttcttcaaaatctaaggccatttgatgaagataagtcagcacaatgggtgtcctggcccatggtagccccagagtaaaaataccatcgatacccctccgccaacccatccccttctctctctgcccgctcctccccagtcctcttctttttctgcccgctcgtctctccatctcatcacctccgcccgctcctctctctgtctccgaccgtggcgaagaaggcgattgtggtcacgtcgagcgcaaggggtaccgccggcggtcccgccgccgccgctccctccttgccctccccgagtagctgccgccgccttcctcctcgccctcccagccaccgccgcctccctcctcgcatctccggcgacgccgccctcgtcggtgcacggatctggcatgccggcagctggatccagtgggccggcaccatctctatgtcaccaccacctgtctctcttgccacatcctctctctctccggtgctctctctctccttgccacccgtcatcgctgcctctctctcccgtcgtcgccgatggagaggggcacgcggggcacggtggccggggttggggccgccgtcagcgactcaacctcctcgccgcctcaggctcctcactactgccgtcggcctcctcccagtgacgaggtcgagggtagaaggggaaatcgtaggtgcggtagccgtgtccacgggcgccccaagctcccaacgcgtcgcctggttgcgactccccacgaaaagctagcgaggcgcggagagagccacgtcccccagcagagggacgcattccatcatgaggggacgtcatggacgaaaaagcaaatggccatcgatggagggcactagggatactctccacaggcacacattgaacatgccctcagaacctgcctcctggccgcagatctaggccaatgagtctaggatgcacgctcccatctttttagcggatcctgcccactatgactcctcctggccctccccaaccataaatggaggcggtgatctactcgctcactatatatggatctacaccgtctttattccacgatagtggacagtgggaggagtgtgttagtatgcttaatttgtataaggtatgtgacgcatgtttatctcttgtcgttctcccgatatttctccggattatgcttctataagtgtgtataggatgtgtgtgcatatttatattggtaagtatgtgcatgtgttacgtgcgttatattgtgttttggaacaagaaaattcaagccaactcagttaatatgctaaatttaaacttatatacgtatgatatatagaactgataaaaataaacttactttttggagattatgttaatgatctctaaatggagggattaatgatcttatatacgtatgagagagagaatagaacaaggggcagtacaagataattagataaacttaccagaaaatagcgcaatcggccgtgctctaacgttgaggcacagcaagaaatatctctagcagtatggccatccttgttcataatgcacatatcaacacctcttgtccccagtagcagaccgaaaatccgtggatatccttgtttcacagcaaggtggagaggggtatttccatcataatccgtcgcattcagcagcatcgcgaacatatcatttccgcaaatgtggcgaaccaccatttcctgctcgctctcaactgcaatatgcagaagatttctccctttatcgtcaaccagttcatagtagttgggacatttcttcacgagctcatcaataatcttggttcttccgaacatagcagcagcatgcacgggatatgaaccatcgctgtcagaaatgctagtcagccttggagaagcagcatcaccacctaggaatagcttaactgtgtcaagccttccatagattacggcaaaatgaagaggtgtcctccctgacgaatcggctctggttagcaaagatggaccttctggccagttcagtatctcctgagctatttctggtttacagttgaaatttactgagttcaatgatcggaacttcaatgaaaaagattaaaatacagcttgaatttagtttctaccccacctgaatattataaacttggagcacaatatacgtgaatgaatgctgttttacgtcaaaaaaaaatacgtgaatgaattacggatctagaggagatatcaggagagtttctagtgttgatttatgtaaattacttttattatatatataaattacatttatttttttaaaattacttctaagacactcaaaatgttgtgtttattgttgttttcaagttagttctataatttattgattaaatttaatttctaaataaaatcatgtttttaccgcacaacgtttacttttaatgtcgtgataactcattttcattttgtgttaagttacttttttattatgtaaattatttttggtcttcattcaatttacttttataaaagtgtctaaaaattaatttgatcaaatctgaaaagtaatttacatgtatgataaaagtaatatacatcatatatttttttcatcgaaatataattatatgagatcttactataactattttgtttcaataaatacaatggtgtaatcggattgtaaagcatataattattttaagagaaaatgttataagaagaaaaaaaaattggcatgcatttctctccgacatgactaccaatcaagcggataccaatcaagcggaccatgttgtctcgtctaataagactaaacaataggatatcctctcgtttcgtgcatgttatctaaatagttattaacaaatttttttaaaaaatacaagatagattaatatgaaatatatcactccactaacatgcaagttaaaatttaaattttacaaattgtaacaaaaataataaatatagttgcgaatgtatgataactatttttaatttaatttgttctttttttgcaacctgtagaagtttagtttggttttacatgtttatggagtgatatatttcatattaatctatattattaattttttaataactatttagataacatgcaaataacgatgggacattctctcaagggatgaaaatccatatcctaaacaatgggcatgcactacgtgactgatacatactgctactctctataactctcgtgaacatgcacacataataattatgaaggcaaatccttaattaaaaattctataaatacccaattaaagatgcgcagaagaaggattcttgagagttatttatgattctatcataccattcgtccttttaatagccgccacatgcaaagctgtacatccctccggaccggcggctgacgccggcgacggccctccgtcttgcgacggacgtagcagtgcctggaccatctgtaccgagtggctcaccgccatgtacagtggcgaaacaccgccgttggttgtcaccgaggccagccagggatccgtcgtcatcagcagatcaaccacctcaacatggccgtgccgaacagcctcgtgcagcgcggtggcgcccgtcaggttcctcgaccgcggtgtcgcctgatccatcacccgcaggaggcaggccgccacgtcgcggtgcccggccttcgacgcgcagtgcagcggcgtgccgagggacctgttgcgcgtggcggccagcgagggcgccctctcgcagatgagcgccgcgagctcggcgtggccgtggctggcgacgacatgcagcgccgtgctcccgttgctcgtcacgccgagaaggcggcttgttccgcgccgcgccgccggctcactcgtgccatggaagcttatcgcgacctggccgtttgtgcgaggcgggtgtgtaccgccctctcctctcagaagctcctccaagaggaccttgttgccggcggcaagcacttgcaacagctccttgtcgagccacagtatttgaggcccgaattccacggttgctgctgaagctgccgccatgattgattataaagtccactctgcactctgaactttgcagtgctatttatactggtctgggtgaatctttgggccgctcgctagttgtcgatatacgtacctactacgtactatatgcattcggcagagtcgttcgaaatcacgtagaactaaatatagaataatagagtgcatgttccgttttgccagattcactcttactactttcttttattcatcttcaaacttcaactttttcgtttttcattaacacgcttttcaaattattaaatgatatgttttctacaaaattttctatatagaagtcatttaaaaaattcaaataaatctatttttaattttataattattaatacttaattaatcatatgctaatgagttttctcgtttgcgtgtgctaaaaacctctttcaaaaaggagattcaacgcaagctaattactcctttcgggttgataataagcacgaggtttaacttcaaaatctttaattataaataatttcttaaattatttgtctagaaaaaagaagattatatgtataaattagtcataaaaaagtttaaataaaatcatatatttattgacatttctatttatactataatagaaaataattgtcaattgtatagaaattggagtagtcttttgaatagaaatttttttgaaaaaaaaaccacaccgtctagaaatttaaaacggtatattttttaaaaaaaattctatacaaaagttgttttaaaaaaattatattaatttattttaaaaaattagttaacacataataatacgtattttgttttctgtgctggggaggagaacgcagcccaggacagctcttgtcgcatgctttggagtttttttttaacatgcgtaggagatagcaattatactttcacgcttatgtataatactccttctgtttcacaatgtaagatattttggcttgtctaaatcagtttttttcaaatttaattaaatttataaaacaatgataatatttttaataccataaaatatattcaatgatggatatgataaaattaatttgatgttgtggatattactatatttttctataaattttaatcaaacttatttaattttgatttagtaaaaaaatcaaaacatttatattctgaaatggattgagtacaccggtatcgcgacagacagcacaccagctccttctccctgtcgcgccttttccactcccacagggcttcgtctcttcaaaccatggaacatgttcccttcctacgacctgccgtctctcagttatttatgtccgtcaaaaacttaagacatgtgattcaagtaatagaaaataattttaagctaagagtcataatgcaagtacatatacgcgactgcgtgcacagtaaacaacagtcgggaaaaaaaacactacattagttataaaatttaaaatgctcaaacaagtcgaccctaaccgtgggcatcgatcacttcaaatctaacccgggtagtcctatggctgcgttcgccttgtgtgcttccctattggggatttttgtcttttctgtatgtctaggtccacagtgaggtgaaagagcggataaaattattcacaacaggcaatgagcactattctagcttccccttcctgctattttagccagtttcatatgttgtttattacttcagtcttagcgttcaactcgatcagatccctcgccagtgtagaattatagatagttgggtttggcttgagaatctgctgtgcacacagcttcatgtcttagtacatgtcttcatatgatcgatgcaaaacgccaaaaccgtgtgctgcaatacttgtctttatctacctgtcccagcttcattaagagaacttctctatagcttccccatagccaaaccgtcagcggctttgccactatactcctctaaggctctaaggctcacctgctgcctcccctgtcattaagattttataatcgaacatgattatcattggagtttattttatttactttttagaaatcccgaaccttatttttataatgtttagatgtcccgtcaaacgctgccactgtacgtctttactatccgtccactatctcacctcttttttacactgattttaaaaatcaaacaaaattatcatttggatttttttttttactttctagaagtcccaccaaaccactgtactccactacagctagcccgctatctcccctctttactgtcgttgaaattctaaaatcaaacatgattatattctagaagttccgccaaccatcgtgacagtgttgtttaatgccctgtctatcgtgctccttttaatcgtcaagtggattatatttggggttttcttaatagttttaaaatgtcccataaaccgtcaccactctacttccttataggcctgttgcttctcccatctttattgtcatttgttatctatgttccaaatgattttttttgaaaattccatatttttcattccgatatgttttatttataaattatattcctacatgaacccttacaattatttttctatttcggaatttattttatttgttattcagaattttaattaatctcgtcatgtgttctaaatggtctcttctttcaatagttttttttttattttattacgaattttagttatttataaattatattcctagttaaactcttattttctttttctaatttcagaatttattttattttttatttcaaatttaaattaatctcgtattgtattctatatggactattctttccaataatatttattttaatgtattctagcaagttaggcggcgaagcggagaggcacatgacgcggcgggcgccgctgtgggcattctcgtcattttgaaatatttctcccctctttcaacctggaaattataaaataatgcttctggcatcctacagctaattacacaacttttgttgtgtccatcggcagtgtcacgtttttacgatgtcctttggtcaattacacgatttttgagtgtcctgtagcaaattctgcctttactttattttaaattttaattaatctcgtattggattcttatatgtactcttctttcaatattgtttatttttaattcctaattattttagttatttctaaattttattactacatggactctctttttctttttcttcaattaatgtagaaacctctagtcttcacagcgaacgtggtgtctcctttcaaaactgtttttaataatataatagatgttatgtatcggtgataataaaaatcgggctatacacccggtcctagagctagaatgttgcaaatgacaatgagatatataaaagttcaggtaatatcctagtaatgttttggtggattgctttttgcctgtgaattgtggggagttgtatgttgcctaatctaggaacccatattcatcttatataggctgaggggtaaggtaacctagccacgtacggcttgcgctgctgcattgaaagggattcttcttgcaagttaaggatgagggcatcttcactcattttcaaaatatcaagcattggaaagttctctagattgtaagattttcagtcattttatcatttcctatcttaacatgtgttcatcaccattgccattttgatatgtggcacaattagtacatctatatgttaaacaatttagacttgcgatcaattctatcaatatatgaagttatactcaatttcaatttgtgttctgtatgctatatattatacaatcattagtatgtaactaataagatagcccgcgcattcgcgtaggcatataaagtagattatgcttgagtaacatgtaaggtggaatatcaatcggacgatacctaccaagcttgaaaagtactactccctttgtcccaaattataagacatattttttacacggtttttaataacatattttgactggtactttatttcattctataatcccatcaaatatgaaattagcatcacatgaaagtactttaaaacataaatctagtgatataacatgcataatacttagatatagttagtatgattattagtcaaaagctactaagttattagtataatttaggacagagggagtatttctttaaaaattttcttcatcgccattgcttagatattttttacaagacatttgtaaggtttgaactatatactgtaatatttaattcattactataagcaattatcaatgatcttctttattttcttgaaagaatgagtcaataaatacataggagatatatatattgtacgcgtcgtttccctattatatatgtgatttatggtgttcctttttaaaaaaatgccagtcaatgtgagtcctaaatttaaagttgatagtagaaaatatatataactttttaaccaactaaatactgctacatccggctaccttagtatgtcttatatatgcaataacatatgagaaactcataataccacgatagatggatggttatggcaatagaatatacaatggttgttccaattttctattttttagaaatttattactagattctctctaattgatttgattcaatccctattgacattttttatacttttctattttattttatacaagtcttattttagattaaaaatataggcattatggatcaggaattgttggtttaattatttaacagagcaacaattacattagaaatttgatgtatatcttaagaatacagtctttttagtttggtttgatagataaaaagtaggaggtgggggggggggatggagagcggagagcgtgagccaaggttgaaggggatcggcagtgttttgtgcatgtgctagggaggacaaggttttggggactttatttttccattttttttctaaataatttaagtaaaccgatgatcatatgttttttcttataatttgtaagatttttttgtaattttgatgaccgttaaaatcatataatcatatacgaatgtccccttaaatgggtgaagctgaccgtgtccgtcgaggctttatttctccgctgcctttaaacataggtcctgagtcgacatagtcatgacccgcaataccagcatgaagcataattttaatgtttagttcactatcagcactctcatagataattgcatcattaagtacaaagttatccactattgacaatagtggcctctgacggggtagcatagcatagcatgcttggtgccctttatgggaaaaaaaaaggcaatgtaggtgatgaaaatattttcctgatgaatttttttaaagttttgtgtagacaaaattgtgtatggtattaatcggtaatgcttaattttttattgtgtagataaaatattctcttttgaaatgagcaaagttaataaaaaaaactaaacagacatatgtccgtgacatctaggagtactatatcgttctttatattttgactaagatatatagtttagctccggtttgttttcattcatgtattgttcataattacatgcaatatttttactaattctaagaatatattttccaaaattagttaaaataactaatttgttggagtgcatttatagttacttcagtggggtgtatgacatacatcatcaattatgtctgatatattagaatttctaaactataaaaaatatatgatgaatagtttgatgcacatgattgttcatttgttatcaaaccaatttcgcaaagaaaaaccatatatgaccataattctcgtgatggattaaggggtcgtattatagcaaggacattgcctggaaattccaatctaatagttctattttttaaaaaaaagagaaacttaatctcacataaactaaaattaaatcaaatctaactgtaaaccacaatgttgttttactttttctgcatgtagatttgaattagtgttatatatttgtcaagtgaatttgataccaagttgatcctttttgtcaggtaaaattatttttaaaatgatcatgacattagtttattatatgttagctaaattatttaaaaataattatgacattacgtattatatgtcggcaccatgtgttgtaatgaatttagcagttccatataactattgtactacctccatccacaaaagttagacatatttcacatttgagtttttccaaataagttgttcctatttgtagtctttatacattcaagacttaaagaaggagataaattaaatgtttgattagaatcgaatgtgtcatctaaatactcattggttttgcattcactcattgattttataacatccaagataatttaatttttcctttggtcttggtgacaaaagtaataggtgtaacttttgtggatggaggtagtaagtgattagtattttatttaattaaagaaagacaaaggattataagttagatagatattcgaaataatttaaacgatgaagatttaaagacagttgatttggtactttatattaatctagtttaaccgtgcatatttgtggagtaataaattttattttataatataggaaatcctattttaaagaccgtggatagatagataagtcataagtatgtacttgctgttctttgttaaataaaaaacagagaaaggcatacacaatacgtattcgaaagaccgtattgtttctttttttttatcttcgtacgtacctacgtctgtttggtttttttttaagggaacaatacgtaggtttatattcggtatgtacgttaattttctggtaagtaatttcgatgaagctgggacttttctaaatagatataatctaatggtctaaaatagcgggtccatcaatttaagtaaaaatcaacggttagattaaaagtgctatgtggcggtttaagagcgtttgtaggagtgccacgtggcagtttatgagcgtttgtaggaagtttcatggacttttagtatataataactagaaaggtatcccgcgcacatgcgcgggcaccttcttatataatgtaagtgaaattttattacgaatattttttgtgcgggtgaatttttattaaaatatcttgtattatattctaaattaaattaaacttaatgataccaatagatcggtgcttagttctaatacccaactaggactggttacagggaactcggcatcaatctttataactagccagcactaat

SEQ ID NO: 63877 - DNA, 18824 bp, Oryza sativa
cgatttctggatcactcgatccccacaaagattcgtgccgtgataatttacatgatatgaatcaagcacgacaccggatcgggttagctaaaattatgtcgacacatgctataatcgacttttttaagccatttacacagaaattacacctcacttacaccacatttacatcctacttacatatatagttagtatgtaatttttgaatttacatatgtaattttaggaattacatatgtaattttgagacttacattataaatacattaaaattacatatgtaatttaaggagttacaatgtaaatacataccgactattttttggtgaaaaatatggcgccataaatatagctacaccctagaaaaaaacatgtccaactgacacgaaggccatatgcaagaaaaaagactaggaaacaaccacactgaatgcccctgatttttggtagccatgtacatacatacatatacgagaaaagataataagcaaaaatacctcattaaatattgattatatttttgttagcattagatcaaatcttaaatctacggtccacctgtttactgtattatataaatttttttttaaaaaaaaagtcttgaaaggagacaccatattcgttgtggaagctataaattctcaaattaattagagaaaaaaaagttcaggtagaaatacattaaaaaataactaaaattcataataaaagaagtaatactgaaaaaggagtccatataaaacataattaaagattaactaaaatttagaataaaaataaaataaattctgaaatttgaaaaataaaaataagagtttaaatagaaatacaatttaaaaataactaaaaattcaaaataaaaataaggaataatgaaagaatagtacctgcataacataatacgagattaattataattaagaattgaaataagtaaattttgaaattacaaaaaaaaagcttaagtaggaatacaatttacaaataactaaaattcagaataaaaaataagaattgttgaaagaagagagcatctagaagacaacatgagattaattaaaataaatagaataaatttcgaaaatagaaaaataattataagagttcaagtcggaatattttataaatagaaaaatattggaagaaaaatatggaattttcaaacacaaaaattcatctagaacacagatgacaaatgacaaataacaataaagataggagaaacaataggtctgtaaaagagtagagtggtgacagttgatgggatatataaaaactataaataaaaccccaaatagaatcccaatgacgattaaaaggagtgacgacaggcatgccgttaaacaacatgatcacaatggttggcaggacttctaaaagtaaaaaaaataaaataaaccccaacaatcatcatgtttgattttaaaatcccaatgacagtaaagagagaaatagcgggcgatccacggaggagtacaatggcaaagccgctgatcgtttggcgagacatctagaaagtaaaaaaaatgaacctaaacaataattttgttcattttaagaccccaataacaataaagaaggggcagcggacgggtcatagaggcagcgtttgaccgtacttctaaaaattataaaaatgaaaaccaacaaaacaataaactctaaaaagtacatggtccgattttaaaggtttgagacttctaaaagtaaaaaatatataccacaatgataatcatgtttgattttaaaatcctagtgacaataaagagatgaggcaacgggcgagccatatatagtggcgaacccgctgacggtttggcgggacttctagaaaataaaaaaaataaacccaaacgataattatgttcaatttttaatatcccaataacaataaagagagtagacagcggatgtgccgtagaagagtatagtggcaatgtttgacgggacttctaaaaattgtaaaaaggaagtccaatgagacaataaactctaaaaaccataagctccagattttaaaggttacaaggagaatgaataaaaacagtggtagatcgagaaagcaaagaaagaaggggtgatagaagtaaggggtagcgactagcgtgacttttacaaaactataaaattagatatacaaggatgataaagtttagtctttcaaagtctgaagataactagctatttaataaattttaagcaaaatcatattaaaaatagataattttgtatgaatgctagccacgcaattgcgcgagcaacccagttagtttataaaacctagtcactttgggtccttacacggttttgaccgcggttttatctgacgtgtcggctgagttagcatgagaccccacgtggaccccacatgccaagatgatacgtcatcatctctctttccctcctctcactctctcccctctctctctctcactattctcctctctgggcagactagccggtgggtggggaggaggccgacgggagaggagaaggtccggcggccggcgacgccgtggtggtagcgatgacgcgggagacgagatcacctcaacctcatcgtgggtacgtacggcgtcgtgccggtcatcgtgccacgggttgccggcgtcgacacattggacgctactcgactcattcgagcccatccatggcgtgcttctatgagagtagtgtgtgtatcctcacctgataacgagccagtcgacgacgatgaacgatagtggtgttgtttgtggccgcgagatatcgtccacttgaggcgctgtggagcatgaggatggggaagccgttaaagtggagtaatccctccatactcgtaaagaaagtcgtttaagataatgtttaagtcaaaccttagaaatataaattatgaataactttcgagttgttaagtttgaaaatgtaaaaattatatgaatatatttgtcttgaaaaatactttcataaaagtatacatatatcacttttcaataaatatttttatataaacaagaagtcaaagttgtgttttggagaccgtgtcgctgtccaaaataacttcctttacgagtactacgagtacagagggaatatgtgcaccgccagtagcggatctaggatataggatatgagtggtccgacctcaatttgtttttctaaacaaagtaaatctaacgatactaatatatacaatgcatataatagactaaatcaccaaaagtttacaatgatatattaataaagcatcttagaacatactccctccgtttctaaatatttaacaccgttgactttttagcacatatttgaccgttcgtcttattcaaaaacattttgtgaaatatgtaaaattatatgtatatataaaagtatatttaacaatgaatcaaatgataggaaaagaattaataattacttaatttcttttaataagatgaatgctcaaacatgtttaaaaaaagtcaacggcgtcaaatatttagacggagggagtataaaattagtaattaagtaatattttcatttaaagaagcttacacgactatgaaagtttaaagaagattaccatactattttttacttatcgggtctatgcgggcggacgggcgggcggtgcactgcagccaggaggttaggaggcagttctctgtgagtccgtggcttcgttttccagttttcctcggctcgacgacagctccttgtggcggcagcacacactgcagcagtgtggcactgcggcggccaaggcagcgagcggattggggtggtcgagcggcggcgcgacgctagtctgatctgatcgcgtgattccaatcgcgtcggcagctcggcacgtcgctagggcgtcagggcgaggaggagagaggcacgtctgggcccggcacaagtcgcgcgaccgcgacgctacagtttctttccttcccttcgatccacgcgcgtggggggctcctaagagcatatacaagagtgtctcgaaatcttaactctccaaatatctatttagctaactctccgttcaattagcaagttaaatttttttatttacttcagcctctccattcatcctctctattctgattgcatgatagtgggacccgcatgtcagcctcaaccttttcttcttcctcattttctcccctttttcccgagcagctacacaagcagagagcacggcggtgaggcggtcccccgtggcggcgccgcgggtggcgaacggcggcggaggagggccgcgcggccgccgcccatggtgccaaggctctcatgcccccgccgccgccacaatgctccgcttctgcctccgccctacgcccctacgccctcgtccgcctccacccctacgcccctcctcccctacgcccttgtccgcctccgccttttgtttcatttggaagcagctggtactgtcggcacaaaccaaccaactaggcgttgcgagtgatcaaagatactgtcttttgttatcctctgaaactgaaaggaatgcgatatgatttgatctgacgagatgtgttttcacctgtcacttggacaagatcgtagggctagatgtccgattattcaccagctgtgcaaaccaaaccatcacacaccgcattcaaagttcacaccgatcacaagttcacaaccatcagtcgtcggctacaaccttgaacaagaaaaatgctcgatcgaagctcgtttgactgacgtaagtagatgacaccaacctgaagaaaaaagacgtgtagagctaaaagctaagggcagggaaaagaaaatcgatggctgctgttcgtcgcagtcgacgagcttagccatcctccaagcgccgccgcccgaaggtgctccccgtcctacctcgccaccccctccgtctccccctccgcctccacctcggccctcgccgccgccgccaccaccacctcctccaagcgccgcagtgctccccgtccttccccgtcctaggtcgacgaggacgtcgaggccgcgctctcggtcgacggtggtgaccgtgccacggcggatggggctgggaccgtgcgctaggaggtgacgcggcgcacttttttttttgacgctaagagcacttaacgctaactaagagcgtctttcttctttttcttaagttgactaaaacaaactttcaattccagatttgaactcagatttaaaaatttcaagtcaagatttaaaaaattttcaactctgatttttaaatttgagttaaaagttttcaaacctgagttaagttttcaaatcttgacttgatgtttgtaaaatttgaattgaaagcttcaaatcttcatttgaaagttttcaaatccgagttgaaagttttcaagtccgaattgaaatttttcaaatccgagttgaacgttttcaagtttgaattgaaagttttcaaatccgagttgaaagtttttaaatctaagttcaaagttttcaagtttggatagaaaattttcaaatccgagttgaaagtttttaaatcttgacttgaaagtttttaaatctgagttaaaattttttaaaaaatcttgagttgaaagtttcaaatcttgagtcctgctcctacacgcgtgcggtagtcaacagcgaaaagaaaaaaaaaggaaacaatggcagctacgaaaaaaaagaaatgacgtcacgaaaaaaagaaagaatcgcgctcgcgcgcgtgggccttgtgggccagaagtgcgtgccagcaatgcgcgcgaattagcatttgtggcgtgcgggcgccaggatcgagctttattctgttcttatttttttaatagtagggtcgatcactgcacggacgaccctatggatccgccattgtgcaccgcccacgcctcatgcacggacgcacggcccaaccgcagggagacgctgctcccatcgtcatctgcatagaggtacgtgccgtgggcgcggctccacagccacacatgatgcccattgtggaactgctttattgcctccggcaagcagcggaagtggcgcggggctcttggtttcttggtgcttcggtcagcgagcgggcggaggagcttggtgctcttggtttcttggcgattgggtcggcgaagcgacagagatggcgcgcgcgggggaggggggagggggggtcttgttttattggcgctctgatcggcgagcggaagagacagtgacgagctctttgtttcttggtgctccgacgaggagagagcgcaaagaggagagaagttcgttgcgacggttactgcacagggctctaggcaccaagaggggagaggaccctagccagcgatggcggggttgcgccgccgccatagggattcgatggtgccggtggaggtcagatggcgctggggatgacgagttggtaggcggcggcgaggtggccataggaggagggctactcttccgcactaccataggctggccagtgaggaggaggggagggtcctcaggcaaccgcattgccgggcaccgaccaccatgcgcctctccccaccacacgccaccccctgctcgtcttcagccgcgcggagagaagtaggatgggagatgaggggagagaagatcgaggtgctaacatgtggggcccacatgggtcccacgctgactcaaccgccacgtcagatataaccgaggtcaataccgtcttaaggacccagagtgacccgattttgtaagataagagatgtcatatatttgtttttcggttgagtgacgattttataattcggtgacaagttgaggaacctttcatgtatttttttcctttccaaactcgtaatccagttgattttaggtgggctagaattggatgtcctggagtcggtataggcccagagtaaagcccatcgtgctcccaaatcctcccaagcgtcaagtccgcgaacagctgcataaatggagagcagcaaatgttaccatgatgttgacgctctgctcccgtctttgtgatattgatgctagaggctcagccttcaggcaatggtggtgatggtgagttagctagctagaggttcattcaaaccgtcgatctccacaacaataccacactcctacttcctccgttttatattataaagtgttttgagttttaaatagatgttatatgagtcaaaattcatatgaatgaatattagtaaatctaagcaagagatgttgaggtcaaaacgtctaatagtatggaaaggagagagtacaaccctaggagacaggtcaccacagtccacaagcatttaacagtagaacatcacgcctaggacacgatcagcaatctttggaaccttcagaaactcaggcaactcagaagacacttcattcctgatgcttgatccatcgccaaacttcccgagatagcttcgtcctcgggctgcagcaagatgagcatagtatagtgggggaactgcatagcaaagttaaaaagtttatgacttcaagcctaatcagtagccctcaatagtccaaataaaaagacacacaacgttaatttcagaaaagttcacaaacaagtttgtccagaaaaagtacagtacacgaaacctgagaggatagatcaaaaaggctacgatgtttagaaggggcacaattatgaccctcattcgtgtctcaataaagtaagctatcaaatggtaccctatctatactttgttaaccaccctagataaaagatattatcatcaaacataaaccgaaagttgactcacctatagaaacagcacgggtgcatcgtgcatacctacatattgaaaagattagagttaaatggcaaaaacaatcaaggtgagcacaaaaaagtaaataaaataaccaaaggtggacgtgaacttacatgtaacataggttgtgtgtaagcaactgaagcccgtcagcagtgaaatgattttcatcgaagataactgtataatgcgtaggtctactgtttccctgaaaatgacattatatacaatagattataaacaaatattcattaatacttataccatcatggaagtaccgaatcatacaaagcaaatttcacacaattgtaaatatgaaaactataatttagcttcaatttcaattggacattttgcggaactacaataataatacacgatttatcaaagactacaaccctacttgtgttcaatatgtgggcccaatgtgattattgcatgtgggaataagttcatctgaggtcccttaacttgtcaacggatctgattttcgtccctcaaccggaaaaccagacacaacggatccctcaactatcaaaaccggtgcagatgagatccctcggcggttttgagagcgattttggctggcgtggcgcctatgtggcgaatttgactcggtcttcatctgacgtggcactgacgtggcgcttacgtggcaatttgatctcgaaaaataataaaacccataggaccgacatgtcagttccacacacaaaataataaaaaaaaatggtaggacccacgtggaccccacatgtcatcctctctccttcctcttctctcaatcccctttctctctctagccgatggagcagggcgagcggcggtcgacagaagcgggagacgggcagagcggagaggctggccggcgaagcggggcgagcaacggccgacggcgggctaggtcaggtccgcggcacatggggccatagagcgcagacggcggcgactgctggcgttgtggagaagggcgtcaacggcatcgtcgggagtatctcctccggtcacgcctcatttcccttctcccctctccctccctaaaggcgagcagcgagcaacgggatagaagctgggcggttgcgggtcacagccgggagaggacagcgggtggggcagggagggaggaggcgagagggcggcgagcggagcagggagggaggaggtggagcgaccacgggggaggcctgcttcattgcggcagcgatgctgtcgaaggtgtctccaggcgacggtcgcgatggtgggcggaacccggagatggaggcagcagtcgcgggggagtctggccttcccgcccctctcgctggcctccttcctcccccgcccactcacctcctccctcttcgcgcgcttggctggctttggttcgccgacggagagggagaagagcaacggccagccattctcccacagcgcctccttcgtggggagggcagcgaaggcggcctccatctcccatatcgtcattcggattgccagcaacggcggcggctagtcccgcccccgcggtgaggtccatcgcgacgccaaatgcagccccgccccgctccgccccgcccgtcgctcgcttctgccggccgccgctcgcgccgctccatcggccggagagagagagaatagagagaggagggaggagtgaggatgacatatggggcccacgtgggtcccacgggttatattatttttggatcaaattgccacgtaagcgccacgtcagatgaagaccaagtcaaattagccatataggcgccacgtcggccaaaaccgccctcaaaaccgccaagggacctcatgtgcaccggttttgatagttgagggacccgttgtccggttttccagttgagggacgaaaatcagattcgttgacaagttaaaggacttattccttgcatgtgtgcatgacatggctgcccaaacttgtgacattttggcccaattaggatatggcttgtgtagcccatgagagctgtgtgcgcatgtttagtaccaccttgctagtctagcaagggtggaaccaacttataaagcatcatccctccaaccatatcactcccgggttaacccttttacatgaagcgaggacgaaagtgtaagtggattagtaaatgtaagtagacccgcccgtcggacaggctggctacacggacgtacggacagttgggtcctttgaattaggatatggcatgtgtggcccatgaaagcggtgtgcgcatgtttagtaccaccttgctagtctagcaagggtggaactaacttataagacctcatccctccaaccatatcactcccgggttaacccttttacatgaagccgaagcgagaacgaaagtaccaccttgctagtctagcaagggtggaactaacttataagacctcatccctccaaccatatcactcccgggttaacccttttacatgaagccgaagcaaccttttacatgaagccgaagcgagaacgaaagtataggtgcagtggtatgtgtaagtgggctcagttgtatgtgtaacccttttacacgaagcaagaatgaaagtgtaagtgcagtggtatgtgtaagtgggcctagtggtatgtataagtggacccgcccttacatgaagccgaagcgagaacaaaagtgtaagtgcgaagcaagaacgaaagtgtaagtgtagtggtatgtgtaagtgggcctagttgtatgtgtaagtggacccgcccttacacgaagccgaagcgagaacgaaagtgtaagtgcagtagtatgtgtaagtgggctcagtggtatgtgtaacccttttacacgaagaaagaacgaaagtgtaagtgcagtggtatgtgtaagtggacccacccgacggatggtggtatgtgtaagtgggcccagtggtatatgtaagtggacctgcctgatggatgggcttgctacgcggttctagagggagggctgtcggatgggctgatttttatctaacaaacagaactaaagatttttgaaatgaatagcttaaattgcagacaaaataggtatgtttttctgacatttatatacctgagaagtatggctacacaaataaaaatcaaaacccgaaggatggcatatgtcttggtcaatcacagttcctgaaaatattcaagtattacattgtgttctcaataaacaaaaataaagaacgaatatacaatatttatagtaaggtccttctgcaaaaacataagataaaaatcctatcttgctcaggtgcatgcgttctatttggctacaggggtttcccttgcatacatccagaactaaaagttagcaaaataaacctaataaaactacagaactactaacttgctctttctgagttagagagcttccactgtgcctgaggttaggttttgtcttggcagcttatagggctaaattaggctgttgccaccatgaagattccatccagcacgtgttggtcaagtttttattatttttattttgtggattttatgttgttatgtataactgcatgtgtgagttgtacagatataaccatgtcatacaaataaagtttttgttgtattaaaatcactgagataaagttttaatttagaaccactgagtttctgaaattgtttattgttgggtttgaaaatatttaaagtcacccatttcaaaatcttgaaataggacaatctggagtaataaactacttaccagagggaatctgtgcaacttgttcagtataattactgcaaagtgtgtgagggaaaatcctggtgtgatgccttttctggacaatcactaatgtgattggtggcagataatcctcttgtagagagaggcatgccttgaaaaggaaatagataaaatcagaaataaatttagcggacaaccagaattacacaaataaatgtgaagcatcaccttcctgatggcatctacttcatgaatgataacctggctgaattgactttcgcttattccatctctagaagcaacaatgaccagtcaaaagacatcatccaagagaatgaataaatatatcactattttgcaatgcacacctgtaaaagattatcctttcaggcttacgcctattcctctggtagaagttcatcatcagttccctacagcaatcaaaacacatgtcagattccaaatcaatcacgtgagaattaataatagaaaagtcaaaaaacgcagatagagaagatacttacctgatcatgccatcaggtttaaggcacccttttggatctcgagtagaatgaaatagacctcctataatctcctgcctttcaagttgggcagagattagctctatatgtggtgacttctggccagtcgattgatccaaccacctaaaagtatttgacaaagtaatgtattgacccacaacaaaattggagggactaatcctttcaaaaaaaaattggagggactaaggagtaaagaggttgagttcaatttcaagttctttatataatgagccaaaatgtttatttccctataagaagccatagtagtaaaacagaaacaaattctaagcaacagggaaaatcttactcctgcaatagatgacgagtacatccctggtgggggatggctaacatcagcaccaaaaatgattgtcggtatgtctgacacgaacggtattccattatgaacaaacgcttgctgaagaactgtattctgccctccaacctagttcaagatactgttgtaaataccagcagtacaatacatggaaaaatgtgtagcaaagtatcgatacatatgtaccttgacatttatcttaagggcaatattctcgaggtattttatatttgtatctgttttaacattctttggtaagcagcactgagaaaccagtccaagcttggtctcacatacacgcttaatttttcctatagaaacatgcaaaatgacacctcaaagctaacagaaagcacagagttttttagcattaataatttcataccatagttgcctctttcttccggaagaatgacaattaatagctggagttgttcttttgcagtgctgtgaatagacttcaatgcagcagctatgttcagatcattaatagaccataatggtaccaatggccactctttgaaatccttgcaaccacaaaataaagtgattgttaatgcaatatgcaacaatttgaataacttggattataaatcaatgcaggaaatagcataccattccaaggaagttgcacgtcttgatcatttaccacagaatatcttaactgttgaagcaggtacttttgaaaaatttaaacaagcccatctctcgacttttcctccatttaccaatttctgaaataacaatcaattcatactcaaaaaaatatagagcagaaaacatgcactctaacaattttgaattttaacttcaattaaagggaatatggcactttgttgcaatgaagcataggtgatatatacttatgaccctgcacactatatgatgtatggatatttatgcatttcgtgtttgttgtttgttgtggtgactgaaatgcctggttcatattcaatgtatgaaacaaatggcctccaatacttttcctccaactagctaaacagagatatgacaaatcacagatgtcctaatattaaccaaaacaaagaaatttgaagttttatcaaatgtgcctttcacttgtgtgctacttgagtatgtaattacactatatgtgagcacattacgtacatactgccatgttgaagaacaagggtaagtaataaaaaatgcaatgtacgaaataggatggcagattcacagcctaacaccataattagaaataaataatgatgcatataatcactttatgacttcacttgtctatggagtttgtagaggttaggttgagttcatgaggcttccatttcctttctcatgtcatgtgggggcgccactaccaccgcaggagcaggccggaggcacagttgcagcaagcagcatgagtcaagggtgcaaacttagaaagaatcatgcaaggaaagtattaattaggaggaaataaatgtcattccttgtattagatgccaagtgcctataaggcatgtaatcagcaacatttgaagataagcaatttgagatcaaaattcctaatctccctccttcttccctaacctccctctgttcaccattgagcgtgcagggaagaaccctgccgccgcccctgatcccggctacgaactccgtagccgcggtccggctatcctcggtgtcaatgcacttgacaacttggtatcagcttccaggcgttcctcttcccgcactgccacatcctcaccaccagccgacgcgccaccatcgccaacgccctccatttcttcagccatgtccgagcccaccgccaccgagctcgccgcgctcatcaaggcgctctcggccaacgtcgacaagctccaggcatctgtcaccacactccagcaggcgtcctcctccaccagcaagcactccggcgagcaccacaacgaccgaccgccgcgattccagaaaatggattttcccaaattcgacggcaagtccgaccctctcgccttcatcaactgttgtgaatcctactttcaccagcagcggatcgcggaggaggagaaggtttggatagcctcgtacaatctagaagacgccgcacagctatggtacacccaggtccagcaagacgagggcacaccgccatggcgtcgcttcaccgagctgctgcacctccgtttcggccctccactgcacaccaaccccctcggcgagctcatggcctgcaagcgcaccggctccgtcgtcgactaccaagacaagttggaggcactccttccgcgcgcgggcaagttgacggaggaacaacgcatccaaatcttcacggccggactgcaactgcccctcagcctcgacgtggagattcacaacccgcagacgctcgtcttcgccatgagcctcgcccgcaagctcgagctgcgcaaccagtgcgtcgctcccgccgcgcctccgcgccacaaccagcgtggcctcctgcccgcgcctccacagctgctggcactcccggcgccgccaccaccgactgcaccgtctccagcgacggtgaccgtcgagggccgcacggtcaagcgcctctcccaggcagagatggaagaacgacgtcgcctcgggctatgcttcaattgcaacgacaagttttcacgtgggcataaccgcgtctgtcagcgcctcttcctcctcgacttggccgcgcccgacgacgactacgatgacgacagcacaccagaggagacaggcgaaactgacccgcacgtctcgctccatgcgatcgccggcgtccgcttcagcgacaccatgcaagtgcacatcaacatgggcggcgccaacctcctcgccctgctcgactcgggttccacacacaagttcgtctctatggcagctgcaagtcgcaccaagctcaagctcctccctcgcggccagatgcaggtcacggtcgccaatggagaacgcgtgccgtgcccgggcctctaccgcaacacggccttctccatcgacggggagacgttccacgccgacttctttgcactgccattggcagggtagaacgtcgttctcagcacacagtggctggcgtccttgtgttgacgcgaaaaacacacactggcctgagagatctgcttagctcaagtgcaggtccaaaacttgatgagatgcgggcgtgccagtcagtttgatcttgcaactgataagatacgtaaacagtagatcaaatagccgatcggctgaaaagccgatggagcaattccagccgatgccgataccagccgatagtgatagggttttgagcaatcggctatatgtccaatgtagataataatataaaagcaatcgactgatgataataaaatataccaacaatataatccagtataaaccaatcggctagcaatacaatatgatagaataagcattgatctgaaggttaaagcatacatcggctggaggtccgatgtcataaaatccaaaagattagattaaacagtgaaacctttgttgcgatcggctaaacccaacttgtgtgtaatccttataagccgatgcaacgtccatataacttatcggctagaaccccgataaaacattagcatgaacctatcggcttagcaagacttatattatcaacaacaatctagtagatcgaacctaaccgatgcagcacgagattgtatatgataatataatactcgatgagccgatagatctgtctaatgtgatggatataacaaatctatttagaatagcattgtgattgtagagatatatcggctaagacagaagatcggacctaaccgagacagtcccaactaaaccgatgcgtctctaaacacaatggaattagagataaacttgagatatcaggaaggcaaatcaatcaaccaaatcagagcgatccaagagatcagagcgatgcagccttgaacgatgccgatgtagatgacagattcaccagggcccgatggaacgtaggacttaccccttcgccggagatcgaaagccgatgcagccccgcgtcaggtgcccaaattccgccggttgataagtaaaaacctcagggaagagggtggcgatgcgccgagagtagttatattgatcgagattgatagattgcatagaccccgggtgtacatatttatatccatgggttgatacaagtccttgtcggacaagaaagaaactatcctaaagataaaaggaaaacatgaagtccttatcggacactaaacacactttcctaaagataaaaggaaactaacaaactatttctaattaatagataaactgccatgccgcatcttccttaaactcgtagtcttctagataagcttccttcgattgatccgactccaccaagaacacgatagcatggcgacttgacaactcccatcagctgtttctagagctctgaaaccgatagtgactttcagccgatgatgactttgggcttaccaaatttcgtcgttaacaccttgggaccgatcttgtgggatttcggctccctctccatgtccttttggcggcatgaccatcgtgtgtgctggcacggcgtggcaggctccgctactccctcgctgaaagccgtcgcgggccaagacatcatggcagcactgcttgacgagttcactgccgtcttcgccgagcccaagggaatgcctacaccgcgctcaagggaccactacatcaaccttttccccggctcctcaccggtcgccgtccggccctaccgctaccccgcctcccacaaggacgagttggaacgtcaatgttccgacatgttgacacaagggctgatacgacggagtacatcggcgttctcgtcaccagttcttcttgtcaagaaagccgacggctcatggcggttttgtgtcgactaccgcgccctcaacaccattacgatcaaggacgcataccccatccccgtggtcgacgagctccttgacgagttacatggcgcccgcttcttcacgaagctcgacctccgctccggctaccaccaagtacggatgaacgccgccgacatcgccaaaaccgcgttccgcacacatgacggcctgtacgagttcatggtcatgcctttcgggctttgcaacgcccccgctaccttccaagccctcatgaacgacgttcttcgaccgttcctacgccacttcgtcctcgtcttcttcgacgacatcttcatctacagcgactcatgggcggctcatctcgggcatgtgcgcaccgtcctcgacaccctccatcagcaccgcctcttcgtcaagcgctccaagtgcgatttcggcgtcacctccataagctaccttggccacgtcatctccgacaccagcgtcgccatagatccggccaaggttcaagccgtctccgactggccgcagccacactcggcccgcgcggtgcgagggttcctcggcttggcaggctactactgcaagttcgtcaaggatttcagcacgatcgcggcgcctctcaccgctctgctgcgcaaggaggggttcttatggtccgatgaggcggcagctgccttcaacgtcctcaagtcagccattacctccgcaccggtccttgccctccccgacttcgccaaaccgttcgtcgtcgagtgcgacgcttccacccatgggttcggtgcagtactcctgcaagaccaccatcctgtggctttcttcagccatccagtggcaccacgacacagctccttggcggcatatgaaagggaattgatcggcctcgtcctcaccattcgccattggagaccatacctatggggctgccgttttcttgtccgaactgatcatttcagtcttaaattcttgcttgatcagcgtttggcaaccatcccccaacttcattgggtgggcaagctcctcggcttcgacttcacggtagagtacaaggccggtgctagcaacacggtggctgacgccctttcacggcgcgacaccgatgagaccatgctcctcgccatctccgggcctcggttcgacttcatcgactacttgcgccaagcccacgactccgatcccacactggtggcactcagggaggagctgcaggccaaccagcgtagggccccatgggccttgatcgacgacatggtgacgttcgacggccgcctctacatttcgccggcttcaccacttctccaggaaatactcactgcgatacatgctgatggccatgagggtatacagcgcactctccatcgactacgccgcgacttccactcaccaaaccatcgctcaatcgtccaggaccatgttcgtgcgtgaatcacttgccaacgctacaagtccgaacatctgcatctggcgggcctcctccttccgcttccggtaccaacagcggtttgggcggacatcggccttgatttcatcgaggcgctgccccgcgtcagcggcaagtcagtgatcctaacggtggtggatcgcttcagcaagtactgccacttcatcccactggtgcacccgtactcggcggaatcggtggcccaagcattcttcaccgagattgttcgtctccatggcgtgccgcagtccatggtctcggatagggacctggtgttcacctccctgttttggaaggagctcatgcgtctcatcggcgccaagttacacatgacgtcggccttccacccgcaatt

SEQ ID NO: 63878 - DNA, 14822 bp, Oryza sativa
aggggctcagcgtgtgttttctgagctctcatactcttccgtgtgcgccaagtttcccttgttcagcctaatggccgagcaagcaaaggcgcacgacctctctccgagtgtgagcggcgacgacgggagccaaacccgcgccatcgagctcgtactcccccacctcctccgcgccaaagtcctaagcggggggaggcgctcgagagggttgaaaaacccatagcatcaccagtcgcaggtgatgcaggagagcggcgagacggggagcgtcgcctcctcgtctacggtgacggcagcacgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccaccaccaggacctccggcgccgccaccaccggctctgtgtcatcaaggcggagggcgcggcgagcggcggctgctgcacgccatttggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtaaggaccagccctccgtgcccccggttggtggtgttggctgtagagcctttgtggcgagtcttcggaatgttcgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacttttgaccagaccgaccacccaccgtgcgttgcccggggagggcagattgcgatggtggtttcccccaccatctgcaatgtgaagttgggacgtgtcctcatagatggaggagcggctctcaacattctttcccccgcggcctttgatgctatcaaggccccggggatggtgctccggccgtcccaaccgattatcggtgtgacaccggggcacacatggccattaggtcacatcgacctaccggtcacctttggtggatcagccaacttccgcacggagcgggtgaacttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactcaggttaccatcagattcgcatggctagggaggatgaggagaaaactgcgttcattacccccataggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccctaagtagttagtgcagcgttggttgtggagcgcgatgaagacaatcctcatttcgtgcacccccattctgtgctaacttggcccgggagcgagcggggaggagaggcccccgagtcggacggtggcctacggcccctgacgaccggagtcggccctctgcccgcttgtcagacggtgctagatgcccccgaccctcaggagggccccaaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgcaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagagaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctcccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccaaacccgtggaacatcgaacaccttcgtcgcttctacccctgagggggggggtcgggtgtcaggtttcgggctcaggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccctggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtcctcactgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcttccagcgccatccatggggagaagccggggtccctggcctggtaactcgctaacacgagttccaccgctccttggtcgaggtccctcgaggatgacttgatggtcttctcgagctcctcggggagttgttggacagcccaggccatcctcctaaggtgcggggcgaggccttccagattggaggagcgcgaaattgtctggcctttccagaggcccgcttcccgaccggcgcgatccagccgggagactgcatcccaaagcatgccgggccctatctcacccaacaagcggagagcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcttccagtgccatggcacgggcctcaagggcctcttcgcgccgccgggacgccgcttcagcctccgttgctcgctgctctcgggcagcggcggcgtcaaggaccccctgggcggcgtcgagctttttctttagctccgcctcccagctctcgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgcctgaagacgcactgagctcggggatgtcccccggacccgtttggtcctgagcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgagtggcttcttcagcctgacgagcccgggcggcctcctcccgagcagcttcttcggcttggcgagcccgggcggcctcctcccgagcggtatcctccgcctgccgaacccgagcggcctcccgggcggcctcttcagcttcccgaaggcgatctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacctgcttttgggataaaagaaagacggtcgcaaagagagcgggacgaacctgcgagggggtcggttaaatgaccaccttggaggggaaattaggtttccccgggatggttctgtctcccccatcttgcgcagccgcttcttcttgcgctccccctcgggctgcgatgtcggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcgcgatctgggtcgctgcagagggggaggataccgtgggggatgagggacgcctccacggagttgagatttagcacccgttggatcagtatcttgaagtcctcgggggcccaatcccatctgactccctggtgggtcctcatatagtcttcgggcccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccgacgcccgccagctggaggcctgcaccgggggctggctcggaagtcggaggcgcgcttcgttggcaaggggggtgtagaaccagtcgcttttccaatcgtcccacttcttgcggagggcgcaggggatgtagcggttcaacaccggcccccgcggctggaagtagcaaccaccgaccaccgacggcggcgataccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcaaaggggaggaagaagatggaccgccccgggtaatctggtgctgggcgcgcctcgcccagcatcactatctcccggccagtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagtttagggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgtgcgttaattacgctcgccgaccgaagcgacgttaccatatctccagacgaaacgaatctgcacgcccagattcgagcgctgctcaagtgatgtggcagtcttgaagagaccgcccatgactgacggccaagacaccgttaccgatatgcgtggtttgagaccgttgggtttttgcccaatcacggagaccggtcccacctgtcaccgggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatgacacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaagggaagggtacatgtggtatccccttaagatataaaaggaggaccatgcccacaaagagaggggactggattctcccgggagaggagagggctggttgatattttgtaacttgctcttacacagatccaccaaaaacacaggagtagggtattacgcttcccagcggcccgaacctgtaaacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcactcaccaaaacaaatcttgtaatagatttaatgattcaaaattacgtgaaacttatatacaagttacactatagttacatgcaagttacagtgtaattacatataagttacagtgtaattacactacgattgtactataattacatctgtcaaattttcagaagaaaatttatcgacaaatgtataggtggtcccattatggcttagtgggccgaattttttttatttatacatttttttattaaaatatttaaaaaacaattttttgtttcaaaaacttgcaaatcttgtcgcttctcgtcctctaggagggcgatttttaaaaatcgccctaccagagagcgataagggacctaaatacaaatttttcagcataggttgtagctctatgattttacaatttaaaattatattatataaagtcagatgaaataaaactttatatcaaaattgtagatctcgaggagctctacaactttgtagttaacaactttttcatttaagatcttttagatataaaatattcgttacaaaatataaaacctattttaaaaaatctcagatctacatttgaaatgacatcggatggagataaactttatacaaaagttgtagatctttccatttaaaatcatttagagtattgaataagcattattcgtttttaaggaattaaagctggtgagaagggtttgaacacaaataaaaaatttgcatttaggtcccctatcgccctctggaagagcgatttttaaaaatctcccttccaaagggcgagaggcgactagatttgtaaattttcaaaacaaaaaaatattttttgtaaatattttaataaaaaaatgtaaaaataaaaaaattcggccttaaagcacatactttatccgtcccataaaaaataaatctataattggatatgatatattttaatactataaatctaaatatatgtatatccagattcgtactattagacagggagtaagtccatcctgctttcatcctatcggctagctgacggagaattatttcgctaaaaaagaaaaaaagcggatggagaactggtgacctttgctgacgacgtcgtggcgacaagcaatggcacacgcacgggccggacgtacgcgtttgttacagcaaacggccaatagacggttcttcaatctgctaccttctgtccggtagaagcagaggaatgaagaagtagaatgctatctcggctgtggtgattcgcgtgtaccgtgtatcacagcagccctgcagcgacattgataatgacgggtgtataccgtgtatagaagtgatccctatgtagtttgtacagaagttatccatggaatggcttttatttcaaaagagaattgttctgaatatcgatacaacgcatcacactttccattaaaaaaagatacaacgcatcactcttaaattcttaattatattcaaaagcaaaacacggagggtttgtggtagagatatactccctccgtttcaaaatatttgacaccgttgactttttagtacgtgtttgaccattcgtcttattcaaaaaaatttaactaattatttattcttttcatatcatttgattcattgttaaatatactttcatttacacatatagttttacatatttcacaattttttttaataagacgaacggtcaaatatgtgctaaaaagttaacggtgtcaaacgaagggagtatatcttagctcactgtcttggcataacaatgtcgagtgcgattgcgacgacgaaggtgacggagatgagtacagggaacaatgtcctcctaatatccatcaaaggtcccgtgaatagagactccaagaattctagtaagctcgacggtcgatcgtgtatgttgatgagtcctctccaccctgctcgtcgccatatcgttttccaaagcccaagacagaatggaccccagatgcccgggaaacagaagaggactgcagctgaagacaccatatagacgaagatgacaagtccacggttggccgagccgagcacaaggtgaaacccgagcgcgaacgtgccgatcaggaactgagctccccacggcaccaacccagatgccagtaagctgtaccaccaacgatggccgcgtggaatctcctttgcgctaccgtatataaggaagctggttgccacgatggagcagaggaaggccatggtgtctgtcacgacaaatgctcggaatgcaaaccggctcgccagtattgctgtcccggcatgcgggcggtcgtcggcgatgaagcccccagggacagtgaaagctgccgcgaatgccactgtggcgatcagaaccgacccaatcgttccgtttcttgtcatgtaatcttcttcgtcgtctaaagcgggtgcaggttcgtcgacaataatgtgagcagcgcgatgatttagagaaagtggtgctctcacccagcacagacagttatgcactaatacgcgcggatcctgtgaaaaaaaagggtaatataggagcattgtcaaataaattggtactcactccgttttaagttataagacgttttaactttaatcaatatcaaactgctttaaatttgaccaagtttatagaaaaaactaacatttttaacccaagacaaatttattatgaatatatattcaattattgatttgatgaaactaatttattattataaatattactatatttgtctataaacttaagtcaaagtcaaaacgtcttataacctaaaacagaggactaatatataaaaagcaccaaatataagcccaaaggaaacaaatgacggaggtcgggtaacctatgaccagcaccagaaattggaaaccaattaaccagctagccgccttcaatacttgataccccacgctttgccgtggaatatatgaaagaatgcatattatatattatagaaatgatatatgtccatgtttaaataatataaaaatgatatatgaagataatgatttgacattaactgcatattgagttctaaaaaatacaat

SEQ ID NO: 63879 - DNA, 46101 bp, Oryza sativa
tgatggacttttggcattgtttaatgtgtggaatatgtgatggactatgtgatggacttttggcattgtgatttgtgcaattggaacttgttttagtctgtacgaatctgtgaattgtgatttgaattgcgaactgtgaattggtacatttgtgcaatatggatctacaatttgcagggaggcagagggcggcgccaaccaccctggcgccgaggttgagaagggcagcgccagccagtgccgcgtggcagaagggtttcgggctgggggagggcggcgccagctacccaggcgccgtggtccatgagggcggcgccagccgaggcccggaggcagaagggcttcgatgggtggaggaggggggcgccagccaccctggcgccgcggtcggggggggcgccagccgttgcctggaggcagaacagacttggcgaaaatttgggggggggagaaagttggtggggcccgtagaggaggggcgcgccagccatgctggcgccgttctatgaggagcggcgccactttggctggcgcccccttcggcctagtcagcacctccacgacagccctattgccacggtggcacgggcacggcgccagtgtggctggcgccgctatgttggggtacggcgccagccactctggcgtcccgaaaaggaccatttccggtttaagttttcccaggggtctatttataaaataagttttcaaaaaggaccaaattgtaaaaatttcaggtagaggcggcgacgtcggttttcaccacgctatggcccgcaagacatgtaaagttgtcaacacgcttgtgcggttttgggccgaattgaaggcgacctgctggttgggcgcccaagctacagaataaggaataagttcacttgatgaccctcaaaagtgatcggaatataatccatgagcctaaaccgcaaaatcggatatctcgaccctcaaactattaaaaccggtgcaatttgactcccttggcggttttagagggcggtttcgctgacgtgacggtattgacctagtctgtgtgctgacgtggcgcttagatagcatttcaattaaaaagatatacgtgggacccgtttgtcattcacacacacaattgtggattccactgacatgtgggccccacatgccatcttatccgtttcttcttcctcccctcctcccttctctatttctctccctctcccctacagccgtccgcggggagcgagcggcggcgggcgggggctgaagcagcggcggacggcgggagctgaagtggcggcggcggaggtaggctggagtccatgtcgtgccgctgccaccaccacccgcaccacccgacggccgacatcgagatgtcgtcggcggccgagctcccctcagaacccgagagattctgcgggtgtcgcggcggctggcggagactgcggcgagcggctgcggctgcacggagtcccgagcggcggaggcgcaggtgtggagcggcggcctacgagcagcgcaacggagacgcgggtgtggcggtggcgacctgcaggtcgagcagggcgcggccgagctcgccgtaccccgccgcgtgtgcctcccgccgccgccgctgtggtctcctccatcttcaccgtggtggagctcagcccgggcgccgccgccgcccgcaggcgatcagctacaccgtccgctccggccgcctcgacgcgctcgcgctgctcctccttctcgcagcggatataccccatggtgaacgaagacgcgcagtatggcgacgagctccgggccgtgtgcccgccggacgcggaggagacggcgtgggtgcacctagaccacggcacgccgggggagctcgacagccagtgctacgtacaggaacgtgctcgccgggaaggtggtggctattcaactcggatcactggacgctgatcagcgaagcggcgacaaggcagatggtcgaggacaacgcggtgaacctgtcagcccctttgcttgttggcttgccgcttgatgttagtacacacatgcactgcctgttgctaccgcttgtgcttgctagccgcagtccagccagtcctcatctgtcgccccttgccgattgcctcagcaaccagcaggagaatgctcgacgcagatgcctcccaactcgcgtgtggtcgcgtcgttgtcggccggctcagcacgccgaccgcgtccatcggcggcggcggggcctcccccgctcgcgccgctcctcccgcctttaacgcagccgccgtcgcaggtgcaggagaagccaccgccggatgccgccatcttcgaggggatgccgacgcgagtcgcggtggcgagacgcaagcggcccttacgcgttcgtgggcgcggcgggagaacggcggaggcgggtgcgtcgtggccggcaaagagggcgtggagcatagtggtggatagtacagtcacggggctgagggtggcgaggacgcggccattctcgtggcccgttttcttccttccgacggccaaccttccacggcagtctcgatatccgccgccgccgctccggccctcgcccgcacgccgctgtcgccgctccagtgccactcccaggtctccgccgccgctggccaccgtcccacactcgcggagagaaagagagaggggaggatatgatttatgtgggccccacatgtcagtgggtcccacctatacttttggtgaatgacaaatgggtcccacgtatattttttttatttctaatgccacctaagcgccacgtcaacaccatgtggacagaagaccgagtcaatactgacatgtaagcgccacgtcagcgaaactgtcctccaaaaccaccaagggagtcaaattgcaccggttttaagagttgggggtcgagatatccggttttgtggtttagggtcatggattagatttcgatcacttttgagggtcataaagtgaacttattccacagaataaacctagcccaaacatgcaaacaattgtacaggtggcctcaaatgaaaaaaagaagggagggggggaatttataccttaattagtccgttccatcgtgccaccttggtcaatataaatgcttgttcagtttattaccacttttaaccttatcattttttatgttatcaaatttggtactctctccatctacttttgatagtcatatttcatcttgacacacagaccaaggataaataattctacttatcatctatttaaatatgctactagtcattcctcgtaaacaagcgattcattaatatttacatttctcaatacccatgtagccaatcatgtgttgaagaatggagagtcacgcattaaatttaaaaaaatcattaagatgataggttgttggattgaaatatgcctatcaaaaataaaatttttagatttgaaaatatgactatcaaaagtagatggagggagtaataccataaactaaacactcttcttcattgtcaccttaccaaattttgatatttctaaaagtttcttccaataagagaactttcaaaatttggtaagttacaaactgaaaacattcaacaataccaactttgatgacaccaaagtgtgccaatatttggcaatgtcaaatcttagtgagattgattttgacaacgagctgaactaagctaagaacgcaagcaaattaggtattaactgacagctccataagtaactcgaaaagataatgaaataagtcagagctttaattttgtcttgtgtttcttcagaaaaataaactagcactcgactaagctaagaacgcaagcaaattactatgtaaaaaaaggacaagtccccctaagaaaacaggcacctacttatgtgctcgagttaaacgacatatttgaagactatttcctccgttctaaaatataagacacagccactcttaacccaaagaccaagaaacaattattatcatcttctagtttgaatcaccataataaatactcactccatctacttttgatagtcatatttcatcttggcacacagaccaaggataaataattctacttatcatccatttaaacatgctactagtcattcctcgtaaacaaatgattcattaatatttatatttctcgatgcctatgtagccaatcttgtgtagaagaatgaagagtcacacattaaatccgagaaagtaattaagatgataggttgttggattgaaatatgcctatcaaaaataaatttttcagatttagaaatatgactatcaaaaatagatggagggagtataatacatgcatccaatagaattagaggtcttgatggtagaggattaaaaaagtaataatttaacggagaagaggttctaattaattgtatgcatgcatgcatgccttatattatggaacatccaaaaaagtagttgtgccttatattatggaacgtagggagtactacatgatagattttcctggacaccacccattttgtttccatgcggtccgaaactgaaaccgcatggaaaaatggggggacgagcaccgggctattgcccgcacgtcttaacccgactgcacgggataatcctcgttatcccgtgctgtcgacttaagagaaccgtacggaaaaatcgattttcgcgtgcaggcttttaagtggactgtacggaaaagtagatggagagtatggacgaccaggatggatagaagtacgtatgtatatagtatacaactccctctatctactcgtgatagtcatatttctaaatttaaaaaaaatatttttgataggcatatttcaattcaacaacctatcatcttaatgattttctcgaatttaatgcatgactcttcattcttccatacaagattggctacatggacatcgagaaatgtaaatattgatgaatcgtttgtttgcgatgaatgactagtagcatatttaaatagatgataagtagaattacttagggcagtcctaacccataacactagacatggtttccataaactccacatcatcaagaaactagtactagacactactcttccaatgcaaacaccactattccatacttcaatttaatgctacttatctcacatgatgccttggatgttatgtagaaaccatgtctcatgctagatatagtttccttatctttcctcatttattcacttgccacgtcattttttttcctaggtggcaacttatttaattgctatggacaccatcctatttattggattgggaatgtacttatccttggtttgtgtgccaagataaaatataactatcaaaagtaacgaagagagtatatttatatgagtagtacacaagtctagtcttggtactagctggcgagccttgtgcatttgttgcttaattatctcgggaagggaaagagttggggaggtgagaactgagaattgaaggaaggcagagcaggggagtcggtagctagtttttacggtgaagaagatgaaacgatactccggtaattgatccttgattaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctccttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattctataggaattgtatatatatggtttggaaaactcaaatccttttaatcaaaaggccaaataaaaaaaattctataaaatttcaattatatgaaattcctctgtaaatcatttacttcaaagaggctctaaatttcttttatgtttcaagccaattcaaatgattttttttggaataataattcaaaggaattttgtaggatttccaaaatttcttcaagtaccctgtgttccaagggatatttgtttggataatagggtttagacatgttaaattcctacataagtttaaacggcaacatacttaattaccacaaaaacttattacacggcaccttattacacatgaccatggatgtactagcatataaccacgtcgcctaaacaccgtgaattactagcccacacagattcacagccaaacaagagtaatctaagcatgaactccatcacaaatccctccttaattagcaaggcgattactcactcaaccaaacgccacacacgaaccagcaagccaacgccagcgagcggcggacgtcggcggcggcggataccatttcttccctacaggaaagcggcggcggccgccttggcgcccaccgtgcgcaggaggtggaagtagagcttggggttcgccaggaacgccgcgcgggagatgacgtagccggcggcgcccggcgcgttcatgatggcgccgccgactgccgccgtgggccagaggaagtaggcggccacggcggccccgccgacggccagcgccgacttccccacgccctgctccttcacgaagccgacccccgcggcgaggcccggcttggccgccgccgccacggtggaggccacggccgccaccgcgctcttggcggagttgagcaggccgccgacgaactcgctcacgccaaccatattctgctaagcaaaccaaaacgacagtaataaagtaaagtagtattagctaccgaggtgaggactgagtagtggagtcttccgttgcttatgtagaaggccatggctacagtaatatagtaaacttctataaagttgcaacttccaaaaagaatttaaaaaaataaaaacatattcttattagaaaaatctagtacataataccagttccaacccaaaacactagacatggttttcataaactccatattattaaaaactagtactccctagacactactttctcaatgcaaacaccactctttcatacttaaatttaatgctacttatctcacatgatgttttaaatgttgtatagaaactatgtctcacgcaagacctggtttccttctcttttgtcattgccacatcatgtttcattctaggtaacaacttatttaatgctatggacatcatcctaattattgggttaggaatggcctaatatgtcacatcccatactaaccttgtatttttatgaaacgaatggagcagtcccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtactacgcatcacaagcaaagcaacagtgaaaggtcaccttgactaacaacagtgaacgacgaaatcgaaaaaggtaagaaaccaaagctgtggaaagcatgaaggtgaaatggaagtgtgacgcaagatgggattccctgattgatgtcatgtatgcttatgtcacgttatgctgctaggaaagataaccggcaacgaatctgggagttttttttggaaataatattattttaatggaaaatcgcaaaattataggtcagttagacgaaatcgcaagtttagcaccctgtcgaacggaggcagttcgaaagggtacctgtcgaactgccccagttcgatagggtacagttcgacaggtaataaaataacataaaaaaagggaaaacactgtagcgacactgtagcgacgctgcctatcgaactcccgctgttcgatacgtccatgccacgcgccctatcgaactccccctgttcgatacgtccctatcgggtactgttcaagtacttttttattttttttcttggacaactagcctgtcgaactagggcctgtcgaactgccccagttcgacaggggtacctatcgaactgccccagttcgacagggcgctaaaattgcgatttcgtctagccgacctataattttgcgattttccattaaaataatattatttttaaaaaaaattcacgaatctggtgcactcatgcacacacacaatcaggcccctccaatctagatccaaaggctagtgttcaggtgaggtaattttgcaaaaaaagcgcccgcctcttgccctggcattttgcaaaaacccccctcacgattggttttcctatcccctcatctatcagatcgtgtgtcctccgagcgcactaatccatgactcttgcgattctctttgttgaacttgttcgttctcctgcatttcctcttgccataggtgaaaacggtgattgggaaggagcttcatgtccttcctatgaggtaatccttgaacaagaccttatgtcttctcctatatgatattttttcttacaagcatacacatgtactggatactggatattgttatattcttttttttcaagggaatggtataggagctatgcaatgttcttggcttccatggtctaacttgatttactatttctagagatactacttggtcaggtgctgaagaatagttgaatgaagatggtagcaagagaatatgggaggcatctgcagtagcaggaaaactattagttgatcaggacagcttgcttgattttaatgtatctccttatatatgtacaagtgcatttctcattattgatatgcttcagcaagcactgaaaattttcactatgcatgttcacataattaaacctggtattgataattttcacacagagacttcgatggaaaaaccagcaaatttttttacattcatatcagcaagccatcataaccttttgcattcagatttcaagaatttgagagatattacattcaattcaatctgggtgaacatttttaccatgtaagaagaaagaaaaatgtgcagtccgctcaaaattcagaatggcaaacattctgaatatttctgaaaatatgtgcaaatcaaatgtgcgtcagatttgttgttattgcttggtagttggtactgccaattgttgctttgtaacaccactaagcagtagcaatgattcttatcaaaattattcttcttgcttcctcacaccacctaacagtagcaatgcttcctcagagcgatagctttcagaatggtcaggaacaggggcatcgccacatactacatctacaatcactcaacgccggagagaaagctagtgcgcgtgtgtgcaccaggatgggtactgtaaccaagagcaagtacggagttgcctccatatccactgttgatgccacctgcagtaccggtgagagagagagaggggattaaatattagggtttgcagagaacttgaaaaagagaaaaatggaatttgggaatgtgagagagcaaacctgcagcttgggttcctcaataatgtatcccagatgatcgttttgaatcagtcttgaagctttgcttagccaccaccatcgccgaggagcttcgcgtcgtcgccgccgccatcatctccgttttaactttatttaaattagactacttcaagattaactatgtttagtaatatctacaaaatcaaattagttttattatatctataattaaatatatttatcttgggataaaaatgtaactaattttttcctaaaaatttggttaaaacttagagcatattcaatatatctgtaagtaaggtccatatctagaaagtcttctccaccagcccagtagtgtgcatagatcttaatgcagaatcaacgactaggggattaactgatgaattacaaatttgcaggcgactgcacagtagcaaaagcgcaaaaaattaaactaaaaaccagaatctagattccttttagctactccctccgtcaaaaaaaaaaacctagatggggatgcccggattcgtagttttaggtgaagtcacatcctcatctaggttgattttttttagggcgggagagtatttctcgtaatctctcagacagaacctacgtattgctcgaaaagctagctagccaggatagccaggataacatagcatgtcgaacagcaatcgatcgtcgatcgatcaatgtgagcagcaccaacgcaaacacttcaactaggtggcacgattaacgtaagttcctacgaccaagcaacaagttaacaacaaagcagcgcaagacgtacgtactccatccgttttatattgtaaaacattatagcattacccacatttatatgaatgttagtgaatctagacataatatattcatagcaattctaaaaattcttataatataaaacagtggaagtaataattaaggtcgtcgattcgtcacgtcacacggcgaaggcggcggcggcggcgacgcggccggcggtgtggaggaggtggtagtagagctgcgggttggcctcgaaggccatgcgggagatgaggaggccggcgccgcccggcgccttcatcatcaccacgggcgccaccgccggccaaagcaggctcaccgccgcgccgacggccacggaggcgatggctcccacgatgtatcccacggcaaccatggcgatccccgatccctctgcactggctcggcctcggcttctgttgcttaccacttggaagttggaagagatgaggcgcgcgcgatatcggcgaccaagatggatacgtatgtactccatatataatccctccgtcctttaaaataaaccaacatgtaacctctcatatagaataataaatttggaattctggacagttctttatccaaatttgttgtattaaaatagatacaataacaaactataagccaactctaaacacatatatagataaaaagaagaaagtgaagagcagtaggctataatttatagcccgctgcagcatagaatggacgcaatatatgtattacaggtgggatcatgtatcaatagtatagtatatgtttataggtaactattatatatattggctataaaattgattatagattatttggaactattagttggctatactattaaacttgctcttaggaggggatgtatctccttctagattgggtttttttttatagagggagtagcgcacaagctgctttaccttgggaagctaagtaaggccttgtttagttccccttttttttcaaaaaatatcacattgaatctttggacacatacatgtagcattaactatagataaaacgaaaactaattgcacagtttgcatggaaatcacgagacgaatcttttaaacctaattagtcatgattagccataagtgttacagtaactcacgtgtgctactggtggattaattaggcttaataaatttgtctcgcggtttctagacaagttatgaaattagttttttcattcgtgtctgaaaacattttccgacatccgatcaaacgtccaatgaggcatctaaaaattttcttttcaccaaccaaacgcaccctaaatgacatgtgggcccggatgaattcgaatggacgtggcttgcatgccaatactcgtcaaaagcttttgacacgcggattgttctgcctaattaagggatccgatcctcatcaattggaaaagaagaaaaattctatgcacacaaccacgacatccgattctcctacgaccacggtttatgtgatgcctgtgacatatactccctccatttgatattaattgtcatataattattgaatatataagcatatattaatttaatttattccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaaccagcaagaaagacaaaaacgtaattagatgaacgatagccaatcggccgatagggccgatgacttattgtcaggacccaaccgatacgggtaaacctaattggctgtggctttatgatagtcaattagagccaaaaccctaaatatgccctattggttgtaggactgtttcttttagtttttatcaatcgttttaagacaatattatggaaatagccgatagatcaatacttagagcgaagaaagataatgtactggctaatactccaatacagacttatataaacagattaatctataaaaatataccaaataacaattgatcaccagatatgaagtttaagcggtcaatctaactcgatgtatttatataaagcaatctatctatataagaggcaattataaataaacagatcatgaaactcgcgctatcatatataccaggtaagatggactgaaaccccaatactatccttagttatgattagttccatgttagtttcaattatatgattctaagcacggctagggatgatgcatcacaaagtatgcaaagaacataaagtctagacaaaattgctacaggatatcgtgactaggcaaaatttgctataggacatcgtgacttcacggttttagctgtagtacaccgcacgaagtgacttttgggggaaaacactcccaaaagttggatatttgctagtgaacaccgcaagcattaaagtaataatttacggttagagaggagagagaaatcgtgtgaaatgtcaaaaatgcccttgggcccacatgtcaactctcctatctctcttctctctctatccctccttctcttctctctttatcccaaatgtcgtggcgacggcaggagggcgagggcggagcggccgcaacaacgggacggcaatggctccggccagcggcgcctgccgccgacggcgcccctccttcctcactccgacggcacctcctcactccagttgaagaggagagagaaatcatgtgaaatatcaaaaatgcccttgggccacacgtcagctctcctatccctctgctctctatcacctctttcacttctctcactaatctcttctctctctatcccacatgttactgacgatggtgggtaggcgaggtttggccggggcggcgggaggacgagggcggaggcagaacggacgcgaccaacggcacgcggaggagcggcagcgcggctggacgacgacggctgcagcacgcggagtgaggagggaggggcgccgctggccggagccgtcgcccgcgcgaagtgaggagagaggggcgccgtcgcccgcgcgaagtgagaagcaatttgattttgatcaaaatcaaaacgacttataatttcaaatggagtgagtacttatcggacttcgctaatatttttttttaaagtattttagttaatcagtaataaaacatactagcagtgaagcccacacaaccacccaaccagcctgagagcgtacccgtacataccaccgctcatgcatttggtacaatcttataagaatttgaagcttaatgttagtacggatggtgaaaattctataaaaatatacatgtttcaaataagaaacccttaggacttctttggatggtagaatttttcgttttttttgtatgaatcaatttaattcccatgaaattcattaaaaaaattctcaattccaacggaggctttaattcacatttcagtaatacatagagttcgactgttcgagtgatcagtagagcagcgaggtgtgtggtacaacgaggcaatggggggaaataaaattaagactccatacagcttgtaaaattaagaattattgaaaagtttggatggattttagatgagaattcgtaactattaatatcaaattttatcgctattaataaaaataaagtttgcatattgtttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgcttacggttggaaaatcgtatagtcattagaaagcacttttgaacatgaatccaacaatatcattatttatggcaaaaagaaacctaaacattatttgagatagtcagttataaggttcaaaattagacagtcaaaattcacattacatttccgagcgtacggacggaagtaaatatgcgtacacgttcggcaaatatcatccatgggccatggcgtacgtatatgctagtaagtagtactaggaaaacatttgtatatactcccttatttatatactcgtaaagaaacgtaaagaaagttgtttagtataatgtttaaatcaaacattgggaatataaatcatgaataactctaaagttgttgagtttgaaaatgtaaaaattatatgaatagatttgtcttaaaaaataattttataaaagtatacatatatcacttttaaataaatatttttatagaaacaagaagttaaagttatattttggagaccgtgtcactgtcaaaaacttcctttacgactacggagggagtatatactaccgttaccgtatggcgtacaggagtatccgagtacgtatatacggggtgtacacgtacaccgtacacgtacgtaggttcattttacacttctcgccggcggcggcgccgccgcagcagcagcagcaggcgaggcggaggcagtggagcgcgagggcgccgagcacggcggggggcacacgaccactgcggcgacgcggagccaccgccggtgtgtccgtacgtcgtctccggcggcgggtgtaagagcgtacgtctcggcttcctcggcggccgcggagaggagcaggccggccaggaagacgacgagctccgtggtcctcgccatgacgagctcccacaggcggccgaagctgtggtcggcgccggcgccggcggccacggctgcagcgccgcctggtaggagcctctcctcgccgcggtctccgggaacgccattgctgatctctcgatctcagtagtgtgaggagtgagtgtgtgagtgagtgagactgatgagacaggaaaaatatgttgggctgtaaatatagaagtatgtttatctaggcccaagaggcccatatttccatatgtacatgtatatgttcagttgatagagtaatgaaaaagaagtgaagcttccagagaaaacaaacacaaaaaacttcatggtatcagagcaggtcgccggtgacctcgccgacgctgaacccaagctggcggcggcgcggaccagcgtggcacggcgaggcggcacggatcggctgccgccgaggagccaggtggtggcaagggagctgagctgggcgtggatcgtcggcgtaggatccggctgcggcgctgtgaccggaggagcggcggcggcggcgtcgacgacaggggtcgccagagctcgaagggaggaaggagacggctgctgcagctgcagcagaggcagcgacggcagaggaagccgacgtggtggaagtgctgagggcaccgggcgtgcacttgctggctgagttgcggcaggaggcccgtgcggtaggaaggagagagaaaaggagaagtaggagaaggagaggaaatctgcagctgaggatttggtgctgttgctgcgctgagaagaaaaggagaagcttgtgctgtagcggttgcaaggaaaaagagaggaaagctgaggatttggtgctagtggtgctgcagttctggtttgctgctgctgttgttctgctgaagtagtgttgctgctactctgacctgagagaaactgggaagtggtgctattgctgtgttttcttcttcaaattgaggtaatcagtgttgttcttgttgctgctacttgattaaaatggggaaaaatcagggacttgaacaagtgatgggtaaattggtggacatgcttgcaaagaaacttagtgaggccccaactacaagtaatgcagtggttcctcatactgaaacaatgcaaaaaattgagttgatgcaaaatgacattaagttggagggtgttaaaaattatttgagttggtcaaaaagagctttattgatcttgaaaacaaagggattagaagaatatgttacaagggagataaaggagcctgagagcacttcaaatgttgagtggaagacttggagtactaccaactcttcagtagtagcgtggttgttgacttcacttattcctgctattgctacaactgttgagaccatatctagtgcaagtgagatgtggaaaactctcaccaatctctactcaggagaaggaaatgtaatgctaatggtggaggcacaagagaagataagtgctatgagacagggggagcgttctgttgcagaatatgttgcagaactgaagcatctatggtctgatttggatcattatgatcctcttgggttagagcaccccgattgtatagcaaaaaatgaggaaatggattgagcgcagaagggtcattgagttcttgaagggcctaaattcagagtttgaagggagaagggatgcaatgtttcatcaaaccactcttcctaccttggatgaggctattgcagctatggcacaggaggagcttaagaagaaagtattgcctagtgtcacaccatcttcaccaagtgccacatatgtagttgcacaaagtaaagagactagggagtgcttcaattgtggtgaaatggggcaccttatgcgtgattgccgtgctcctcgcaagcctagttatgggagaggaagatttggtgacaggggtggagcaagaggtggaagaggttatgcaggtagaggtaacagaggtaggggttatgagtatagaggtgatcacagagctaatgtggtcactcttgaagagggttcttctggacctacaaatgttgatgttgccaaccttgttcattctacctcaggtaattcaaaccaagcatttatgtctatcaatagctctcattcaaattggatacttgactcgggtgcatctagacatgtcacgggtatgtgtggagaatttgcatcatataaaccatacccatttacacgaaaagaaacaattcaaactgctgatggaacatcatgctcagttaagggagagggtacagtacagtgtactcctttaatcactttatcatcagtgttatatgtcccttcttttccagtgaatttggtttcaataagttctcttgttgatcatatggattgtcagatctcccttgatcgtgagaattgtttaattcaggagaggcaaatagggaagaaacttgggattggcgtcaggcgtgatggactttggtatttggatcaaaaggagacaagtgaagatgtatgtcttgcattgatggcttctacaagtgaagaagaggctaaggtattacttttgcattgtcgactagggcatatatcttttgaaactatgagtaagatgttcccaacagaactaagtagagtggataaacataagttagtatgtgatgcatgcgagtatggaaaacatacaagaacatcatatgtgagtagaggactccgaagtatgttaccatttatgctaattcacttagatgtttggacttcacctgtggtctctatgagtggaatgaagtattttgttacctttattgattgctactctcgcatgacatggttatatcttatgaggcataaggatgaggtgcttaaatgcttccaggatttctatgcatacattaaaaatcattttaatgctcgggttcagtttattagaactgataatggaggggagtatatgaacaatgaatttagtagctttctttcatcagaaggaatattgcatcaaacttcttgtcctgatactcctccacaaaatggagtagctgagaggaaaaaccgtcatcttttggagacagctcgatcattgatgtatactatgaatgtacctaaattcttgtggagtgaggcagtaatgacagcaacttatcttatcaaccgcacaccatcaaggatactcggaatgaagacaccatgtgagatgatatttggaaagaataaatttggtgttccaccaaaagtgtttggttgcacttgttttgttagagatcatagaccttccattggaaaacttgatcctcgggctgtcaaatgcatctttgtaggctattcatcttgccagaaggggtataagtgttggagtccattagaacgacgaacctttgtaagtatggatgttacttttagagaatatgtcccattctatggtgagaagacagatttaagttctttattcattgatcttgatgattcaactagtggttatgatggtcaacaaatggaaggtgaaatattgggtccaaagggagatgaacaatcaaagaaggaaaagcttgtgattggttcaattccatgtcctataggtggtcctgttgcacaggagcaagaatggaggaagccacatgaagaggaaaatcttcaagtatacacaaggagagcaaggtgtccagtaatacaacaagttgaagaggataatcaggtagaggaagatgtaagtcatgagcaagggtctttggagtcagggggagaagatgaagaagttagagaaaaaggatctgacatgccaattgctgtcagaaaaggtgtaaggagcaatgcaggtaaacatccactaaggtatggttttgaagatcaacatgaaggtgatgatgagaataacatatccaactatgtttcttatgactctttgtcatctacatataaggcctttgtagcatcactagactcaatgcaaattccaaaggattggagagaagcaaagcaagattcaaggtggcatcaagctatgctagatgagctagaggctcttgaaaagaacaaaacatgagatcttgtaccatttcctgaagggaagaaagttgtcaattgtaagtgggtatacacaataaagcaaaaccctgatggaaaggtggaaagatacaaagcaaggcttgtggttaagggatatagtcaaacatatggaattgattatgatgaaacttttgcaccagtagcaaagatgagcacggtaagaactcttatatcttgtgcaactaatcttgactggccattgcatcagctagatgtcaagaatgcctttttacatggagaccttcaggaagaggtatatggatatcccacctggatttgctacctcacaaactaaaggaaaagtgttgagattgaagaaatctttgtatggtctcaaacagtcaccgagagcatggtttgatcgttttagacgtgcaatgtgtggtatgggctataagcaatgtaatggcgatcatacagtattctattgccataagggatgtcacactactattcttgctgtgtatgtggatgatatgattatcacatgggatgattctatagagatagcaagattgaaagaaaatctaagtaaggaatttgaagtcaaggatttgggtcagtaggcatcgagattgcaagatcccctagagggatagtactttcacaacgaaagtatgcattgaatctgctcagtgacacaggtatgcttagttgtcgaccggcctctacaccaattgagcaaaatcttaagctttgtgctgagtcgggagatccagtgaataaggagagatatcaaagacttgtagggcggctgatatatttatgtcacacaaggccggatataacttatgcagtaagtgtggtaagtcgatacatgcatgaccctagaagtggtcacatggatgccgtgtataggatcttgagatatttgaaaggtagtcctggcaaaggcttgtggtttaagagaagtggtcatcttagtttggaaggctattgtgatgcagattgggctagcagtcttgatgatagaaggtcaacctctgggtattgtgtatttgttggtggcaatttggtgtcttggaggagtaaaaaacaacctgtggtttctcgctcaacagctgaagcagaatatagggcaatgtcggtgggtctgagtgagatgttatggttgaggaatcttctatgtgagttgaagttgttgaagaatacttgcatgaagctatggtgtgacaataagtcagctatcaatattgccaacaatcctgttcaacatgatcgaacaaaacatatagagatagatcgtttctttataaaggaaaaactagatgagggaatgttgaagctagactttgtaatatctggagaacaaatagcggattgtctaacaaaggctttaggtgttgcagagtgtttgtctatgtgtaacaagatgggcatgatagatatctatcgcccatcttgagggggagtgttgggctgtaaatgtagaagtatgtctatctaggcccaagaggcacatatatccatatgtacatgtatatgttcagttgatagagtaatgaaaaagaagtgaagcttccagagaaaacaaacacaaaaaacttcaaaatatactcctagacaagttgagaatttatcctagaggatgctaattgataagattcgcaagagtacgagttgtactatatgcaaaatcaataaagcaaccacaagtattactactccatccgttctattttaagtgcaatcataagtttagttttcgtgtccaactttaattgtccgtcttatttaaatttttttaataattagtattttgttgttatgagataataaaacatgaatattactttacatgtgacttatgtttttattttttaaaaaaattaaataagacgaacggtcaaaatcatgcacggaaaatcatgaccgcacttaaaatggaacagagggagtacaaagtaaagccatttgttcagaggaaaatatgtaaaatctgtcattcagaaaagatcgaatactagtactgtgctcttcccgactcacatccttctttttccgcgacgtacgctatttaaattgctaaaaagtatttttctaaaaaaagtttctatatcaaagttgttttaaaaattcatattaattaaaattttaagtttttttggctaatatttgatcaatcacgtgttaataaacaacattgtttccgtgcgttaatgaactccacctcgggaactcagccttagcattaacctgctatggaacaatactccctccgtcccataaaaagagcattcttagcatcccaatgcaaatttagtgaggagtaaagacaactaaaatgtcccttattatttaaaaaaaaatagtaatgatgatagatatgtaaacggtatttaagggataaaacttctcgttttacgtgctgaaaataggcaggacagtagaagttgattttttttgacaaaatttaaacttcagaaattgagttttttttaagatggagtatatgagaagagattttttttccttgagattcggacaagatgacagtgatacagtttgaaacagagctgacaaacctcttccctttcagttaagggtttaaggcatctgacatcagatttcagataaccacttccctttcagtcaagggtttaaggcatctgacatcagatttcagataaccaggaagcgttttgattctcctctctaaaaaaaaagttctgaatcctactcttttaatccttgaaaaggcggtggcgctgttcgttttcttacatctgaagaacagatgaaaggaaatcacagcaggtgagacaagttaaaccacatctccgtcgattgcatacagagcacaacgacgagaggaaacatacacggctctacaatctcggaccaaggactactcatcgatcagagagaaaaaaaaatgcagcagatatgcaaagatcgttacaagacagatatagaacagagaagctcaaggcgtcattaaccctatgaagctttgacaagatacattacattaatatatattggctatgccgaatgccgatatatcaatatcgctggaagatggattgcacaacagtggctgccttagttggaagaaacatgttgatgttggccattgagtggagtgacgtttgagatcaacagatgccttcatgtgtgacttgtccggagcatccatggcggaagcttgctgttgcctgcttgtgccggagacggttgagcttctgactcccctgatcctcttggttggctttgactgaattaagatgaggaaaaacagcataactaaaacagacaatggagttgatgaaatagtagtaacatgctagatcattcctaacgtcaagttattgttcagacatgatatatcaagctgagaccaaaccatttggaggctttttcactgtttggttcaggcgctttcaggcctgggcttatttgttccaaacttccaatagccatatgaaatagaccggcagcatttgattgaacaaatttcaccggattaagtttcctaggcatagaccatcaaaaactactgaactgtgatagataatggaagtctgataaaagaaaaaatatagaataaaaatttgctgaagaacaaaacagagttttgttttatttatggtgagtgcaggggcaaaatatatggaagtaaaagcggtacctgttatttgttgtcgggatgggatctggagccgtcactggtgttggtgatgatgtgcttggtgttgctccattttgctcctcccggttagtgtttattatagcattgtttttctccttttctgtctccatgagctgctccgaagaatgtagacaaaagggtttgacctccaatacagcttttgtagtgatctgatataaaacattgttgtaaacaagaatgaaatttaccttttgcagaacattattctggtttttaagtgacttttcctgcagacaggaagatagcagattgtaagaatattcatcagcacgaacctatatcaacttcgtccatttctcagcacaatattaacatggctctgttgccacttgccagatcagatacagtaacaatcagtagtgcaggtccttttttttccctatgtttatgcatacattattgcgtaaaaggctaacggtcaagtccttgccatatgcatcgaagatttattttcccgtagaatgttcaattttacaacgtagtctgacttagtctgttctctctcccctagaatatatacattgatggcgactttcctgttatacccatttgacaacattgtgcatttcccacaatatgaccaagacaagtggcttctcgttagttccttaggtgattcaaattgactaatgatttcttcttataatggaatttctagaattgccaaaagacatgttttacatgaatatattctggtagaaggcaagaagagttagttgtctgaaaattgtttgaatgcaactttaatactccaaaacaatatggtataaacagactgctacattgctatttaaggagccacattgagggtaacctaccttcttctgaagctcagaaattgattcaaacagaagctgattctgcaaaagaaaaacaaaaaggaaagtaatgatgttttcaaagattagttggaaataattaaatcaagcaaatttgatccctcagtcaacagtgcataatggacacaaatttcaccttttttgatcttatatgcttcagagaatattccagttgatgttccaattgctggagttcttttattgttagtgtgtccaattgttcacctaagagttgccttgagcagtagatagaccaactcaagttagcataatcttgttaccaaagtgaaaatttcttaagaaagtttgcagtacctttggctcttctgaagtgcatccagtttggacttcaaaattccatattcatcaccccagttttcctaggagaaaatgaatatcaagatcagataactaaccagctagttaaataaacagccggagatagttctccaacagtcagggatgtttttttacctggtcctcagtatttggctccagtacggctctttcatcaaacgagtaacgctggtagcgttcaaggatcccttccatactacagaagaagtatcacatgattatgctttggtttgaccaatgcatcaaaagatgatgccaagcatagtcttagagcaatatcaaacaaatgcacagttataatttttgtaccctcaataattcttaaggcttgtcaggtgacaactacaaaagtaggatccattattcaaattatccatgtataaatttaaatcataactgctacaaaaattatgcatcagaaatagcactttgaaaaacatttgtatttgttggctgaaactttatccattcatgttcttcgtcgtaagtttatatctaattagaatgattaaaaaaaggattatctggccttaataacattagtacatatggtgaatccacattactcccttcgttaacaaataaaagtcgttttgaaatgtgtaatcaaatctcaacatcaactcactggagaatggattctaaactctcaagggaacatcccctcgttttttgcatgtcatctaaatggttatgatttttttaaaaaaaaatcgacaagatagattaatatgtgatagattacttcacaaacatgcaagttcaaattcaacttctacaagttacaacaaaaaaaaattaaactatggctagttaatgtatattcacggtcaaatttaattttttcattgcaacttgtagaatttgaatttgtccttgcatgtttgtggagtgatttatcacatattaatctatcttgtttattttttttcaatttttttcacaaccgtttggataacatgcagataatgaggggatgtcccctcgagagtttagaatagttcccaactcggtgtataaaaataacattcatagattcataattgaataatgtagttatattttaactattttatgagtagatgatcatacaaagaaagatgtgtgttagggataatgtcaatatcctagacaagaaataaaaaaaggaacagaaggagtatttggtagcatagaagtagcttgaccttaatactaacacaataatgagagagtattgttgcctatccaaaaattttgcaaatttgaaattatatttatcacaaaaggcatcatttaggtcccttttttcccttacgagctactgatattatgctccctccatttcataatacttggtgattttaagttcgcattgttttagtttggccattccaattttataaataaacttttagtattagattatgtaacatattattaaagtatgttacatggtaatggtaaatatagagatataaatcccatccatcataatcataaattttaaaagatattaatggttaaactgaagcaatcaccggtcaaaattgccaaatattatgaaataatagagtataggaataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgcatggcagcagcagcagcagcatgccagcatcacatagagagctgtaatccaggggacacaagcaacctacaactagctagacttcgcgagcaactccatcccgagctaagcagcaatcgcacgaacgaacacgtacaaagccatgaaccgtatgtgcaatcagagagcacatgagagaaatcaatcagcacgaaataatagcaatcgtacacgcaccaacaccaccagccccctcgcattccgcagcggaaacgatcgaacacaaggcaggaacccgtacgaaacgaaatcgaacgcatcaacaagccgcccaggaacggggagctccgcgagctcgcccatggcgcgcgcgcggcgaggaaaggcgacgggcatgggccgtactacgtaggtaggcgggaggtcgcggagaggaggaggaggaggaggaggagctaaacgcgtgcgtacctggagtggctggagaactcgtagagcttgcccttggtggagaagacgatgagcgcgacgtcggcgtcacagagcacggagatctcgtgcgccttcttcagcagcccgttcctccgcttggagaaggtcacctgcctgtttatcttgttctcgatccgccgcagctgcaccggccctctccccatcgtcgtcggcggcggcggcggcggcgaaggcggcggtggcggtggcgggtggagggtggagagctcggggaagatggaaatggggggaggaagagagagggagggggagggaaggcggttttagatgggggtggaatgcggtgtggccataccagggcggtttcgagtgcctcgttgtcgatttccgattggccgaggcggtttcggggcggcgtggagggatcccggccgtcggatcaggagagaggtcgttaccgcggccctggcccggtggggcccacgggccacgcggcgcgcgcgaacccgtgcacccgcgggctcgcgctcgggattggtcggtgggtcggatggggcccgcttgtctgtgactgcgggtgcggtgggctcgcgtgagggatgggtttttctttttccacaacgtaggggggtgtcgggtacaaggaaacgagacgccggatgacacgtggcgagcccacgtgtggtcgtcgaagcgggcgggtggggcccacctgccagtacaggtttttcttttattttatttttttctttttagaaattccgatacgatacgagtatttctgtttgtactactcaactccgtatagccgccaaactgtttggcaccgagtactacctagtagtacaatacacgtactgggagtaccagcgtttgtttgttggtgttgaaagatttttttttcttttttttaagagagttcgtgttgcaacaatagaaggagcggacaacaagaccgtagaaaaaggctagactttttttttttaagatactccctccggtttcattttaattgacgctttggacaatgacacgctctacaagatataccttggatcttatttttctattataatatatacaataaataaatacatgtttacttttattacagtgttttgaaagacaaatctatatatgtttttctagtttctttaaactaaatatttttaaagttattgatggtcaaagttataaaagtttaaccttaaccttgtctaaaacattaattaatatagaaccaaagggagtaatagattaactggtctccacagcccaagaaaaatgaactaccttgtggctttgtattgctatgctaccgtggttgattgcaaaattgcagataggtaaatgacctttggctacacacaggggcggagctaccatgattcctgggtattcccgggaatacccaacttttttatcaaaaaacaagtatacttttagtatatacacatgtacacatattagtgcacctaaatcctcaattcttcgatccaaacacagtccaactggcctcttgcaacgcctcctaccaacccgacccactccgtcatgacccatcagacatcagctgacccacttagccaccactcttccatacggccccctctccctctccctccgtgacccatccctccctagctcggttccctcgcgccgctccccatttccaaaccccaggtggcggcgcggcgaggcggcaaccggcggcggaagctggaccgtgctaccgcggaggggtggcgcccgccactccgccaagctcaggcggtcaggccgattgggtggccggtggccgcgaggggcaggggcagctagcggctcagcgcttagacggaaatacccaactttaaaatcctggctccgccactggctacacaaacgaatgttagccatgtctaaaaggattaccatgttaaattcatgttgaaatatttttttaaagataatggaaaataatcatggcctttaacaaacaagcgatggagccatttcaacgaaaaatatgtataaattagagcaacctttgataaacaaactatgaaaatatacatattggtttgctctcaccttccttttgttttggattatactcctctatcccaaaaataaatcaaactccagagatcaatctggacacatgtgtatccagatttttatttttattttttttgtgaggggggagggggggctacggagtgagtacacgaaagacgcgtgggcatgcagaccacactcccacatccatgaatacctcccactcccaatgctcacacacccacaaatgtgcctctcactcgcaaaccagaagcacatccctggtcccactataatgttattgaaagtacatccgtgtgtgtggaatgtttattggaaccagaatttgaaccatattagctatttctgaagtcacgtacccacgacttcaccaccacacagacgatgttttcccactactgtttgtattttccttagatcttgtgcaaaggttgcatcttgcatgagatctaggcgatttatcatctctccccttgcatatatcctccaccttatcattcaatgttacaagcaacgtggaaagattcaaggtgttttatgacatggtaggctatctcatggataaaagttatcgggactatcacttaagatgatgtggtaggagtaaaaaacaatagcgatgtcttcacacatgcagctagcatgaaaaaaatagagtaaatataatggcaccaaacgcatatacttgattagcatacttaggggtgaaaacaagtcgggccgagctaggctctgctgaaattagcatcacaagctaaaagagtagctcggcttggctcaacttcttcttgacctctagttggctcgtgagcctatgaacaaaaaatactttcagagatgaagaggagtgagaggatattggaggagccgacgagaagagtggcaactaggagtcgagaccaacaaggcgcgcgacaggtcattgggcaccagccgcaccaactttgcgagaggtgagtggcaactcgcacattgtgcttgttagcacaagctagcgacaccaaggagcagcgactttctatagtttggtcaagcagagaggcaacacgacgagttggtggaggctagagatgccttcaattggtggagtcgacatgcctacgtgcagcctcaagtatgacatgtgttgaaccgaagaaagcagtgttgtgggtaggagcatggctgagatagggaataggagacagggtgcgaggaaaggttgggaacttcggctttctttaactagattgaccactagactaataatgtgctatgagttaaatgagtgggctcgccagctagcttgggctatactcattctcgaaacgtgttgtcttatgagtgaaaccaagccatgtgagactaaatggagctcacaagttcgagatctttgtccacctctcacacaaaaactgatgagtagttgtattagtatgtgctttctgttgaaatgaaaaatgtataaggtgaattagtttgagttcttttcagcaataatgacaattttcttattttccgttatcatactttccaaatagttaaacattgtgttttgtgaaaaaaaaatatttacatattttttaaaaaaaatcaaagaactctactttttaagtttataatggctaataatcatgctctaatggttgttctagttatacgagaacatgcaacctgccttctcaaacgaagccttactcactactaaaaaatggtttttctgtcggccaaaatcagtctttgatttttgccagccttactcactactaaaaaatggttttttctgtcggccaaaatcagtctttgctgatttttgctggcagttaggttaaccgcctgaaaccaaagggtagagaaaataaacgttttcacattcggaacttaaccgccagccaaaaaacatattttcgttggcggttctgttacatgggctgctggcaacagtccatttttgcttacgtagtgttaagacgaccgccagcgaagctcttttttggttaaaaaaattgaaaatatgttaatgcatctgttctctgaccaccagcaaagaaaattaaagaaaaattgaaaattgccagatacaacaaccctgcattcccattccacattgcaaatcaaatccaagaacatgccacaaatacaagcacaaattccacaaaatataagcaaatctcaactattgaacatgcacaatcgccgatgctagatctgccctcccgatgcacgctgcacatggtcttgggcctcgccaatgaccggcttgcggcggcctcctcctcctcgcggtcactgccaccatcgaggtcgtcgtctcctccttgcccttgtcatccccgcacagatctggcaagaacgaggccggatccgcgccgatagaggtggcggcggctcgatctcgccggtggagaggggagagagctcgacaccgccaatctcgtcaccctctgtgggaaggagctcgtcacggcggtggggagggagcccgtcacggcggccggatatgatgcccacggcgcctcccgctgtctgcgctgtcgaagaaaaggaaggcaagacggggacggagttggatccggcccccgccaccgccaaactggatccagccgctgcctcctccgccacctccatgcccacatgcttcacaggctccaggcccaccgccgttgtcccctcaagcgcgccgctgcccccatgcatgagctcaccgtggacgaaccgcagccgccacccaccggtcgtctcccctccgcccagatctgggcctcctatcgcagcgcgcgggggagggggagggggaggggggaggcccggcttttgcgcgcgtcgatttcacagtcgccgcagtcgcggtccgctatcgccgtcatcttatccgccgtgtcagctgagagccgagaggtggggtgagatgaatctggagggaggtggtgaggagaagaggataagatggagtgactagtcagtggataaaatggagtccgcacttggtgttttaatatagcgaataacttcttgcggtcggcgctccttggcaaccaccagcgaaattttgattttatctagtggtcacttaagaggcccgctttaaaaagacctctatttttacaagcggttctcttatcccggccgctaacgaaaatgaattttttcgctggcagttcttagcacctcatccctcgttaaattttcgctggcggttttcgcttatagacgtcagagaaaaaaaatagataaacgccatgaaaaatcgattttctagcggtgactccctcccatcaaacaaaaagcaattctgacatagtcttaaaaatactgtttccgctaatacttcgtattgcattttttttagaaacctaataaaatcacaatttgtaaaagtactttctgagataaatctacacacgtgattttcatgtataccatctaaatatctttaagaagaaatttatgtgtaaggttgttttcgcgattgaagggtacggtgggtaattacagtcctccttccgatggaaatgccggggaacggcaacactctatattcttttatgtccttttgaatggatccatattcttggacaggtacattggatggcacatcaatattcacttggtcaaggataatacgaggtacacgatcaacatcatgatacgtactagtaccagctaaccactgcaccataattgaccgaggaaggcaccgatgagttgaagttttcaaattcctccatttcatattatatgatgatctggcttattttttcgaatcaaacatttctaatataaaacaaacatattataaatatacatttaatgctagatataataaagctattttcatgttgtttaattattctataaatttaattaaatttgaacatagttgacttataaatcaaagcgacttaatatgaaaacgaaggtagtcactccgtttcaggttacaagacgttttaactttagtcaaagtcaaactattttaagtttaactaagtttatagacaaatataataatatttataatactaaattagttccatcaaatcaataattgaatatatttccataataaatttgtcttgggttgaaaatgttactagctacttttttctacaaacctgatccaacttaaagtaaaaacgtcttttaactcgaaatgaagggagtagaacttaaaaacatgaaaaggtcggggggagaaacggccaccggcacgtgggaagaacggacgtcttccttcctcggccacacatatgcacgcacggacgccaccttgagatcacatttggagcaaagattctatacaaaagttgctacaaaagttttttacgaaaagtttctatacaaaagttgcttaaaaaatcatattaatctattatttttttaaaaaaatagctaatacttaattaatcacgcgttaatgcgaacattgtgttacgtgccgcctcctcctgaacagatcctaatccatcatcctcactccactctctctctctctttctcccgtcgacgcggaggcgccaacgccactgaccacccccatccatcaattcaatcaccaatcaatcgacggcgacgacgacaacgacgacgatggcgacgacggagacgaggacgacgacgacgtgctcgatcgcaagctagcggcggcgaatcatgagacgcccgcaatgaagtcgtcgtcgtcgtacgtcctcgtcggcgaatcatcggtcggcgaagcagctgcagctgcagcgatcgatcgatcgatcgatgtggccgtaacaacaagcggctgggagaaggacacatcgctagtccgaggctagtacttcctccgtattattttaatatatgacgccgttgacttttcgaccaacatttgaccattcgtttaattcaaattttttatgcaaatatgaaaatatttatatcatgcttaaagaacatttgatgatgaatcaaatcataataaaataaataataattacataatttttttattaagacgaatggtcaaacgttataaaaaagttaacgacgttgtacattaaaattaaaatatggaggtagtattaagctccgagctagctgctgaatgcagtgcgtgcagagagtctctgcactccgatccactgaactcatcacatgaaactgtttcacgtgtgtggctcggtttggaattattgaaccgattattaccgtatactatgcccctccatactataaaaaaaaccagcttagaattagatggggtttactccctctctattcatgctgagtaattttacagttgttgagaaggtaccatggggtactaaaaatttcgtgtaaaattcggtaccttatacgagataccaaattcataatagaaaaggtgatatctcatattagcttttaaaggacggtaaaattggtcattcatatgcatgccataaagcccggaaaaggaacggtgtcttttcttctcctctttggtcttgctgccatgcacaaatgcattgatcaaacgcatgaaaggagaaagtaacataggccttatttagttgggaaaaatttttaggtttggttatcacatcggatatacggacacacatttgaagaattaaacgtagtctaataacaaaacaaattgcaattctgccaagaaactgcgagacgaatttattaagtctaattttattaatccatcattagcaaatgtttactgtagcacaatattatcaaatcatggcgcaattaggcttaaaagattcgtctcacaatttacacgcaatctgtgtaattgttttttttccctacatttaatactccatacatgcgtccaaacattcgatgtgacagtgtgaaaatttttattttgagaactaaacagggccatagtataacaaatctgaataagaggttatctagatttattatactagctaggttatgtcttattcacatttagtttgattttctgtgaaacggactatgctttatcgtaatgataaattagatatttatagagagaaacttaatgaatgtcaacatttaatacatggtccaaaaaactgtctaaacattcatgtatttttaaagaggtgaagaaattacccaccgtataataccccgatgaagtaatggagcctggccacttgtgctgcagttgtacgaggttacattaactctatatgccaaacatgtgtttatggttccgtatttcgacgattcagaggtagatttgttgctttctccgtggcttttacgtcgttgcaggttgtgagttgtgaccactgaagctgagctcacgttcatgtctactatagtatctcagaaaaaaaaagattattttttttctcttcctatttattctaaaataaatttataaacacattggaaacagatagctagagtatagaataattctattacaatttgataaagtgagaatattatagttctttttttctattggtatgtatagaatagataaaaaatgaatttattttgtgatacagtgatgtgagagtattgctcaaacagaagacattaccaacttcgcctattttacttatgtctcactgtctcggcctcttttaagtttggacgtacctacgtctcgttttcatagacaacaactcgcaagctactgtataacagtggccgcctgattaaaatcctctgttttgtcatgttcttttgttaagataaaggattatattaacccggcctttacaccttgggggtgtacacagccaacaactgttttgtcatgttgatgtctggggataatctgctgagtttctgctgtcatagctgaaaaaagttcaggcataatgacaaatatgcacataatcgagtaaaatgagcacagtgccacagtgtaaaaactgcgtaaactcagactattcgcccaaactgtggcaaattgatagtattgtccgttcgttgctaatccgatgctaaaaaaatctcctaaatccgcggcattgtttagtggactttatgcctctacttcctctcaagtgttgaaatgatgcctctactacgtaaaatttgcgtatctttgtatcaggattcaggactggtgggtgtttggggttatatggccttgagcccttgacaagctcatggcatatgtgtgtgtgtgtgatcgagagatggagcaaatgtagcggtggaacttgtggtttgaaaattactatctccgtcctaaaatataaaaagttatcggtttggacatatgtattaaaaaaaatgtaggtgaaataaatggaaggagattatgattggttgagaaaaaaagtaagtggtgaatttgaatgatgtgtttggtttagaaagaaattattatatttttgaataagttctaaatgtaaaaaaatgttatattttgggacggaacgtgtactactcctaccacttattattattattattattattattattattattattattattattattattattattattattattattattattggcaaaaagatttacatttcttctttcttcttatggattgggatcaggtgcagtcacgactgcaactttggcagtagccactgatccaccatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattgataacttttaaagaaaatgttccattcaggaaaaaaagaaactgtaaagaaaaaacaataggattaatgcttcttagttgaacagagcatgagtcacataaaaaaaaggttaaaggagttacatcaaaatatgagctctacttcaagcccttaaaataaatgccaagcttcttttaaacatctaaataagtagtactaaatttcttgtcaaatgaaaaataattgtgctagtatttcatgttcaaatgctaaatgaggaaggaggcaattaagtctgaacgttccttactagttggatggttggattagttgctactgccaaagttagtgactgcacctgatcccaatcctcttcttatgggttactcactgttcaccataggatgctggagtaccctgcctcatgattcggcgaaaacagccaaactgtccttgtaaacgttggattgacaggctttattggtgattctcccaggcccctacctcttgcatttctgtccattcaatcaatgtatggaaaacttttcagatggggtagtactgaagtggatacctcagccagtaaattccacagccgtgagccaattggctctgattggttgagataaaggtagaaaaatgaacaaaacaatcaaaataatttacggtttaaacctttatatctatatcatgtggtttaaaagtaaacggtagtagaaaatagactaggtaaaaaaaagctaaaactgactctaaaattaaaattaagttccactccctccgtttcacaatgtaagtcattctagcattttccacattcatattgatgttaataaatttagatagatatgcatgtctagattcattaacatcaatataaatgtaggaaatgttagaatgacttacattgtaaaacgaaggaagtaaaacttaaattttagccgtgaccaccaacaaggaattaataagagccttccaagtcaataattgagagacagagtgagtgagctattggtttcgaagagtagaagtaaaagtaagttggacattatatagggcgtaatctctcaatttcaatgtataagtatttagtaatggaggtcatatcataatacttggatgatttatatccagtactaggattttatatattggcatagagggaatagaaagagaaggtgccatccaatatatatatatatatatatatatatatatatatatatatatatatatatatatatatagtaaatttgtttggtgctccatggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccggcaacggcgaattagtttttaatttttttggcacttgaaatgcaagatgcatttgtgttttaaatgacgaaatagccgataatttccaaattggaaaaggtactcctccgcaactttacagtacaggaggtgattttgaacttcaagcttcaaaataatgtgttttctttgctgtttgttcagataagcaaaaacttcagaaatgcagtcgtaggtgaaggcagttctttcttctttttacaatggggccatgtatgtgtaagtgtaaatcctatgatttctttgataaaatgattactatcgtattattatcaattccaagcaggttgcttgtgcactggagagacaaaatttaggaacagataatttaaactgacataaaattggtgcatccagggatggtttaatttttttttaatgcaagtcttatcaaggcactacaaaaaggaagcataactgcacaacaccaacaaaacacatgatgcgatatgtaaacataaccaatatctttattctaatttgaaggtgattcgatcctgacattacaactgtttcatcacaccaaaaagaaaaaaaaaattgtaaataccatagaacagccaggacggttgtccagggaggtgacacatttgaagttacaacgctgaagcgatctcagttcaatcagcactaacaaaaccaaaagtatttcggtatttcagtataagcagttcacatgaacaaacgaagtttttatactaccgccctctcacttgctcttggcagtgccgtttgcggtggcaacagctccctttggtgggttcagctgatcccaggcctcaatccatgtgaccatggagtcggcgagcttgttgaagtagccatcgaccttcccgagcttcgccctcacttgcttggccagctcaaggtaacacttctggacagtgtcggcctccttcgggagggacgcagactggaagaaggggatcagctcctcctgccagaatatgccgttgtattccttcttgaggttcacaaaggggttgctcgctttgctgtgccagatgtagggaaggccagtcttaacacccaaacccaagtgatcggtaatcacctgtttttatgacagatattagcatggattgtgattggtgagtggtgaacaatagttagcttgcacaatgcacaaattatttctgaagggggagaaagaacaaaccttggtgcaccatcctgcccacatatcgtcgtaacgaccaataggctggccatcacccataagaccaaagtacatcgcaggaccgatgaggtcacggtcaaaagcaaggttcattccacacatcgggaataaagtgcccttcgggattgtcataacagcatccacatacctgatttcatcatcaataaacaaaaacatcagattggcaagaagagaacgataaaggatgagaaatgccaaaaatgtaacatcaatacctgctgttcctctcaagaggcttgacaagctgggtaggggcatcatagtctggaatgttgagccaaagcccatgagaaacggcagtcggggcaccctcacggaggctgaaggggtacccacggacaaaatcagcgccatcacggtacgggtcatacaaagtgttgaagaaaaatggagtggaagggttcagaaggttcttgatgtgctgctcaagtgcattgatatcctttcctgatgggtctttagcaacctgagattttgcaagaggaataggtcagcaatgaaccaaaaacaaatgatagggcggaatcagagaagtattagcattacccaaaagtaacaaaacagaggactaaaataatggcatcacactccaatgctcaacttttatagtgcaaggcatgtggaagtactcagtcaactgtaagctaatcaagaaaactattgtgaagatcatactagaatgcaactaaaggacatgaaagagaacatgactatattcttatgctgtaaacaactgaggaccattcatatagttaaggttgattctacagtacatccatgcatccataagccagcctaataaaacatataaatcaaataatttaacaagcaggtgggacccttgtggctcatgtgccccatgtgaatacacatggcatttgctttgggggaagaagctacaacacaaccgctgaatacatccaacagtattttttttccttgtagaagtaaaacaaaaataggaatacagtcgagataaccttcatgtacctttatgttaattcctacaaaatttgtgttccactggctcttaactgataactagtgaccgaggcttaatgatgtcatagtccatcacatgtgatttagatggattgtttggtcctgtctaacttcagattaacgtttttgtataaaggaatcaatcataattaaatacaaatctggaaaatgatgtgtagccaataacaaagccaagatgaccccaaaccaaagtggacataccattcagtccaaaagacaccattaacttgaccctttctctactgtttctacattgatatgttctgaagaaaagactactgataacggcctcgagcataaacaaagtaatataagcgtacatatgcattaacacaaccgacaaagcacagcggcaggacgatatatccgagccacattgtcgcgtactaacaatttctgaatactacaaacctgtggggcaccacagatatacatataacctattccagctcacatcccctccaaccgcaaccgcaacctatacatgaccaccaagcaagtgtagctagatccaatgcttgatgcttccaagcagtgggccaagtcaaacgttcaatccaagacaaagcaaacactgtcagatctgataatggcagactacatgcatgattccaaggattaaggagttactaccttttcaactaggcagatcaatcagtcatccgcaacatgtgaaattcacattcaacctacccacatcacagcactatgcagtagtaatagtagtagtatgatgtaatgcaaaaattaaagggtttttttatcactactaaactaaactgtcctaacaaaaagaactactaatctcgcaaaactgaagctaaactcaaaaatctaactacggggcaatgccgattgctgacgaagaaacagcccagagatctcgcctttcccccactaaaactacacatccagatccgatccccaccaaaccaagatctaaaatccccgcacacagatcacgccatggcagtggagaaagatcgcccaagatccagcggccatcaaccagcagatcaaaccttaacagagacagatctcactgaggcgaagttaatcgaggggtggaagggggaaagaagctcacgaagcagtcgtcgtcgatggtgtagatgtacttcttcttggagaccatgtagccgaagcagcggcaggcggagtccttgaaggagatgcaggaggccctggggccgaggatccggttgatgtcgtcgcggttgtagagctcgtagtcgaagccctcgggcacccggatcgtcttcttggggtcgcagtcctggacgatgatgaggtggtacgcctgaaagaaggacctccacatctccaggaagtccaggttgcggatcgtcgggatcacgatgtccagctcgtccttcagcagcggcgtcgccgcctgcgcggccgcggcgtcggaggaagccattgccggtggcggaggaggaggtagaggtggaggtggaggtggaggtcggggggagtgaggcgagacaggcgggtataaaagggagggagacgagggggtgggccggatgggccgtggtgggcctcttttttgttgggctttgcgtgtacaggaagggaagggagctgtgtgagtgtgagtgtgagtgtgggtggtccgttgttggagttggtgctttgcttgacttattatcactactactggggcatggactgatttgcatggccatggacatggtgcctaccaacaacatctgggatggttggctcaagaggggaagatatggtaacggctacgggtaaaaagggtcgaaatcggtagaatctcttcggaaacgatgctcgatcagccggtaattgaccatatctatcatttaaactactcagtatcgacattaatacgatgtagaaagaaattagaaaaaacaaaatttaaaaatagccaaaaacggtacagtcggaaactgtaccccttaaacggaaacggcgcccggtcgatcgggaatttccgtccgttttcatccctagtaacggcgatgttcttttcaacttatttatttatcggattaatggaatagattatttgtttcatgttttcaaaaagagtaaattaatacgtagtgtaggaacttggcaggtggatgtgatttagtgtaacaaattgaaaaatatgcagaccggtacatgaacttggcaattaagtgcattttggtcaataacattgttgcgtacgtatgattcaacatttcaacttattttgtttgttctcattataagcataattgctaggttattggtcataagtacgttttgcgttgttcatcaccgcagacaatcaaatatgtttgattagtccgatcactcgggaaactatgttacaacagtttttatgcagttagtttttacaatcattatatttttcggtttcaaatcaagaggttattttattattataaacaaacaaatacaatacatctaggctattattttgagagtcattatacttgttagattgcaatgacaactgcttgcttttacgtggcttaaaaagttagccacgatatatggtcgcatgatcaaatgttagccaagaaaaaaatgctgcaaatttgtgatatactcttccttcaatttttatatcatttcgtttaccctcttggacggacagccagtcgttctaagttctaagttctaacggcccttttgccactctagaatgcgtgctagagacaccaaaaccagtcagaaaaacgtctttgagtacgagctgcgcgcgattacttgaagattacacacgcaaatacgcctttccacatcgtacgccatggaccttagctacagctacacgcacatcaccatactattatttacttaattgtaaagatgaattgaatattttgaaaataaaattaaaatcaatggtctaaataatatacagtagaataaagttttttttaaaaaaaaaagaacataaagtgtgaagcactgaagcaaacaatttgtttcaattaaagctagtgaattttgatgcctgcaatataggagtagatggtgtgatcatctgtcacgctcgtacgaaagaaaggacgtacgtttcagcttatatggatggtctcctctctccatgtgagctgcaaggaaaacaaaaccggtaacatatcaatgcctaacagaaaatgatggctgctagaacgtacgcattagtactagtacatcaactaatcgccttttttgaaaataaagaaagaaaaagatcaatgctgacagagtacttacctgatcaaatcggtaattttagttagtttatatccagggtgagcaatgagcgtctttcattttcagtactacttcttccgtccataaaaaaaaatcaagggcttcatcttttctcgcttatgcttatacttatcagctaaaatttgaattttcaattttaaatttagaggtgattttgaggtttttttatcgaagtttatttttcagactttgcttttatatcgctaagaacacgtatataaaattttattcacaaattacttttcgtttgtaaatatgccatttctcttattccgcgaataagccaaatgatggctccgcaaatcttgactataaatctagataaatgtttgtccagatgcatagtcaggatttaaccctttttgacgaaagtagtggaatattccctctgtctcaaaaaaaagcacaacctagataaggatgcgacatctcctaatacaatgaatctggatatgttatagctgccatttcttcatcccaaggaatgaaaatgaaactttttagagatccaaggtatacagaggagacttttgagtgtttatacagatacaataatgagttgacgagacacacgacattgtgattctctcgagatgctcgtctctttgcctgcctcgcacgtcggccggtgatcgatcgccggtgatttgcctcttgcagtccgcactgtacttacaccggcaaagtattttcttttcacgaacac

SEQ ID NO: 63880 - DNA, 88329 bp, Oryza sativa
  unsure (1)..(88329): unsure at all n locations
cctctgtttctgttcgtcacgtcctctgcttgggtttcgtcgaatgcctgggatgcgtgactgttaatttggtcctctttgtgtgttcagtggtggtgattgtatcagggcggcgatcggtgggcgagccgacgctggacgtctctgagatgctgctccaggcggcgcaggcatggagaagccggcgcacgcagcgggaagctcgcccggacgcgcttccacctcgccatcctcctcgtcccgtcgccgcggatgggcgcgggggctcaggcgaggggaccagtagagcgcgggggcgcggcgaggaggggacggctcgtggcggagatggcgagatgatggcgctggtgagaacagtggatgtggccgtggccggtggtttggccacgctcacgcacggcggcgagcgggatgctggcgcggcggtggcgacggaggagaagagaaatggcggcgaggtggggacgaagagggggatggaggagcgggccgcgcgttcgccgccgccgcccaagcggagcgcggtgtcctccgttcgccagcttcctccaggttgcggaagggacgccgctcttccactcgggcgccgccacggccgcggccgcgatggcgacggtggtgttcctcctctcgctggcaacagaactgatttgccgttggaagctgtggtggatggtggtgatccaattgcaaatgtgcatcaaatcttcagcaaatcttcgcatgctacggatgagaatcaggtcgcttgcaaagttggttcactggaggatgttgtacaagaaggggcagcaaatagtggtgaattgctggggtggaagcaagtgttagctcaagccgcgaatgtgcttcccaagaggaggatggtatccgcgacgcgccgcttccctcctggatgtgggagggacgttaagactggttcaggtttggaattcatggctgttgatgcttcttgtggtggtgtgtcaaaggaggtggtggcttcggatggcggtgatagtttggttagccaggaattggaggagggtgaggtggctgatgaggcatactctgatgtagattcacaaaatgttgctgtggatgattccatggctgcagctactgaagatgttaaggtgatgaacaaatgcaaagggaccttacccagagccgctgctgaaccttgtgctgagggtccttccaaagaacattttaagggtacgagggagtgtgaaaatgataggatgggaaaatcatccatgaatgttgcaacagaagtatttggtgattgtatgatgagaagtaagatactattgacagctagaaaagcagtcaagtcaccactgaacattctgcatagacgtcccttctctaagggaaaagaggagtgtgttgtaacaaatagtgctccatgtggtcctaagaagaagttgaaggtaaaaggtgcatatcaaactaaagatattcctatcaagattgtctctacacctggattagggggcaaggacaaccttgtcgacaaagaggctttgatcttggaagatgatgatattttgaaggcactagctgttcatgatggaacacttaagttgtatctcaatgcttcctcatctgtgcagcatcacgggcaacatggaagtgggaatgctgatgataggaggaaaaccatgatgctgtgcaggaggtttcagtttatacgccaggctcttgtacaagctgtcaaacagggctcgttgaaggttctaagagctgaccttgaagctgataaaatcgttcggaaattgccgggctttatcaaacctggacctattgtgggaaatgttcgtgttgtcgaagttggtgacgaatttctatacagagttgagctagcccttgttggtctccaccgtccataccagggaggaatcgataccgccgatcataatggagtgcttgttgctataagcatcgttgcttctggaggttatcccgatagattgtcaagttcaggtgaactcatatacactggttctggaggacagcctgctggtaagaagaaaagtgaggatcaaaagctagagaggggaaatcttgccttgaagaattgcatcaagacaaagacacctgtccgagtgattcatggattcaaaggccaaaatggcaaggatgacagttattcaagggctaaacaaatctcagcatttacttatgatgggttgtatcgtgtggtggattactggagagaaggtctaaaaggttctatggtcttcaaatacagactacaaagaattcatgctggtcgatgaggttgatcatctaaatcttttctagtaagcttattatttagtcttaacaaatgattcaggcagtaaatggtacaatgagattcttttctacaccatggatacttacgccaatctaaactctcttgcttgttaggtacagaatcaagatgtattttttttgtcctgggtgatataattagcttagaaggacaagaagttacatgggcctggttgaaggtatgttatagttgcagggtatctaaaggggacattttactgtacccctattggttatggtagtagtgtagtaggaagcagatcatctaaagctatggctattttagtcatgtacttcgttaaggtgaaggggcaatttagtcttccgattatcccaatcgaagcaaaacaggactcgttggtttgttagatcggcccaagcctcattctgcatctcgacgcacgacggccaaaccacagcgccgtccatatttgtatgcattttccagaggtatctttgcgataacaaccatgcaatcttagatatatttgtgaaaagaaaaaagtgcatgcattggaatataaccgtttcttgccttgtgcaaaagctaccacttctccttcagtgtgtacttggatcatagaaggtgacaccttcaaaatgcaccagacaagatgccagtaacaagaacatgagtatgtggattggattgtcaatcaccaaaacccctgaattcagctgtgcaccacagctgccgtgggttagctcgtataagagtgtgcccaaatatgaaaatcacactcatgaaaatcaaaatcatttctattaacaagatgcagtaaaatcatgacaacatcctgaagaaaatttggttagctgatagaagtcatagaacaaaatgtatttcaaaatatattccatcactgatttcaatttcaggagcccaatttttgtactaactatttaactgtaggaaagcttactataaaccaatgaaaaaaagaaagcattatatgatgacttgtctgaattacagaatatgtggcgtagttgtccacttacaaatgaattcatcaactaattgatctcaaggttattccagattgtagataggagcacatctcaagcttcaattaaaaatccatccaaaatacgaattgaaggacaaaagtgaccagaattaggaatgcatactctaatactctattctcaggagtcaggacagttagataacctgctggctgttgtgctggtagccttggcattttcaccttcacgtgtcaataaaaaagagtaaatatgactttcgtggagaattgcttgagtacagtgtacactggatgggatcacctatacatttgtcgacaaattctcttctaaaaatttgacaaatgaaattataggacaattgtgatgtaggctgtgtttagtttacaccaaaattggaagtttggttgaaattggaacgatgtgacgaaaaagttagaagtttgtgtgtgtaaagttttgatgtgatagaaaagttggaagtttgaagaattattttggaactaaacacggtggtaatttcactgtaactattataacttgtatgtaacttttaaaagtttcttcgtagtatactatttcggtgaaacggaagtcgtgggaacgaatcctctgacatatgtgtgtgttatttttttccttcctcacttgcacaaatcttgaaacaaatctaacggtccaaaattatgtgaaagttatgtataagttagactgtagttacatgcaagttacagtataattacatgtaagttacattataattacattacgattgttctgtattacatctgccaaatttttaggagaaaatttatcgacaaatgtatagcaaaattgttttgtaatatattgattagaaaattctcaatctcactcttcatagtatggttttgaatctcaagggtgatgttttccggtggcgaaaatgggcgtgaagtgtcgctcgaactcctggaaggggtgagagtcgaagcactagaacacatgcgcaagtacacggaaggcacttcggcaacctataacaagaaggttcgaccgatagaactccggcccggccatctcgtactatcctaacctatatttttccttcaaatttaaaatcgggtataggtagtgccggatcggataacatgtcacttgtgccgtatcacattccatattaatttctcgaaatcggatacatgaaagaatttctatgtgcaattcatgcatattaaatatagaggggcaattaaagtaccaaaagagataaagcaagaaaacatttatgtaatattacctatgatattataaactagtgtaatcaatattttatcatgtttgtaggtgaacttataacagattttcatatatgtataataataatatgggaatacgagtggacacaacttttcccttattaaaacatatcttttacgaatttggattcgaacttggatagtatcgaatatccattttctctcccatgttcttgtgagcctcaggccaggcaggtggtcggaaaatgcccgtcccattttcgcccgtagtaagaactagaaaaaaaaatctgaatttacccctgaactattgacaccatccgagtaaccccataaattacaaaaccagacatatctacgcccctaaacttttcaaaccagacaacaaaacccctaactcaatccgaagcggtttggattttaggtgacatacatgtgttagtccaaacaacaaaaagtaataaaaaaatagtgggctcggtcagtctccctcctcgctttcgtccacttccatctctctctctctacccccaagtcctaacagaaaggagggaggtggcggaagctcagctgccggaggaagaccgtggcaaaggaggcgtcctcgggcatcgaggtgcatcatgacctcccgtggaggcggcggaggcgctagctagcacagagcacttgacgactttggtcttgcatcgatgcctcgacgcacgcgcgactgcttctaggatagatggtgatgtgctcgaaaatggctcaccaaagccatgatcttgatcacttggtggatctggaaggagcacattgtgcgtatcttcggcagagttcagcgccatggtgttgcagacctagtctagtgtgtggcggtagctattagcggtttaagaaccttgaggcggtcttgctttaagcggtatgagatggtcttaccttggcaaaactagtttcctgagattttatattctaaaatccttttaaaatctaacaaaatttagacggcgtccttcgaccgctcagtgaaaaaaactaaaaattatggtcgaagttttagaattggaccaaaattatctaaaacataaccaagtgagtacaaaatctattaggaaaacaagaggagtgttactatccctaaatagtatggtctccgtttcatattataagttgtttttattttttttctagtcaaacacttttggtttgatcaactttatagaaaaatatagtaacatctgcaacactaatttagtttaactaaatataatattaaatatattttggtaatatgtttgtcttgcgtaaactggatcaaacttaaacgactaagagcaggtacaataacagactataagccagctataaatatattttaaggagataaaagaggaaagataagagcagcgggctacagatttatagctagctacaacacagactccaagacacatgtgtgtatgatagatgagaccatatattgattgtgtagtatatgtttatatgtacttcctccgtttcaggttataagatattttgattttggccaaagtcaaatagctttaagtttaaccaaatttgtagaaaaaggtagtaacatttttaacacaagacaaatttattatgaaaatatattcaattattgatttgatgaaactaatttaatattataaatattattatattttctataaacttaatgaaacttaaaataatttgactttaaccaaagttaaaacgttttataatctaaaacggagggattaactattgtataaattggctattaagttaattattaatgatttagagccaatagtttactataccattaaacttgcactaatgatatcatgaaatgaaacggcgggagtagcagcagccgtttcagcagctaccatcgtagaacagcatcattgccacaataatgcccactaccagtctactaatttacgccgcagtaaatactcctactccaatgcaaacctcaccggtactatataaaacgagaaggcgccaggcgggttgcaagcaaacacacgacccacccgtcgttgggtcagccacgtgcaccgcgaccgagccggaccagtttggtctcggacagtcggacccgagtcaaccttcagcctctggtgcggcgtccgcccgccacgtgtcctcgcctcaccaatcatcacccatccttctcttctcggccccaccaactctctctctctctctctctctcgctgctcgcgcaaaaaccccaactgcgtcgccgtgctcgccgcctcgccgcctcggcctcgccgcgcgctctctcgccgccggtgtctggacgacgaggaggtgagtccgtacgcctcgcctctgtgttgttcttcgtgttcgctgcttcggttcgtcgtgttgtgatgtgatggcgtgttggatgatgtgtgtaacggctaatttggtgcgggttttttgggcttggtggtggtggtggtggtgatttgcagggcgggtggcggcgggggatggatcgctgggaggcgttgatcgccgccgccgcgcggcggagcgagccgccgagaagcgggtgggcggagtggggcgggggcgggggcggcgacgctcgcgcgacggcgattccgtctcgctgtcctcctcgtcctcgtcccgtggctgcgggtgggagaggcggggggggtgatagaatgcgggggcgaggcggtgaggaggggacgtggaagagtcatggtggagggggacgaggtgcggagcgcgcgggcgcggtggtggcgccgccgagggcagcggacgcggcggggacggggacggggacggggaggaacgcggtggccgtcaacggtggtgcggcggaggatggtaggaggacgcctctgtttctgttcgtcacctcctctgcttgggtttcgtcgaatgcctgggatgcgtgactgttaatttggtcctctttgtgttcagtggtggtgattgcatcagggcggcgatcggtgggcgagccgacgctggacgtctcggagatgctgctccaggcggcggagacatggagaagccggcgcacgcagcgcgaagcccgcccggacgcgcttccacctcgtcccgtcgccgcggatgggcgaggcggctcaggcgaggggaccagtagagcgcgggggcgcggcgaggaggggatgactcaagtggccgtggccggtggtttggccacgctcacgcacggcggcgagcgggatcctggcgcggcggtggcgacggaggagaagagaaatggcggcgaggtggggacgaagaaggggttggaggagcgggccgcgcgttcgccgccgccgctgccgccgcccaagcggagggcggtgtcggccgttcgccagtttcctccaggttgcggaagggacgccgctgttccactcgggcgccgccacggccgcggccgcaatgccgacggtggtgttcgtccgttggatcaggcgactgctcctcctctcgctggcagcaaaactgatttgccgttggaagctgtggtggatggtggtgatccaattgcaaatgtgcatcaaatcttcacatgcttcggatgagaatcaggtcgctcacaaacttggttcactgaaaaacggtgtacaagaaggggcagcaaatagtggtgaattgctggggaggaagcaagtgatggctcaagccgcgaatgtgcttccaaagaggaggatggtacccgtgacgcgctgcttccctcctggatgtgggagggacgttaagactggttcaggtttggaattcatggctgttgatgcttcttgtggtggtgtgtcaaaggaggtggtggcttcggatggcggtgatagtttggttagccaggaattggaggagggtgaggtggctgaggaggcatactctgatgtagattcacaaaatgttgctgtggatgattccatggctgcagctactgaagatgttaaggtgatgaacaaatgcaaagggaccttacccagagccgctgctgaaccttgtgctgagggtccttccaaagaacattttaagggtacgagggagtgtgaaaatgataggatgggaaaatcatccatgaatgttgcaacagaagtatttggtgattgtatgatgagaagtaagataccattgatagctagaaaagcagtcaagtcaccactgaacattctgcatagacgtcccttctctaagggaaaagaggagtgtgttgtaacaaatagtgctccatgtggtcctaagaagaagttgaaggtaaaaggtgcatatcaaactaaagatattcctatcaagattgtctctacacctggattagggggcaaggacaaccttgtcgacaaagaggctttgatcttggaagatgatgatattttgaaggcactagctgttcatgatggaaaacttaagttgtatctcaatgcttcctcatctgtgcagcgtcacgggcaacatggaagtgggaatgctgatgataggaggaaaaccatgatgctgtgcaggaggtttcagtttatacgccaggctcttgtacaagctgtcaaacagggctcgttgaaggttctaagagctgaccttgaagctgataaaatcgttcggaaattgccgagctttatcaaacctggacctattgtgggaaatgttcgtgttgtcgaagttggtgacgaatttctatacagagtttagctagcccttgttggtctccaccgtccataccagggaggaatcgataccgccgatcataatggagtgcttgttgctataagcatcgttgcttctggaggttatcctgatagattgtcaagttcaggtgaactaatatacactggttctggaggacagcctactggtaagaagaaaagtgaggatcaaaagctagagaggggaaatcttgccttgaagaattgcatcaagacaaagacacctgtccgagtgatccatggattcaaaggtcaaaatggcaaggatgacagttattcaagggctaaacaaatctcagcatttacttatgacgggttgtatcatgtggtggattactggagagaaggtctaaaaggttctatggtcttcaaatacagactacaaagaattcatgcttatagatgaggtcgatcgtctaaatcttttctagtttgcttattgttaagtcttaacaaatgattcagacggtaaatggtagaatgatattcttttctacaccatggatgcttacgccaatctaaactctcttgcttgttaggtacagaatcaagatgtattttttgtcctgggtggtataattagcttagaaggacgagaagtggcatgggcctggttgaaggtatgttatagttgtggggtaatctaaaggggacattttactgtacccctacttgttatggtagtagtgtagttggaagcagatcttagtcctttacttcgttataaggtggaggggcaatttagtctgttccgattatcccaatcgaagcaaaacaagccttgttggtttgttagatcagcccaagcctcattctacctctcgacgcacgatggccacgccacagcgcgtccatatttttatgcatttttcagagatacctttgggataacaaccatgtaatgttagatacatttgtaaaaaaaagaagtgcatgcattggaatataaccgtttcttgccttgtgcaaaagttaccactttttcctgcagtgtgattggatcatagaatgtgacacattcaaaatgcaccagttttgtttgtagcagtattcagatcaatcatggatcgctgatacgtgagatcaagcaaatagacaagatgccagtaacaagaacatgatatggattggattgtcaatcaccacaacccctgaattcagctgtgcaccacagctgccgtgggttagcccgtataagagtgtgcccaaataacaacagcaagccaatacaactaattttggtaaataacctaatcaaataactataggcctaaaacaggtccacccacactcccacaggatgtcaggattatcatgtgttttagcaatttatcttccagggactgaattggcacaaaactgaacaagaacaaaacatataggatgtgagaattaacatgtgttctgtacttcatttttcaaggacagaacaagtgcaataataaataagaacaccattttttcttctagcttgatgactgataattctcaaaggcaatgcatttttatcttcatgatgataaaccaactgtttcatttgaaaagtgacaaataaattgctttcagcttcatgaactcttctggtcttcctccatatcaccttcaccatacattaaataaaattagagtggacaaactgctaatccaaaagtactgtatatacaagatcctcaaggtcaagtcacactcctgaaagtaaaaatcatttctgttaacaagatgcagtaaaatcatggcaacatcctgaagaaaacttggctagctgatagaagtcattgaacaaaatgtatttcaaaatatattccatcactgatttcaatttcagcagcccaatatttttactaactatttaactgcaggaaagcgtactataaaccactgaaaaaggaaagcattatatgatgacttatctgaattacagaatatgtggcgtagttgtccacttacaaatgaattcatcaactaattgatgaaaaatccatccaaaatacgaattaggacaaaattgaccagaattagcggacatcgaggacaaataataaaaaggaatgcatactctactctcaggagttaggatagttagataacctgctggctgttgtgctggtaacgttggcattttcaccttcatgtaggatcgaatagaaagaactaagccaaccaaagagagtgagtaaatggttagtatacctaaaaacccaaactttttgcggaattaaaagttactctcaaatcgatgtagatcggtctgaccgaagttgatccgccggtctaaccggtgtagatctcccagttggaccgccctgaaatcgcctctgtctcctgaagccgtcgccggtctgaccgccgtatacccgccagtttgaccgccgcgatgccaccggtctgaccgccggtgtctcgccggttagaccgccgaacctgagcaaacacaaatcaaagaattctcgaagtagatgacaactttattacttctctctgtgtttacaaagtgcaacaacagcactcctcacgaaaatcttggctaaattcgaaaccctaactcaactctcaactcaatgctcttaaaagcgataccgggaagcctcacgctccctctctatttatacatgaagtaggcagcctaaagccactaatcaaactcatactagaagtcctaatccacctaaccttcccgtacaagaaacaaactttacaaactccaatcataccaaatttggactccttcaaaattcaactccgtatcccatacgcacacaatatctccattgtatgccatatggaatcttcaccaaccatgtgtattgatctttagcctaagtattccacatgatatctgactgtccggacgtcatcttatctccaagtcgactcccgatccatcaccggcaatactctcctgaggcatcaagtcacctacacatgaatcaaacaaagaaaccatattccaataccaagctatctccaatttgactcattgttagcaaacaacagtattacatacgcatagtatccatctagaagccataaacaagaaacaatcacggatatccaaacaaacaacctgaaaccgaagccgacacagagtcggccggtcagaccgcgggctggctggtctgaccggcaaccactgcccggtctgaccggaccaactatccagcagcacctgtaaatccaatcatctccaaaaccactttgccaataatctccaaatatcaaaaccgataatcacagatgccaattgttcatcacagaataaagaatcaaaaacactttgattttacacttcacatgttaataaataagaataaatgtgaattccgtggagaattgcttgagtacagcgtatactgaatgaagtaaaatacatgagttaactttgtaacccccccccccctccccccctcttctcctcccacgcccattttctgtcgaagtaaatccaccagtggatgtactgtaacctccacaattctaagcacagaattatgccaccacgggtccaaaggtatgatgcaattttagaaatttaatgtggcgcagaatacaataggtctatccaaaatctgtatagaggagggctcataagcagatacatgttaggatagggaattacaatgtatgttgtcatcagaatgcatcagcatggtaactatattatctaccatccccaaagtagcaaacatttatagggatgataacacggatacagtctggatagttcaactttgtgtaatatcttggttagaatattctcaatctcactcttcgtagtgtggttttgaatccgattccctcaggtgaagtttcaattaatcagtcaataagagtagtatatttgattattggctttcacacacatcaaacaaatcaacaataatagagtggcacatcaaataaatcttgtagaagaacagaagattgagggcttcgaagtgttgtgagggcttcgaagttcaatcattccaccaaatgccaatacatattaagtgtccatatcaatatgaataaattatttagaatttacacatagctatgtcaaatcaaatttgttaaagttcatgatttgaatttgaaaaatacatggtatagctctgtgtaaatttcaaataattcactcatattatttaggagaagaacacacccttagctggtagatcctagctttgttccctccctgttcaccttataggatcgaacacaaaaaaaccaagcctaccagagagggatgaatggtacgaatatcaagaacaaaaacttttagcggaaacaaaagtttatcctctaacctgatgaagtccttggcatagccggtctaaccactgtatgcacaccggttagaccgctcatctacgttggttgtctcatgccagcaatagaagcagagtcagctccccctacctatgctattgcctcctcctcgacctccctgcatcatccccacctctcatcccacatgagcatcatcgttttttgtcaagccgagcagcatcgctacctccttgccgagccgaactatgtcgcccgccttctctcttggcctctccttatcaatgccactacctctctatcgagacaagctgctctactgcctctaggtctagtcctgatctgcgtacctagtgatctcgagctcagaagattccaaactcaacgtcgtttggcttgacttcattgcattcttcctagcaccacatcagttttgacctcgcccacctcctcccaaaactccatgggcagcaacaacagagagagagagaggcaaggagaactgatctttgtagtcagaacaccgtcgaggcaagtcttcgtcactagagaattgaagaaaagccaaggtagtggtggagaagagggcagggcaacgttgtcctagagacactaaaaatcccaagttcacctgtcttgtttaactagggaaggctggaaaggcatatattagagagtcaaaatagaaagtttattggagcacaagaatgagggaatcttttggcatggatggttaaatggagatttggatagccaaatttgatatctcttggagatgatgactgttatctcacttagaagatagtatatgcaatatgttagctctaggtgcaagtaattttattttattcattttaaactactctttttctttccttccctttttttatgcataagtcatcaacctctccttcagtaaaatatatttatctaaaatgttctacacctacaattacgttgataactagccattatgcaactaaaataggggcaactccttacatgtcaccaagcatgtatagttagtttttagtgccttgaaaggaatttatcaaaccatgagtggcaaatcaattgtgctcagaagcctcaataaacttctgctgatctgcactctaggaagctaatggttgatctgtatacttcctgcatttcatccacaacatctgtttggcatgtggtaattaagaaaaacaaataatccaattaggtgcaatcagcacaagtaccaataaaaagaccatatcaagagaacttcaacatccttttgtgctgcagatcacttggacaagatccattcttttcttttcccggtgacgatcaagatctgctgaaaaagctgaattaaaagaaaggcaatcaagcagcacaggaagtaataatttgacactactaagctgaataaagaaaggtaatcagcacacgaagtaataatttgacactattcatttttttcattcattcacacgctctgagcacattatcctcaatcctgctgcctttttcttctctctttcctctttttcatgttcagatctgcattctgatttgatgacatacgaaatgtgaatcttctgacatctagcatatggggtggaatggtaaaacagaatttgaggaaaatatggacgggcacacggcactacgtcaaactggttggcaacttgtgatcatctgaacaattgcaacaagagtacattgcaaaatcatggtctctgctgccattattccattattttgcaatgatctaaatatagacgacaagatgaacccgtatatgccatatccaggtgtgatataaaaggaatataaaaggaagctgtacacatttgctgatactgtactaaaataggcgttctgaattcacactgcacatcaatcagatccagatcaagaaagaccataaagaaaccaaattaaaactggatccttcagctttgcaggagtcagcgtgaccttgtattccttgtttgtttagatcaaacattatttcattaaattcgaattgttacaatactctctagagaaagttcacttgtaaactaattgatacatagcatttgtagaaaaatatgaccgtattgttggagccaaaccgcggaaaaagtagtacagttctcaggagactaataaatctaacttgagaagaagagaaacctcagcatatctcaattatcacatttgattcatgtcagcttgaaaactatgcagaacgagccgtagcttcagacccagtggactcatcaggcctgatgagcacaaaactttggttagtagttgattatatggagaaaaaaaaagcaatgaagaattagggataggtcaaattaaactgaagtcggatgagaaaattagcaagaaccataaagtaaaatcgcaaacaattgatatctaaaagaacatattgctttttttatgggccatcagtttgtttagtgcatctgctgttaaaggacaggaaggtttatagtgcatatgcacaactgcaaaaaattaatcagataaaattaccatccacccccaccaaaacccaaaaaatgctcaatccattgttgctgtgacaaatatattgtacctttgaaactccttcgccaacttccatcctagcaaaattgccaactgtaacttttgagccaacttcctttgacaaatcattcaggacgctctgaaaatgttgacatcaagaagcaaaaccattatgtaccatgaattcacaattcaaactagtactacataattaaaaaaaaggaaaaggttttatcagttcaccttgatgtttgtgctgtcattgacaacatatttttgctccaaaagcacaacttcttcaaaatactttcttagtcggccttccaccattttctccatggccatttgggattttccagagctttcagcctaaaaagtttcagagtagtgtgtcactaaatcttaaataacttgaatgcagttcagtcatattccagatggatgtagcccatgtgtctccagaagatgacaaaagatattgctatttaattcatggaaaaataaacataattggtatcataaacttctaatatacggattcacattgtgttccattgcatagctcatctctgaattctaacagcccagctgtcttgcttacataaacataaaacaatgtgacaggaatactaattgagaaaattctattgtgagtcaacagtttcctttcattttcttttagttataatgagttaggacttatcacaagatatgcatttttctctcaactataggtcattattgcctatgtatgtttttctgttaagataacatcagaacacttggtatggtatgaccttatgatacctgatatctctatgtaaagcacacgcccatttcttcaattgtaagctaatcatatagaattacagtgatgctaaatttttccggtgcaaaggaagtaacatttatcagaataacgtacctgagtccggagtatgtccctctcattttcaacagctgaagcagagaccagttcttttgataaaaacaacggctttgtcgcaacgatgtgcattgcaatagatttcccgactctctgaagagcatcaagaggagcattgctgtcttctgcctctagtgtgatcaagccagcaagacgacccaaaccttatttcagaaaaaaaagaaaaagcttattcattcagtgaacgagaaattgcaccatttaccatatatcaatacaacttcatacttctgaagaacataaaatatggattgctgttaggaatcaaattaataatgcgagcaagcttggccagctcagtgtaagaggcaagtatcactaaagtcgtattactatcaatggttttacaaatgagcttgcatcctactaaataaataaataaataagaagctaaaattcatcactggacaaccctaagagaatagattaactataatttagattaaggaaggtaatgtccagaaagtccaacaaatttagatttctgaacccactgccaccccaccccccggcacaaaaaaaaaaggaaaataaataaaggcaaggacaagtatgatccatgctcagtagtcactagaaaactttcatttggttatgtgcactcaaacttagccaagaagattggaaaacatgcatgctacattcttgataaaagccaaagggcagagatttgtgcatgtacctggctggggacatgtgtgcatataagagcaaacaacaccatgtgcagttgtggacataatgaaacctcttctgaatttgacattctccccaaccatggcagcaacttctgtgacagcactttggactgttgtctccccactaagtttaggatgatcaagattgacattaaggttctgcatgattgagagtttgagacaactttataatatctacttacacatggaaaaaaccaggaaaagaagataaacatatcatatgaagctaaccaaatcatatcatgggaacagcaacagacattactgtgtgcacaggataagaagctgtgccctctgtgcaaagggcacaggaagtgagagagagagagagatcctgggctcgcacatcaacgtggcttttctctgagagcatggctctagtggagggagatagtgcgcaacagttattctaagggggggctgtagaataagcctacccaaactaaatatctgataagcactaaaatcttcatgtagtttaaaaaagcaggatatatatacatatttacaatggctacaatatctacaatgtggttgttaatgctggtattgcaaacatgttcatttgtatcatgatcatctccacatagcatcctctgtaatactagagccaagtcacatttatcatggcatttccagtccactgccatgaagttcttgtgtcacatatgactaaatggttgagccattttaacttgtttccttttatatccaacataaacagtgtgctaaaaatcagctgtaggtagcaattcggtgccaggcggcagcttggcactgcgattagcactttggcggtgagctcggcagctgccccacctcaatagtcatcctcggtccaactcagactagttgtggcagcaagtatgcagtgaagagggcgactagtggcctaggcggctcagtacaggcgaggatataagtacctccccaccctagctgcccaacctaatccccaaattggagcacgtgcaacagcggctagggtttgggagaggcgatggcgattgaggtcgccatagacgttgccgccgccaccgtagttagatccactggcagctcgcctgctctgctgcgactcctactgctccgctgcgacttctactgctccatcgtccctctgttctccccgccaggcactcaccaccatctaccatctccacgccaccagccgcttggacatatgcaccagcacaccagcacagtgcacaattatggccaacactgaggaattgagcaagtaagccatgctctttggcctttgctgtgctacagtctattctctagtatctatatactgctctgttcttgtgtgctctgctactctactctacactatcagatattcttccacaatttgcttgtctttgctgtgtgggtgcggctggtggtggtggtaaattggtgttgcttgctgccttgatggaaagcttgtacttgcttgcttgctttgcttcttgctgcacctgctttctgtggtggactggattcgaaactgctttttcgcggctagtcgtgcgcaccctcccccgcgtcgcgcaaagaggagggcggcagacagccatgcttttccttttttttttccttttcctgtttctttccttttttttctgtttctttttcactttttcgggttttttttttcggtttgttatacaaactatgtatacacatatactaagtttgtatacatgtatattttttccttttttatacatacgtatataaactttgtatacgtatgtatacaaagtttgtatattttgtatacgttgtatacaaactttgtatacatgtatacatattttttatacatcaaaagtgtatgcgtatacatataaaaaatgtagggtatatatacaaagtttacacatattttatcgtctatatacgtatgtatatatacctcatatacatgcgtataaactttgtattgtggtatatatacaaacgtataaatactgagactagatgggtagcgctggtcgcgcgggtgtgccggcgcgcgaccaatcgcgtatcaaccatccccgactggattggcttgggggtggtggtggtcgtggtggtgatttagtcaggtggatggctggatgctcttgcagctgtgtggtgggtgttacataaatatgatcacaagtatcttaatatctctatcagtacagcacactgaatccatactatttgaaaaggtagtgtgtagtgggcttaaatacagatacaccattattgaaaagataacatgagattgatcacagcacctgttaaagtagaattttacatgaaatggaacttaatgaagacttagatcagttggtttcaaatttgtaaaatgacgagtcaatcaattactggtaaaattggtggtgcttctataaattacacaataaatgcgccataacccaaattaatatatggataacttcatacctccaaatagtcaggaccaaaaggaaaaaccaattcaccaggatcccttgctgataaagccaactttgctaaagaagaagcctgcaagtttgatgagatataaaaaaaaatcataaatcaagtttaactaccttgaaaccacgcacaagcacaagctgaacaatcaaggcagttaaataagtatgctgttgtgatgtctaagatagggaaaagaatatcctacaagatacacagctatcaaagaagttcaagagtacaactgcaacagagcataatgtcataatgttgaaatactcaaataaaacctacaaaagaaactgaaagttaaaacatggacaaaatgattctgttcatattttgatatgccacaaccaacaagctatacctacatgctcaaatacactatatgtttagcatgcacaaaaagtaggcatcaggaatggcataaagatactgagataaaaactaaccagatactggaaaacatcatttcttgccacaaaatccgtctcacagttaagctcaaccacagcggcccttttctcatcttgtgcaatagcaagcaaaccttcagctgcagtccgtgaagactttttggcagcaagaaccacccctctcttccttaggtccttctgtgcaacatctgaaagaaatcaacaaactgtcaataggattaacagatacaaacaagtatgccgatgaagtaatgctaatgcaatcagaaataagcacaaaccaatatcccagttgcaactaactaaggaagccttcacatctttgattggagcgctcgtcctctccctcagctgtttgatgagattcatttgctccgacgcaggaacttcggagctgaatctcctgagaagtgtggcgctttgatcgacattgctgctcgaaaggtgagcctggaacgctgaataagagtaaccccgagcagaatgttgttgggcgcgaaacagaagcccaatcatgggctttctagcactctgactccaggccattctcacaatgttctgcaatgcagaatatgcagtactgttggtaaactaaactatcatcaataaacatcagaaaagcgagctccaccgattaggtctcaactaaagaaaagagatatgtcatcccatttctgcaactaggcagcggcggatccaacttggccaaactttttggggaacaaacaacaaactgttacttgtattaaggttaaggctctgaaattaagagaggagcttcttccagatctagaagaagagctagggttaacgaacgcaagcaaattccagacaaaagtagtcccggtgggagagagagatgaatcaggatgtggatgctcaccaggatcccctcccctgctctgctcgccagatggagatcggcgcccctcccctgttcagcagagagatgacgcaaggagcggaggagacgagacgggatacctcggcgaggacggagacggagacgcggacgacggcggcggcggcggcggcggcggcggcgacgagtggagcgcagccgcagggacgggacagtgagggagacgagggttttgggttttccgtctcggagggctggtttgtacgtcgatgggccgagcttacgtgggcctattgggttgaagcccatttggtaaaacttcgacacatgtaggaataagtctaatatgcgtccctcaactcatgcatctggttgaaatgcacccctcaaccgcaaaaccaggtataactttcccctcttcatcccacgtggcatcgacatggcgtttacgtgacactaaaataaaaataaaaagaaaattttgggcccacgtgtcacatatgcgtaaccatgtatttgcctgccaccctttagaaagccaagtgcagagcacttgttagttgttagtacaaacctatcaagacggacaccttaaatccccatactgtcaaacaactctacggctactccaccacacccaatctgagcgtatccttccaccacacccaatctgagcgtatcctgtgataaccgtattccaagtagttgggcgcctgggcctcctgttgggagtgcatgaaacaccaacattgcctcatccatgctgcgaagctttgcatacaagttgataggcactacgttacctgtatacggcaaaaaaatcacgtatccatatcggatgatacggtatcggatacgctccgatatgtgtcccgtacgtatccatgattttcacaactaacaaataaaacaaagtaaatctggatatttcgtggatacgccttgatacatcgcttgaaatcgctgagcagtacaaatccatggcaaccaccatgtgagctggctcgatcttgttcaccatttgatgcccctacaagcgcatggttcctatgctgccgctgtcggacgccatagctccacctctgctattgggtgtggcactgacggtgtccccgtcgtagccggatgtaatgcttccccctccgcgagtcggttggccgccgttggacgtattacctccaccgctgagcgtggtcccgccgccgctcgggcgctgctgctgcctactgggcgcagtggggcctcctcctcagtggtcaggcgcagcgccatagttgaacacaacccatgcaccgctgggtatttgcttattggtttgttgcttctttgatttgtttccataaagtacaggcgcattcgttttttatgtagggtttgggagtagtaaggtacggctggtaatgttgttgcagcctacaggctcactaacagtattttatgaaacaatcaagcttcatcatatttctttttttttgtcatggacatgtgtggatccatctttatttgtatacgggcgtatcccaaaatttatagtttagaaaataaaatttgtataggtgtatctccgtatccatgttttctgaaaaataccgtatccccgtatctgggtaacataggatagacgtagtcccaacatagacattagcattcaggtccaacttgacgtcaatcccattcacttgcttaccgaataaaacagccttagattgtgtacacgcacgtaggaggcctcccagaaggcagcgaagatggaaatcgtagagtcatcgcgcccgtgctgtgtgtacatggagatgaccgagccccaggaggcaggagacaaggttccgatggtgcattagagcaactccagtgtacgagtaaaatcgaaccatacttgaaaaaccgaatacaacacactacagcaaccaactgttatatgttagagcaaaaatcgaccacagaaggagagacgaactcggcgatgaaaaggtaatttgcagtcgttggctggctgcacgagagagggatggacgcatgtgattagagattctttttctacgtgggtccatgatcaatgtcacacattgcagccaacgaatcaaaattttgctcgaccatgcttattcaacatttgaactatgactaaggtgccttagatcgaacaggtgggtacagactcaccccgtcccattcccctagctatccttatctctctctctctctctctctctctctctctctctatatatatatatatatatatatatatatatatatatatatatatatatatatatcagctattcactttccatttatattacacatagcttgcactaaaagttgattaaactcaaactttatcgatcgctcgagccgtcacttataataaatatgagtaaattgcacccacggtgcaacaacttggtaggtgggtgtaatttggtgtaataacttgaaaaatgagcgttctattacaacaacttggcaagaaggtgcaatttagtataagaactttataagtgatcgtataaatacagcaactttgcaaggtaagtacgattttgatataataaattaagaagttgtgtgacaacttaattatttggagcattttttatataaattcaaatttttaagtatttattttgacaatatactagcgtggatttgtataaacatatttatatttttatcctaataactaataactctaataactaataactgaaagttaattaaactggatgtagaaattattatatttggttgatatttgagaaggtgaagaaaacaaaaaaattcttaaagaaaactgaatgtaaattgtatgtgcaatataattcttaaagattaaattcaatattataagataatatccataggattactatgtattggcatattgatatcggaaaaaactcacctagcatatgcttagccaaattgattcaccaaaatactaaattgtcaagttcttgtattagaacgcacccacttgtcaagttgttgcactcggacattcaattctcaagttcttgcactatatcgcacccacctgccgataggggtggaaacgagccaagccgagccgagctcggcttcgtgaaagcttggtcaagaacaggcttggctcggctcggcttgataaatggaacgagcaaaaagtgcagctcggcttggctcatttaaaagctcgagccggcttgagccagcttgagagggtggccgagcggcactggggagggaggccggaggcagcgcaggggagggaggcggcgccgcggcggcatagggagtgtcgagccattgaccgtcgagtgtcgctggggagggaggccggagccggtgcagccgcacaggggagggaggcggcgcatgggagggcgggccggagggatgtggcgggccggcggcacaggggagggaggcagcgaaccggcggcacataggggtgactggggatgggggagggaagcggcgccgtggtggcgcggggagcgtcgagcgccgctggtgagggaggccggagccacgcagccgcacaggggaaggaggcggcgcagggagggaagcggcgagccggcggcacagaggagcgactggggacgggggaggaaggcggcaagccgatgggtggcggcgcatgggatggagccgaaggtggcggccggcaactcctctcgctagtgacgccggtcgtgcgtgcgtgcggcggcgtgcctgcacctgcgtgggatggggaatggggagggtcggacggagcagttagggtagggttctctgttgttttttatgggccagactgagacaacttgttaatgggctaggctaggtcatgtttttcacaggcttgacgagcctaccgagcggctcgtgagctagctcgggctcggctcgatttgcaaacaagctgtggagggagctcgggctcggctcgtttagtcttcgagccgagccaagctcacgagcctaagttttttgtccacccctacctgccaagttgttgtaccgtgggtgcaatttactctaaacaaaatataaggtaatctacgataataaaaatcagactaagcttaaatacatatttttccctaaaaaatattccgcgacttatctgatttaaataagataattgccaaaaaaaatcatcgcgaactttcaattgtaattacaacatataacaacggtgtaacattatataaatatagagtataaagttacatattttataatatatttacatataaattatattgtattatagtatagttatatttcaaagctttccactcaaaaaacgtgtcgtagtttttaataattcctcaaataacacttcaatttaagcatgttgtcgtctaattctgccatgaacactaacggctcgatcagaaaattatcgacaacggttcctttttaactacaaacacttacacgcacgagtacttttctaacacagttaaaaattcgaaaatgctacacgtacatccgaaatgtcacgccgttgtgcatttgctgttttaccatttagtcgtacgccggtgggacacctagttattggaaccgaccggaccggcggttggatcggaaaaaaccgaaaccggttcctttttaactccaaacacttacatcccgttataacgcacgagtacttttctaacatagttaaaaattcgaaaatgctacacatacatccgaaatgtcacgccgttatgcatttgctgttttgccgtttagtcgtacgccggtctagtccagctaaaagaccggttgtgcaatcagcctggtatataccggttgggccgcccgatctgcattgtgcgtggtcaccttcgcagctggagagggaaaagggtgggattcgatcccaggacctcatgtataaaagtaaaccaaccaaccactagattacgatataccttgtgttttgaagggataaacaatatatttacattagattgaaccgcttcaaaccagtggttcaacactttaaccagttgaaccaataaatcattgaattgagagcatcgctggtttaatgaccggtccggtcttaataattattatgatgtgacaaagaacatcggatgcatagcggggttcttaaaaattactcatgcgtcaacaacgcggttgcaagaaaccgttggctcacgccacccgcgccgcgctgcgacccagcctccgttcgagctgcgtgcgcgtgcaccgccaccgagccgaaccagctgtcgcctgtcgccgggctcggacccgagtcaagcgagtcaagccttccggtgcggctgcggctggcctcgcgtacggccgccacgtggcctcgccgtatcaatcacgagaaggggagaaaagtggggcgttgcccagaaaccccagctgcttgctcgccgcgcgctctcttctcgccgcctcggcctcgccgccgtggccgccggtgcctggacgaggaggaggtgagggcgtacgcttcggccggtccgccggccgcgccgcgccgcgcctctgtttgttctctgcttgggctcgccgtgttggcgtgtggatgtgtaacggctaatttggttcggtttttgtgcttggtggtggtggtgattgcagggctggatcgctgggagatgttgagcagcggcgcgcggtggcagccgcggcgaagcggatgggcggagtggggcggcgacgctcgcccggctcgctctcctcctcctcgtcgtcgtcgtcccgacgtcgctgcgggttggcgaggcgaggggaccagtagagtgcgggggcgcggggagaagggaacgactcatggtggagcggaaggcgagggcgcggtggtggcgccggtgagaacagcggacgcggtgccggcgagaaatgcggtggccgtcgccggtggtttggccacgcgcggcgtcgagcgggatgctggccaggtggtggcgagagaggagaagagacatggcggcgagttggggaccaagagaggattggaggagcgggccgcgcgttcgccgccgccgccgccgccgcccaagcggagggcggtgtccgctattcgccagtttcccccaggttgcggaagggacgctgctgctccagtcgcccgcggccgcggttgtgatggtggtgttcgtctgttggatgaggcaaccgctgctcctctcgctggcagcaaagatgattctgctgttccgggtgtggtggagaaggtggcgtctgtagatggtggcgattcaatggcgaatgcgcatcatcatcatcatgctatgatggacacggtcttgatgaaatcttcacatgtttcggatgagaatcaggtcgctcgcaaagttggttcactggaaaatggcgcagaagggtcagcgaggggaaagggaggacacggcggtgaattgctgggaaggaaggaagtgttggctcaagccgcgaatttgcttcccaagaggaggattgtatctgcgacgcgccgcttccctcctgggtgtgggagggacgctgtggctccacttgctcacagagaagagagtaaggtaggttcaagtttggaagccatgcctgttgatgctggttggggtgtgtcaaaggaggtggtgactacggatggccgtaataattcggttaaccagtgtgcctcgaacattgtcggaacagtaaagtgccaggaattggaggagggtgaggtagctgctgaggcatgctgtgatgtggagtcacaaaaagttgctggtcatggagaaaaacttgaaagtgctgttcctgtaacttctgctgttactgaagttttgacaaggtgtggttctgatgagatggaagggtgtagttatgctgcggaggcaactgaaaaacacttgtcaatgggtggtaaatgttcaattggtggtcctttcaatgaaattgtccacggcaagagagtgttggggagtgatggcattaaaagggaagttcctagtcttgcaatggaagatcatggcagcattgctcatgaccaagaactggtggaggttgagttaactacaggggaccatattcaggaggctcaagttgctaccactgttaacccacatgagtctacaattagtagacatgaggcagctgtttcagcaaatactgctccagaagtttctattaggcatttttctagtgtgaagaacggaaacacatcacagcatgaggagacgatatatgcatctgcagctgctgacgttgttaaggtgatgaataaatgcaaagggaccaaatccaaagctgcggctgaaccttgggctgaaggtccttccaaagaacacttcaaggctaagagggagtgtgaaaaagatgggatgaaaaaatcatccatgaatgttccaacagaagtatttcgtgatggtatcatgagaactaagttactattgacagctagaaaagcagtcaagccaccactgaatactctgcatatacccttctccatgggaaaagaggagtctgttgtaacaaatagtgcatcatttggtcctaagaagaaggtgaaggtgaaaagcccgcatgaaagtaaaggtattcctatgaagattgtctctacatctggattggcgggcaaggacaaccttatcaatgaaaaggctttgagcttggaagatgatgatattttgaaggcactagctgttcataatggaaagctagagttgtatctcaatgttccctcatgcgttgagcgtcacaggcaacatggaagtgagaatggcaatgataggagcaaaatcaggatgctatgcaggaggtttcaatttatatgcaacgctcttctacatgctgttgaacaaggctcattgatggttcgacgaattgaccttgaagctgataaaatcatcaggaaattgccgggctttactaaacatggacctactgtgggaaatgttcgtggagtcgaagtcggtgacgaatttctgtacagagttgagctagctcttgttggtcttcatcgcccataccagggaggaattgataccaccgatcataatggagtgcttgttgcaataagcatcgttgcttctggaggttatcccgatgaattgtcaagctcaggtgaactgatatatactggttctggaggaaagcctgctggtaaggagaaacacgaggatcaaaagctagggagggggaaccttgccttgaaaaattgcatcaagacaaagacacctgtccgagtgattcatggattcaaaggtcaaaatagagaggacgtcagtcattcaagagctaaacaaatcttaacatttacttatgatgggttgtatcttgtgttggattgctggagagaaggtctaaaaggttcaagggtcttgaaatacaaattacaaaagattcctggacaaccaaaacttcctctgcacatagctaaatatcagaacactaggctgggatcccaaggatggtgagaaccatcttgatgtagtgcttagatcattgctcttgattgcccttgtcgaactcggacatgaagagactataaatgagggagttaggcggttccatatcttcttaaaagacagcaaaactaaccttcttccaccagacactagaaaagttcagattttttcttaacataccgctatagtgtcacgtctttggtatctagtgtactaatatatgtattgatctgcaggcttcatatctttctatgatgcagactgttactacctccagcagaggtggtaatggtgctctccttaaaatctacagagaaactgctgaagcactggagaagtcagtcaagtcacgcattttaggactgtgcgttctgactgtctagcttaagtgacacagcagggattttatgatgagttgtgttgtcctgaaaagtaatatttcttctattgtaggtacattgtcttcatgcccagctaaggatattgttcttgaggcaccaaacttcatggtcactgatgagtgatgaggttaagctctaaatttctgaacaaacgatgattcaagacagtaaatggtggaatgagattctattctacaccatggatacataagccagtctagtctctctcttgcttgccaggtacggaatcaagatgcattttatgtccatggtggtagtatattagaagtttgagaagttgcatgggctgattgaaggtatgctatagtttcagggtacctaaagtgggttatttatgttgctatctgataaacaacgcacagatttctgatatttatgaacgaaaaaactataagcactgttgtgatgctcaatatttttactgttatgaggggttcaaagttcaagttccaccaaatgccaatacatgttaggtgtatatatcaatacgagaatcaaatttagattttacacagagctatgccaaatcaaattatggtccttgagaaggtaccatgaggtatcactttttctattgtaaatttggtacctaggtactatgaggtatcatgaggtaacaaaaaaaataatgtaaaatttggtacctcattgtacctccttaaggaccgtaaaattgctctaaagtttatggtttgaaactaaaatagtcaaaataattatgaaatagggaagctggattatcaaaattcctttctaccgttcacgccaatatcgaagttagtgcaattgtgtgtatgttaccctccctggttgcataattaggtctctttacccaaaactggtgcaatcatttgttttgctcaatactactatcattcagtcctgctcttttagaaaaccagagaacaaatccaaaaggttttcccaagtaactctgtgatagttcagaacaaaagaaacacagtacttcatagaaaacgtgggaatcaacgttctaacagatgaagtgaagctgtttatgcagttgcaccaaataggagtatgctaatgagctttgtgtacctaccagtgcagcggttgtgactgagttatttcattatctaaaagagattagatcatcacctcggtgagatgaaagctccaaccccattcatgacgctgaatagctctgcaatttaagggaaatccagcatatcaaaatgaacgcgacatatttccacttacagaaaagatgccacctgaataatgcacatcttagaatgagcaaatcaaagaagttacagtaataagttctgttatttttaacaggcctgattctggagttcagagcaagttggatatctgtgaccatgagtccccatctatgcatgatgcaggaaaaccggttcatgtcttgaagacctggccatcaaattcactactatcagacttcgtcaatttctcgggtaagcgaagttacccccttttctctccattgctcttccttctcaggcactaaattcactccttcccttttatgtttctatttgttttctgcatgatcaggtcaccacggaggagaaagctactgaattttccgagttcttcgccggtgaagggttcnaaccatcgttcgagcgtgtgctgaagcaaagcctggagagggtccggatcagcccgagatggatcgagagcatcaggccttgctcgtacagtgcatgagctgcagcagcaggaaatgtaactttctgggctaagctagaagattttacacgcatggaagttcgtacaaaaatgttcttggaaaggttgtgcggttgggccaggtgtggccactactaaaaaaaacctagataggtgctcaaccggcacctagcaagcaggcggcacatatgagagaaatgaaaggaccggcacctttgaggtcccaaaaattcagaaaaaaaacagctgtcgagccaatgcatcgaggcatcgagctctcaatcatccatgagatccccatccaagaatacaagcacacaatcacgactaaaacaaacatccgcagacaaaatccattaacaaaatcaacgagaagccatcgccaccggggagagtggatatccgccgtgggagcctctgccactagatccacctttctggcagcgacgacggggatggcttctcctccgtcttcacccttatatcccatcgatataagggtgataccttacaatatcaggtatggtacacaagtatctatctatctatcttctattatatactaaaagtccattaaacattttataaacgctctcaaaccgccacgtggcactactacaaacgctcctaagtcgccacatggcactatctaatctcaccgttgattttcacttaaattgatggatccgttattttacacaattagattagatctattattagaaaataataacatcctcatgtttataacatacaagcgtacttataagtttgtacgttacaaatgccactgctgtactttccgtacgtacaaacgtatatgattgaaaacaaaactttcctaatctttgctagaagaaaaacaaatacacatatacataaaaaagacataaaaacatacattcataaaaatcaacggtatttaaaatatgactttctacaatataaagataaaatatattacttcacaaatataaatatattcagttaaattaagatctataataaatatccaatcaatattctttcaaagcatcttctaaatctatctattatatactaaaagtacattagactttctacaaacgcttttacaccgctacgtggctctctaataatttagagaaatcataaaaatctattatatactaaaagtctactaaatgtcctgcaaacactcctacattacattatcatgtgacgctctaataaaataagagaaatcctagaaatttagagtaaaaaaagaaaaccatccaaccttcaattttcacttaaattagtggaccagttattttaaacattggattagagctttaaagaaacggacggatttctcaaaaaaaagggattatgctactaatctctatcccggtaaaaaaaaagtggcgtgcttaagtcgtacgatcgtctccttcccaagaaaaaaacaaaatttaaatacctacaccatatatgatcgaaaaaagataaagaaaaaaataaaaagaaagcacgcacacgtacatagtagtatcggcaagaaatattgataaaatcatcagttcagcactaatttgttgtcaacaacctttaatctacgattttattaaaaataatactacatagatatgcacagttaaacttaatcgtaaacttgttgtagtgataaatatatcatggcaaatgataccaacatgtaatagttaatgcgataataatgtttcaaataatttcatatgatattttatggtttcaaatatcacttgacaaatatataacgttaatttgaatctacatatgtaaaaaattaaaataacaaaacctagaattgttttttaagtacatctatttaggtttatttaattttgggagaaattgagattctcaaagtatttggaatttttcaaaacttttcttatttgaggtgtcagaagcacaattaatagattgatgagaaaattaaattaaattttagcgagtggtaataaaacaacataattgagctttggtttttaagtggatctttttaggtttattttgggtgagattgagattctaaaactatctgaaatttttcaaaacttttttattgctatttgaggagtgagaagcatacatgatagatagatgtgaaaaaaaaataaataaataagattttagacaatcgttttgctagaatacaacccttaattcatcacaagaattatgtattttctttgccaagtagtattggcaaaacatgaataatccaataaaatacgcatcaaactacttatgatatttttttatagttgatagaaattctaatataccaggtataattgatggacgaatgttatacaccactgaacccatctataagtgcactctagcaaattagttagtgtaaataagtttgtgaaataagtacattcttagaattagtaaatgagtctcgtatagttataagcaacatatggtggaaacaaatttggcgctaaagtataaatctttatcaaaatataaataatgatatggtgttttgcagattttcgtggtggtacgtctctttagttatagttttttttaagtagtgtcgaatgattaaccccagtcatttgagaaacataatattgtatgtattccattaaaatttgagaagtacttattactaacttcatatacatattttatctattctctaccacaatcgactcaaaacttaaaaaaattattttcatcacctccttctttctgtccctctttgtccttcaatgcagggtgcaatacctgctatgccatcataaatttgcatgggcatgtacatggttgagttaaggtggtgtccatgaaaggctatcataggcaatgtaactaaagtgatgtacttacaaatataatcaattgtgagtgtaccaatagtgaactaagtattaaaattgtactctacgatggtttttaggggcatggctatatcaatgcgagacctgtatgttttaaggcattacatatggaagccttggttggcagatacagctgacttcatacattagagaggcattcatgtttatttttaatggtgttatcgtattattcggtagatatggtatatttagcttatttatacatatacgtaaaaataagtgatgaacgacaggttatgtagtgtagatgaattttttaatgtattaataatgtatcgtttgttttagtggtactaatacaatttcatttattaaaagtgcacctaactcttaaaacaatgatagtaagtagtgatgacaaacaaccagtttatatatgaccagaataaagggatttttatttaaatctaagagacactcttatcacattagtagtatattaaaatctatcatctattttagggtaaacatatttcttttttattgtaggataatctaaattctcttacagtatatatatacatagtgatatatgattccttttagcactcctttttttaataaaaaaaaagatgcatgtgcatctgtacgaaatttctttccgatttatattctggaatgttgtacagtgtttgaaacacaaactataatatatgcccgcgcgaatgcgcgggttaccttcctagttgacttcataatatttacaaaataaaaggtcttatatacaaaatatcgtaaatatttactgtgccagaaatagctatgttttaaaacggagatagtattaaggtatatatctccattccccattgtgtgaaatctgatttcatcaacttatcgttccttcctttatggcttcctctctcggcgatggcagtggtctcccctcgacgattatagcgctggtgctccaccgtcctcccttgacatcactggcgccgccggtgatgttctcctctcgacagtgacggcgacagtgctccctcgtcctcccttgacatcgtcggcaccggcagtggttgcggcttcccatgtcctcccaaccattatagcggcgtcagtgacccttgcctatgcatagcattttctctgcagtaacgcagagaaagggactgttttgaacagtaattgactttgtgtggacggtgagcgcagcaatacctatagcaggccaaacgggcggcccggcccagcacgacacggcacgccgacggcacggcccactagggcacggcccgttaggcacggctcctatagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgagccgtgccatgcctgggccgtgccgtgccggtacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtttagcaataccttaggaaaaaagcactgttgtatagtgatgaatttactgttccagaagtaagtattggtgttacagatagtgcatacctcctatacatgagtttatgacatacaaaaatacacatatctaatattatacaaaaagtatataaagcgagtaagaaaggaaactgcttttgcaggaatagaagacgtaaaagtttggcccagaagaggcaaggtttcctttgcctatatcctaacagggttcttcgagttctacttggagaaaaatgtatctagccgtataaatatacccctcccaagaggaaagagcattgaattgcaagcccaagccagagccacactaaaagatagccaggaggaagataagccctagtgcggacatcatctcgtcgagaattactcgacggatcctagttgatgggttagaatagctaacttgctcttcgattgtaactagtgtggtacttttccagagatatacatatgaaccggagtagtgttattactcatcttgatgacccaaactagcataaaagtcattgtccccgtcttcttactacaatctcgtgtataccttggtaccgatgacttccatactctacaaataccattctcgggtatagcccgtcgatagtgttgtgcagattcaactatagctatagtgatgaggatattactagcttggatatgaccatgattaccttatatattcataaaccaagtgcatgctttctatgtgggatttaagtgtcatatatttgaacaaacattattgcactatgagttttgcgtgttctcattttcaaagatatttgcttgggtaaaggaaaagagaccgagtgcgagagccgtgtcttgtcttgcacatactcggctcggtgaatggttcatcttcgattggcatggagcaagaaaacggattgaagcagagccagcacacctcagtgaatatcattatttaggacaagcacgaagaggaagagctttgtccttcggccttgaatcagcataaagcccctcgccgagccacttctttgacattacgttcgatttcaacttcatgttcctgagttgcagagaacaatccaaattgaggcaatctttccggatttgctccgccttacagccttgcttcccattgtcattnnnnnnnnnnnnnnnnnnnnnnnnnnnnnnnnnnnnnnnnncggactcgagcggggcccaccttagaaatacatggatgatcaaattaagaagctgattgggaccaaaccaagaccttccctaagtctactcccatgttaccacgtcacttttggtccatagaaagcaaaagaagaagttatacacgttttggattcggattcggtctcttgataacatcatttcaaacgggcctagctgttgatctagaaggaatctcggggcgcatgagtacttgttggaaagcttatggaatctactttttcagatggttttggtcctacatcaaaattcctatcgaggtgttgggagtctgcaaaacaagttacgtaccttatacagtccgagtttgatttgagccttataattatgtcatgggctaagcgcaaggaggtggagtcctagggcaaactcggacatcacttatcatatttattcaatagccatcatagtttagaatggggttttgcttagattatttatgccattacagttttgctgcttgctcagtttgtagaactccaaattgaagcgcttaatcattcatatgcaattaagttgcaatctaccttattcttgcttgtgttcttcgattcgcatgtacggattgtttgaggtcaaccgggcagtgcacggttgataaccagaggagacgtggtgctacaattacagggttcggatcgtgtcgatcgaaagctgaatcgtgtgtgtcaagtttccgccaaatcgagagttatcactacctattggaagatcgggaccagtacctcatcatatagttacttagcatctgaatatctaatctaagaatcaggatcctctgaattgatctacaatacccaacattagagggaatggagactgtttgatcagatggattagatcgtgcgctacaataaatatgctacaatactcatcaatgtttgacagtattttcgttaatggatcgacattgtttgatgcattgatttattgtgctactaacatgaatagtgcacctatgcattactgcagaggatccggatccctgatctagcccatcattttaaatcgagggtggataggatgggccattgtgcaaatgatataacttgcatcaataatattccaatgtagtttaaaaaaagagataatattctaatgcggagtatcccgatccgtactgctcctgctactaagcgaatgagcaattaagcatgatgtgtacagtagaaaagggtgagataaaaagtgtggatgatcttgtgtagatcattgatgtgaagggcgcgataatttatagaattactatcttcgtgttaaaatataataaattttaattataaatatgaatatataattgtttaaatttttagctaaacatatttatattttgagatggatattaccaaacttagccgaagctgttaaatagatacgctttcctgctgtgtgattgtcctttggatagtgcttatgaataaatcagcggcgctgcaaggaggacccaccggtaagtgacatgtttgagtaaccgacatacaccgttcagggggcgcaccaaagtctgtgtgtttgctgttggttttggatgattaatggggagtaaagattacgaagtatagttacggagtaacttgcatggtgtggctgatgtctaccagaatgtgaatgatcagtgggacccgtctctcatggtaaaaaaatagctgaattcagctatactcatgcgttgtatagctgaattttgctagactgacacgagtgtcaatgacaagtaggtccaaaataattatatttcttagcaaaataatgaaataaatacttagcaagagttttaaatataattgtgtccatttttaattaactggttcctcacactttaaccattaataatttcttaaatgttttgttttaagaaaaatacacgtatgtagatttgccttaaaactatcattaaatatcataaacttaacagtaaaaaaagacatcataaagttattcgatgtcataaatgtattctaatactaaaattatggttgaagtttaaaatttgaccaaacctcatcttaaacataaaatatttgtgattggagggagtagataatatgggattagccgtgtgaaaatcataattataaacttattatggaaaatatcttcacctagccgtttcaccattgtagagtagaatcaatgccgcaataacaaccatctaaaattgtatttacgccccccagtaaatgcactacagtaatggagtactagtaccgcggcgtcaccgactcagcgtcaccgcctataaaaagagaagcgaaggttgctgagacccccaactagggctatcaaaaaagctcgaggctcgcgagctgcttgagctcggctcgctgtagactcggctcgagctcgattcgtcaacaattcgagccgaactcaagcctagctccaagcttgcgagcttgacgagccgagctcgaatagctcgtcgagcccagatttccctctgtcaagttcttaaattttcaatgcaacagctagtactactcttactcccaatgaaaagcagtatagaaacacagagcgtgcagagctgtaccgtgcaggcactagcctactagtactacattactctgcagcactagcctattagtactactagcatgcatgcagctctatttaatagtactactagttgtcatattatgcttgaaaaagctactagtactagtagtactcgacaagcatgcatgcagcctcctttcatctgtattggttatttgagggcacacgagttaggctcgagaaagctcgagactcgagcgagccgaactcgagcccatttctaagcttgtagtttaaacaggctcgactcgagctcggctcgagttggtgccgagctcgagcctatataggtaagctcgctcgggctcggctcgttgacggccctacccccaaccgttttctcaccccactcgtttgcttgcgttgcgtgcacagcgaccgagccagtcggagactcggaggttcggacccgacccgacccgagtcaatccgaatctttcaggtgcggggcgtccggccgccacgtggcgggcgaacccatccctcccggcccctacccgtatcagtcacgagctcctccttcctcccattccacatttccacccctcacggccccacccactctctcgattctctcctcgcccaaaacccccccaactcctcgcaggctcgcagcctcgctccccctcgccgcgctctcggcctcgccgcgtcgccgccggtctctggacgaggaggtgagggcgcgcgcgcgcctcgggactacttcggcgcggctctgttctcgtcgttcgtgttcttctgcttcggtttcgtggtgttggcgtgtggatgtgtgcgtaacggctaatttggttcgggtttttgtgcttggtggtggtggtgggtgatttgcaggggcggtgaatcggtgatcgatgagcgggctggatctccgggagatgttaagcagcgctgcgcggcggcatacgtggaggagaagcggatggggggcggagtggggcggcggcgacgacgctcgctcggccgcgcttccggctcgctgtcctcctccccctcctcctcgtcgtcccgcggctgcgggtgggcgtggcgacgaggggagcggtggagtgcgggggcgcggggaggaggggacgagtcgtggtggaagcggagcgaggcgcgaggacgcggcggggaccgggaggaatgcggtggccgtcgtcgccggtggctcggccacgtccggcgcggagcgggttgctgcgcgagcggaggacggtaggaggacgcctctgtttcggttcatcacgtcctctgcttgggttcgtcgtatggattgcctatgtaacggctaaatttgttgcggtttgtgttcggtggtggtgattgtagggcggcgatcgatggacgggccgacgctggaactctccgagatgatgctccacgcggcgcagccatggagaagccgatgcacgcagcgtgacgttcgcccgggcgcggttcctcctcgtcccgtcgctgcggatgggcgaggcgagggcaccagtacagtgcgagggcgcgtgctggaggggacgactcgtggtggaggcagaggaggtggaatggagcgtgagcgcgaggtggtggcgccggcgagaaatgcggtggccgtcgccggtgatttggccacgcacggcggcgagcgggttgctggccccttggtggcgaaggagaagagaaatggcggcggtgagttggggacgaagagggggctagagaagcgggccccgcttccgccgcccaagcgcagggtggtgtccgctaagcgccagtttccaccagatttcggtagggactctgctgttccactcggccgcggccggggccgtggtggtggtgttcgtccgtcggatggggcgcctgcccgtgctgttctgggtgagaaggtggcgtctgcgggtaatggtgattcaatggcgaatgtgcatcatcatgctgtgatggacacggtcttgatgaaatcttcacatgcttcggatgagaatctggttgctttcaaagttggttcaccagagaatggtgcagaaggggcagcaaggggaaagggagcacacaatggtgaattgctgggaaagagggaagtgttggctcaagctgtgaatttgcttcccatgaggaggactgtatctgcgacgcaccgcttcactgctgggtgtgggagggacgctgcagctccacttgctcgcagagaagagggtaaggtgggttcaggtttggaagtcatgcctgttgatgttggtgggggtgtgtcaaaggaggtgatggctacggatggcagtaaacattcggttaaccagtgtacggcgaacattgttggagctgtcggtgttttggatggaacagtacagtaccaggaattggaggagggtgaggtggctgatgaggcatactgtgatgtagagtcacaaaaagttgttggttgtgattcttttgatgattctgcaggtgaaagacatgagggtgttgttcctgtaacgtttgctgttactgaagttttgacaagtcacgcttatgatgagatgatgcaaattaaggcattgcaagaagggggcagtgatgctgcgcaggaaactgaacatgacttgccaatgggaggcaaatgtgaaactatcttacctgatgcttctcctaaatgttcgtttggtggtccttcaaatgaaattgtccacggcaagagagtgttggggagtcatggcatgaaaggggaagttcccagtcttgcaattgaagatcatggtggcattgctcaaattgaccaagaactggaggacgttgagatgactacaggggaataccgtgttcaggatgctcaaattgccacccatgttatcccacacgagtctacaactggtagacatgagggggggctttgtgcatctgcagctgctgaagatgttaaggtgatgaacaaatacaaagggaccttacccaaaggtgctgctaaatcatcgatgaatattgcaacaggagtatttggtgatggtatcatgagaagtaagatactatcaacagctagaaaagtagtcaagccacctgtcagagcaagccataagcctccattgaacactctgcatagacccttctccacaaatagtgcttcatttggtcataagaagttgaaggtaaaacgtccagatcaaagtaaagatattcctatgaagattgcctctacatctggattggcgggcaaggacaaccttatcgatgaaaaggctttgagcttggaagatgatgatattttgaaggcactagttgttcatgatggaaagcttgaggtgtatctcaatgttccctcatgcgttcagcttcataggcaacatggaagtgggaatgctgatgataggagcaaaatcaggatgttgtgcaggaggtttcagtttatatgcagggctctcttacatgccgtcgaacagggttcattgaagattcgaagagttgaccttgcagctgataaaatcatcaggaaattgccaggctttaccaaacctggacctactgtgggaaatgttaatggagtggaagttggtgacgaatttatgtacagagttgagctagcccttgttggtctccatcgcccataccagggaggaattgataccaccgattataatggagtgcttgttgcaataagcatcgtttgttctggaggttatcctgatgaattgtcaagctcaggtgaactaatatacactggttctggaggaaagcctgctggtaagaagaaagatgaggatcaaaagctagagagggggaaccttgccttgaagaattgcatcgagacaaagacacctgtccgagtgattcatggattcaaaggtcaaaatagagaggacaacagtcattcaagagctaaacaaatcctaacatttacttatgatgggttgtaccttgtggtggattgctggacagaaggactaaaaggttcaaggatcttcaaatacaaattacaaaggattcctggacaaccagaacttcctctgcacatagctaaagggctgagaaggtctctttcacgtccaggcctctgcatagctgatatatctcaagggaaagaaatggatcccatctgtgtgatcaatgatgttagtaatgtccatccaacatcttttcagtacatctctagaatcaagtacccgtcatggcttacaaaaagacatcctcagcatcatggttgcgattgctcagatggctgcatagattctactaagtgcttttgtgctgtgaagaatggaggaaaaatcccattcaactccaatggtgcaattgtccatgataaacccctcatttttgagtgtggtccatcctgtaggtgccattcttcatgccacaacagggtaagtcagaagggtatgaaaatccacctggaagttttcaggacagccaataaaggttggggtgtaagatccctaaggtccatctcttctggcagctttatatgtgagtatgttggtatcctgttgactgacaaggaagctgacaagagaacaaacgatgaatacttgtttgatataagccataattgtgatgatgaggattgctccaaggggaggccatcaactatttctagtctaaactcttctggtggttgctctcagaccatggaagatgtgtgcttcacgatagatgcgtctgagtacggaaatattggaagatttatcaaccatagttgctcacctaacctctatgcacaaaatgtgctttgggatcatgatgaccaaagggtgccccatatcatgttctttgctgcagagaacattcctccactccaagagctcacttatgactataactataaaataggtgaagtccgcgacctgaatggcagagtaaaagttaaagattgccattgtggttctccacagtgctgcggcaggctctattagggcatggttgactgatagtactaggtttggtatttctttgaacaaaaaccctttgtaaagttagtgttttgcttgttgtcatttgagagctttgtagatacatggataacatggagtgttagtggtaaaaagcagtaaggttggtggtggttctgtacatctgttgtcctactacagcgaaatgcagattcttgcatagtactgtggtaatatatatcttgcccgtttgcgacactgttgctgagtccagaatatatgtggaattgaataaaattggcttggtgtttgaactatcccaagaatctggacaggactgcagttgaaagcaggtacacaatcaaacttctgttattttacataacgatcatttatgtcatttgtgctaacaatgagctaggacaatcagaagatggacaagatgtgtggtgtgcttttgaaacctgggaggtagtcttttggtctttggattcatgtgtgaggttggttactagtataacattattgccgttgatatgaatgttcaatgaatctgcttgatctgcaatagctattgtgctagcgaagcaatattttgaaccaatgtatgactagatgaatcacctttatctctgctagacgttcaatacctatctttgttataagaatttcctagttgtagtcttgttatcttgtagaaggtttttaagttgcaatgattgacaattaaatcttttactatatgactaacagaacacttagcacaacttaggagctagtcccctccagtaaaaaagaatgcctatgtatgctgttttgaattctgaatttcacacttgatgtacctataatcagtgagaaatcagcatagccatatgtataccactaaaaggatcatgatattacagttttgctgatgtgtggcaattaaatgaacagccaaatatgcattttttgagacataaaattgtcaaaataagtattgcaatcaacctactgtgcaaattcttttttccccattacattcttacgcatttttttcccctgataaggtgtttttaactctttgtacactgcaaacagatgggaacacttgattcttttcagaacattgtatgatagtgtggtaaactcgtaatgaaaaccattggcaacaaatggcattgatattttttatatttttgttataactgatggacttatagagggagctaattttctttcttgtagaatctttggtcctttccttgttactgcaagattaacttggtgcttgtttgagttcttgtcaagtttgtggctatgattgtatagcaatactgctcgtcaacttgcacttcaaaatatattactgtgggtactggtcgccttgatgtgaactatgcgaatcactaggaagagcttcttttaacttttaattcagaaaagaaaataagcacaacacacaattttcactgagtcagaatggtttgcacattcaacacagggactaaaagtaataacatttccattttgttttgttttgctaatttggtcaaatctgttttgatttatgtcaatttctttggtagcttatgatcttgatataacttcaacttatttcattctcatttcaatgcttccatagtaagcctattattggactaagaatacttacaaaagaataaattctgcagaggtggatgctgatagacattttttttcaaaagtaagcgatatttcctctgaaaagagaaacattgtttatatccttctgggcagatttcaataaaaaaaagtaggttaaataaagaccaataaactatagagttaattttgcagtcaaacactgagtgttttttttagagaagggaattgaagtttcaaagtaacttgaaagcgggtatgatttatctggtttcctgaaagtttatgatggatttgctcggtttcttactttagaaaaacttggacagctttttttgatggggaagtttctggttgctgtgtgttcagtcagtatctcaattttcagatgatcatgatatgacttgtggatactgaaaccagatagttctgaattgttccaaccaataaggtgctatggtaagtgccattctcttgattccttgtcttgccagatgaggcttcttaactgaatatctgatggtgctgcttttatctatgctgctgaattaactagtcgcagttttgagcagatcttcagcacatggttggtgtttagccagggataataaaggtagtgcattatttacaaggagatgcacatacatgtgatgaaattagttcaggatttgggttttgcctaaacttgtcgtgggattacatgtgtggttatgatgttaaccattggttaccatttgctttgtcctctgcagcaaatagagtgttttactagctcatagcctctgaagtctgaaccctttttatcttcaatgcattcaggaatatcttcgaattttgactctcataattctttctaaacccctaaaattttcccccagttttctttcgaaaggtaattttcttgatgggataaacatttcctcattttgcaggccatgtgctgcaacctgtaccctaggtcgaggatcactagaagtcgcagcgagtgccgaggtagcaaagatgaactactctttgaagtcttgatcaatcggtgggcatgattactggttttggcggcaagagagtgaagttatcagtaaaaatgtggattcagttaggtaggatactgacgtgttgcatatcactactagctaggaacagatatacctttgagttcttatcatatctttctggttatcacaggaagaaatcggctgtcacaaaattctctgcatgatttgattagctccaacatgacgcagtggggttgcttaccttggacagctggatgcatcaagaccaggtttacagttctaattcatttccaaccgttgttaacctctgagattccttactgttactgacacgattatctctcgatgtgatatgatttcctcgttctcacaggctatgtgttttagaccgagtggctgatctgagaggcactggatactcaaatcagcaaccaaacatcgggtttttggcagctaggcaaaggttgaacgaacgaactcctcttgatcagatcggtgggcatagccatcagattcagcaatcagcactagcttttcacaactgtcgcagctcaaaagatgattggcagaactgcattaccgaaagattacctgctgctggtagtggttggtggtttctgcaaacccatagtttcaggctctagctttattttttttccccttctctctttagactgtggcttgactctgacggaagtaaagggaaatagttgcatcagcacgaacttttttaattttttgaaatttttaattttaaaaataaacccttctaaaacatatttctagaatctaaaccttttggtcacgtcagcgctctaacatagcaaaaacacgccgacatgccacacatagcgggcttaaatagttttgtcccgccatgctagcgaaggtggcgcgtgactacgtaacactgtcataccaaccagaccgcgtgaccaaataatgcttccatgtcaaccagactggcgtgacagtgttgttttttcacgctagtctggctagcgtggttaaaaagttcagattttaaaaataagtttcgaaaggatttatttttaaaattaaaattttaaaaagtttaaataataataaaaaacccatcagcacatgttgcaatcccaatctgaaaagaacaaaagaaagactagagactagagagagtggagttgtcatggtggtggtcaacaattttgatggcctgtgggggcagcttattttgatggccttgcgtatgacagataacagcggctggtacgtattctgacattttgattggtcaatttccattccgtacgtgttgctatcttgctgatgcttttggtttggggcccctgtttagaaatcagggtcggcttggataatagcagtttcctctcatctttgggtagccgatcaatcatcaacgtgtggtggtggtggtggttaagaacaaattttagtctaccaaattggataagtttagagagagcaggttagcgggagagatctgcaggcgtcaccgggtctgcatgtgtcaccaggccgctgctgcctgtactaaattctcttccttttctaattgctggtaaagaagaattgctctgcgttctaaggtatagtagcataactagcatttaaatttggcaaaatttaaatatccaaaatataactgccaaaaataccagatgaaatgtcaaaagacactccactcttatctctgcgaccctacctactttctattaagtgggacaaccagtgattggcaatttagccttttttttatctatcttcttactcgttattaaagactttaaaaacagctatattttaaaacgtactccctccgtactcgtataggaagtcgttttggacagcgacatgatctccaaaacacaacttttacttcttatttctataaaaatatttattgtaaagtgatatatgtatacttttatgaaagtatttttcaagacaaatctattcatatagtttttatatttttaaactcaacaacttgagagttattcatgatttatattcctaaggtttaacttaaatattatcctaaacgacttcctttacaagtacgggggagtacgcctcctttcataaatcgaattaattttgataatatgtctgtttttttcgaaaatactattatattttttataaacttgattaatttaaagcagtttaattagaaaaatatcaaataacttataatatgaaacaagcactgtactggataagataagatttggagggtacttcctccgtttcaaaaaaactcaattcctaggtttctgtgtctaacgtttgaccgtttgtcttatttaaaaaattatgaaaaaaatttaaaaagataagtcatgcatataagtattattcgtgttttatcatctaacaataataaaaattgtaatcataaaataatttcatataaaatggacggtcaaacgttggacatggaaatcaaataattcagttttttttttggacggaggaggtaaggtcaaagagcggtaaatttttaatagagcagtagcagcggcggcagcagcaagagcaaatatcatgattattcggagtactagtgtacaagctacctgtacgaataaaaacaagcagcagaaggtcgggtgcagaattattacgctttcaccttcgttgcttctcctctccgattctctcttgctttccttccctttccctgtcgcgagcttacgcgtcgttgtcccgcgggggcggagagagaaatccccactctcactccatccacctagtctaatccagcttgctgccgctgctgctgttgctgctgcgtcacctcagtacctcacctcatctcatccatcgtttgctccgtttctgtgggatttccaccggctgattctctcgccctcctcccataaagcgaccggtggttcgcaccggacggatgccccaatctttgcatcgaggggcaacgaagcgaggtcacggatgcgggcgatgccaccgccgtcttcttgtccctagatccatcaaggtatccatttctttctctcccccctccgtgttgcccgtctctctgccacttcttgttggtctaatcgagcaagaagggggatgatggtttgtgtggtgtggcaagaacatcagggcttgggtttcttggtggtggaggttgttgatcgattctcgttgtgccccccctttgctggaggcagatcgatctatgtgggcaccttctgttattaaggaattatattcctttttcacggttttcaaggcttcgggagcatcataaacacgtttatggtgttgagtgttttgggtcttttacatctgtacagttttatatgaatcctataaatggacttaaaactatttgaaaaaaaggatatttgtgagttggcaaatatggaacctagttaactcattgccgaatggtataattttgcatattaaaaactttcttcaaggatgagcagaaaatttgagttcaaaatcaaatccagttgcctagtactttgtctgcatagaagatgcagggcacaagaattggttatgtaatgctgatacttgaccaattcagttgattctttactgatattcatatgacaggaatacaggattcaacctatgttcctaaataacaataataacgttgtcaaattgcaaatatgagtcatcctccgggttctgattagatgtttgttcatcctccatgctctgattactgtgcgtgcagtgttaggaggacagagacaagaaaatgcttgtatatctgccaatatcgtgttcttggttgttcatatccttggtctctcatgctttcaagttggccttggccatcagtttatgctctgtgcattacctagctttgtttaatgtgtattggtcaatcccgagaaaaaggaactacatgatgaccttagttcatgcttattaaagcagtgtcatatctctcatttcaagccatggaactctttccattgaaaacctcatttgaaacaacggttgaagtacaacagtagaacacaagattagtatttcttaaaaattgaaatcctagaatttagccagcattttatatgcactgatatgcatgcttgcactttgtggattatgtgtttgctctgttgcttgagtttattttatcctccttctgtgtgttgctttgagcgtgcttctgttgttaaactgatgttgatgttttctgtttatgattcagtgaccagttctctgatcagtgagaataatggccgctgctgaagcaagggctgcttggcagcgtgctgcaaaccgttgcatcgttcaggaggatagaaaaagagcaccaaaactagcctgctgtccaccatcatcagaacagcagcatgtcaaaagcaatggaaattgtaggaattctgaagaccgccctgtgcccaatttcatgccattgagctggaatcccatgaactccagtctgccacctgatattagatggtggcttcagttacaaccaaatttaggagggcagaagaatcttgcaggtgagcacctatattttctgggaagagagatcagtgataaggaagtggaggattcagcacaaaagaatatacacgacgaaccattattttgtgaaatgttcgacaccaatcctgagaagattgaggatgtttttgagccttcgtggatggtttccacagcttccatgaagtattcttctgaaacaggcttacaagacttgaaaaatataggtggctattcccaagttccttcgaagtgcaaagaaaatgccagtgactgtttgttcaatgataaagaattcctggatttcaaaaattttaacccaccaccgtcgaagaacccacagaaggacgattttgatatgaatgcgccttggaaaggaggtgaaaggagtcaaccatggtggcagatcactgatgagaatgagctggctttactggttgcagaaagagcaatgcagcatattgagaattgcgatttaccaagacctacccagatagttcgtgttcagggtactgaatcacgcagtcatgaaaatatgggtaggtacagggggtcatcaggtccagcaggtacaatgtcatatcctgatactggacaatgtgaacatattgaatgcagttacagcacagcaagcacagatgaggtggatttaaccagtgatggagtttggcaacagcaggaaagaaatgttgcacgcaggtgtgtatttcttctgccttactctgtcaccaatttaccctgatgccataattgtaatttccgtaagcatacctaaattttgatgcacatctattttaatttcctagttgatatctgaagttcaggtggtgcattacttctgtattacaaatagaattgctaaatattactgtagtctgaattatttggtgctaagtaggagtttccctttgtgttcgctaaaatgctgtttggtgctagtgagatcttttgtctgttcctgttcagttctctttttgaaaggaaaacttattatactggttaagtttcagttttggttcatttcagagatacattgttgctcactgcctacaggataatggtgccattgcccttgtttgcaaaagagttcatggacttcttcaaaaaagttgcttgttatatttgtttcatttaatcaatacctagagttttttttttaaaaaaaattcctattgttgattgggaactacacaatttcacaatctacattcatctattttaagttatgttccataatccgcactcggaaacttcaaatgtgctccattatttttcagtttcttgtgtttttctggttatcatttcatccaattttcctgcagtgatgcacaagatttttctaggggcatcaatacagaaccacgaggcaagcgaacataccagaatcctgcagagcaagctcaacttttggaggcactttgtcactcgcaaacacgggcgagggaagctgagatggctgggaagaaagcacaaagtgaaaaagacgatgtcatcaagctatttttcagacaggcctcgcatctctttgcgtgcaaacaatggctgaaaatgttacagttggagaacatctgcctccagcttaaacacagagagcatcagatagcaaccatgatacctgatattccatggattacactaaagaaaaggactacaccagatcatgagaaagaagattggacaaggaagaaaggcagaaggcataaaaatgcagggagtttctgtgacgcgctcttatttgccgttggtttaggtcttgcaggtgcagggctgcttcttggctggacatttgggtggcttctggccaagttctgaagttgcccatagttttcaactgagactagcttagctagctaggcatgtattttgctgtgcgcctgtatgtgatgattcatagatgaaatctccaggtatactctccatattggagtgagatggcgaaattttagacccaagaatatgttcgtttggaagctctgctagttagaagacacgaatgtatagggagcatttgttgcaaatttgcaatttgtaaatatgggaggaggacgtctgtgaatgcttgtacatactgatcagtagagaaaaaatgtcatcggacttcttcaacagtactccctccgtcccaaaaagaattaagaggggataagaattaagaggggatgtgatctctcctaggttgatctccaggttgatgtatgtgtttttgggacggagggagtatctccacctgtacctattatttggaaaattagcagcgttactgcagattgtgtttttcaaaacagggaactaccaagcggcagttctgtctgtttttcagtgaattgcaggttatgtgtttttcagtgcaagcaattgttggttatttgcctgaaatgaaattctgtcacattctagttgtttctgcttggttcttttacaatgttcaaatatgtacagactatcttatttctttcttttaatatgttcacatttaatttttgtttgcctgcctgttttcttcaaacaaggatggtagagtgctagtggtaattaatatgttacttcacctcttctacgactacagtatacactggccttctatgaatcgcctcttgatgctccttaaagtttcataatagggattttgtatcatctgttcggggttttttttttatttttagcattcttgtcaattctgtaacatttgttcagcatttcttatgtttccaaaatactagataggtctcgccaagcttagaatcgaattgaatgcaacaaagtttcgcatttgttctgtttggttccctgagcatctatttttcctaagaccaaggagtgaggtattggtgttgaagttatcgtacactgctccttagttgtcattttatttcttacaaaaggttagtggataacaaatatccgagggactacaaagaattgaaaagattttatcatagcctcaaaattatttgttcacattcatgttaaagagaaattgggttcaaaatttgataagcatcgatcccacacaattgccgtctttttttagagatacttctgaaaaccccctttttaattttttttattgttcaccaaattttcgtttaggcaaaactcatacatggctgaggtaaaattgcacgaacataacaaatgagcatttgacagtatactcaccgtgcaccttgaaagatgatgtgttacttctttgcatgtccgcaatttattgatttgtttcccgagccctgacttacctctagtgtgaattgaacgtgaggactcatccgtcaattcgaaaactttcctacagggttagtccacagaagatatgtgtaacatcccgccttcccccaggccaggcccgcttacatctggcagcttttatataggtcatagactgccctcacagaccaacacatgtcttttctgcacactaagatgatgtgttactcctttgcatgtctgtaatttattgtgttaattcgaaaactttcctacagggttagtccacagaagatatgtgtaacaatcccgccttcccccaggctaggcccgcttacatatggcagcttttataggtcatagactaccctcacagaccaacacatgtcttttctgcacactttgtagaagatatgtgtaacatcctgccttcccctaggccaggcccgcttttataggtcatagactgtcctcacagaccaacacatgtcttttctgcacactttgtcctcactcgtgtgcacccgggaagaatttcccggtcggtcactcatcccaaattgctccaggccaagcacacttaaccctggagttctttggaaatcggcttccggaaaagaagtcttaaccctggagttctttggaaatcggcttccggaaaagaagttgcaacttgttgatatgagtattctattaattctattaagccctgggccggaatgtcacaatatgcatcctatgtccatgaaagtactagctctaatggttcattaatcgaattcaacatcatgtctaatttaattaacgcagaccattttgacctaagcaccatgcttaaatcaaaaaccctatggatgtcttacgaacacacccaaactagagcatacaaaaataaacaaatgaagcataacatatacgatcaagccatattcacatggtggtactattgagtaaaggtttggtgaaccttgttttatcttttacataactgagtgtacttaccaccagcataatggatatgttgaaatctttgaaacagtggcatggtcacatatgattgtcgatctctcatccatctgatgcggattgtagcggggcaaggcactttgaccatgccaagccaggcagctgtaacatcctgaaagttaactactttctaattatgcatcatgccagttcttatgttcttaatacctgaaagtgcatctaggcccctaatgattttgatgattgattacaatgcgattagagaggaataacacttttattcaagcaaatatgaaggttgttatgtcctcgacatgttgtaatgagatgcataccccatgaatgcaacatcacgatgcaatgcggcaatgatcaaatggtatattgtatcttttaccttgcattgtgtcgtaggaatgccgtactattaagagggataccacatgcatataattggtagaacactagtgctcaaaatgcttcatctttgtgtgagttgaaaaacctaagccaaaattttaatcccgagttgtttcacttgtcacaacacttacaccgggtttctttgcaagtttttcaacatatcttgaaggttttggaccattttttatgttgggtttgatagcccacgaaactagctttccatagagtccaaaatcttcgaaatcggagttcggagtaaaaagttattgcactttttacttgagcaacattagactatccgatttgaaatcagactatccgatgtatcggactatccgatttttcacagaacttcactctctgtctttgtttgaaaaatcctttcgagtgagtttttctatttgtcggagtatctgatgttggatcagatagtccgatgatacagagactctgaaatttcatggaacttgagtctctatttgaggacgaagtttttgcttctaaaatatcggacactccgatttaacatcagatagtccgatgtctcggaaagtccgaaatttcatggaacttcgttctctgtttcttgttgccttggaggtttaaaatatcggactatccgacgtgggctgaaagattcccctccaatggccacattttttttttgggggagggggggttctataaataccccccacctaacccttttctagggttacccaactcatttcattctcattcactttgggttgagcttggtgctaaggtgctttggatctttgagctcattctccctctctcaaatccctcctcgttcattgtgtggtgtatcttggtggttgtggatttggtatttgagggcctagtgtgtgtttcactcgatcttgagcactagggtttgaccaagagttgtgtggtgtttgttactcttagaggatgaggactcctagacggctaggtgtcactcccgagccaccgatctacgtgtggttggccgggagaagtttgtgaaggcccgatctcgcctccgcaaggaaagagataccccttagtggaaggaggagtgcttagtgtaacctcttgaggaaagggttagcaaagacccggctcttagtgagctcctcaacggagagtagaatcccctgaaggatttgaactccgggaacaactccgtgaacttcatcgttggtgatatctcttcatcctctctttagctttgcttaattgtgctgctatagatctagtcgttgtttgcgctatactcttgtttgtgtgctagatctgcttgttgtgattgtttagtggatcagacaaactgatccaacatcagactatctaatattttcggatagtctgactgtggatcagactttccgaccttaactcaattttagtttccgcataaagttttaaattagcctattcatccctcctctaggcctaattgaccctttcaataaccttctaaacctaggacattataattagagggccaactgggctttcacattgtccaccatgtgtcatgtggtgggccaggtgaatcccggcctcaccaaatggcgccacggctctcttcttgcccagttggccgaattgggtgttgccaggcatgtacgacatgtgtccagactcgcatcgtccctaatgactcagcgctactgtcttttccacgtcttttcagtcccatcggtttggaatctttttcctaaatttgtttcatttatggatgtgatcgttgggttatagctggcgggggggggggggggaggggtcagggccttgactttttcaagtcttcggccttgcccctgtgccccttagcagggagattgagtgtttttaggctagcttctcgaagatgtctttgatgaacaaatgtataatatgtagatcttgtatgcatccacggtcctcttcagaaggaacgtgtagtgtacaaggaccaaggggggccgggtcccagaccagatcgggacctaggctccatccagtccataattttaatatgtagatcttgtacgtttccacgctcatctcaaggaggtatgtgtaacctacaaggacagtgtggggcaaaagtctgccgcaaagacttatggtatcttagagtttgttagagataagtgtcgtgtccgatatggacatagtttgtaattctcgggtataaatagaccccggatcccatataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcaaccgattaggttagacatcaatgttgacttagattatataggatattcaccactctatgaaactttcaatggcttgattgtctagatattgtccttcttttcatacttatagctgcatcagttgagtttgatcttataagtcatgattagaatctcaatctctagcctgcttcttggttgccgattagggtagtatcggggtttcagctgatcttacctgatttaactatatttactccatatgcttcgttgatatgttaaatctgccctttatgttaagatcttgttgcatttaagtatattaggcctttgtttgatatattttacttgctttaatatcttaatatagagtggtatcggagtattagccgatacatgctagatctatctgatcggctatgctatgaacatatatagtcccgttattaatatatattttgatctaagtgatttatactgtctcggcatggcgaccgatctatcccaatcacttgatttaagtatatatcgatataaggagtatatattgttaatatctacagccgatcgagtagatttagttccttcttatttattcatgaccgccgatcgatacatatatgacatcggcccaaagataaatgatatgtcatcggcactcagccgatcggctatcgtttataggtttaaccgcggtttctttgtctttgtttcttgttgattgtaggatcaaatcaactggcacgcttgcatacccgaaggcgagttttggacctgcactggagttaagcagatatcccaggcctcgtgttttatgtcaacacgcttttggtacgcctggtgggacagatcagaagtcagaatcacaacaacagtttttcccatggccgagaaaccgccagcatcgccgtcctcggctggtgaacctggctatgttaaagccaagatccacaagctgggtctatctgaggttgatgaagccaacattgtgcccgtcactatggataaattgacacccgagcagcaaaaggatcttgaggcaatgatgtagcaagcacggaatcagttcttgagctcattcacggagacccgcaagggaacacttgttcaaaagtacaaagtaaaagtaattggtgatgttcctgggacaggttcttctaaggatggagaagtgaaacaagctctagatgacgcggctcaaccgagtaataaaggtgctgcagatggctttcaaggagatcaaggtgatggctctcaaggagttcagggtgttggctctcaaggaattcaaggtgatggtgttcagggagttcaaggtggaggtcttaatcaagatggcaatgcaacacagttacagtttaacaacttccaggatcaggttgactatgctatgcaccatgctttgatcaatcaatctggaatattagtcaacactttgtcaaacatggtgaagataatggttgatggttcaatggctgaatatcaggctacatgaccggtttatctaccaggaggggtattcctgaattatcggccattagtcactgataatcagccagctgttcaatcaattcctcttaatgcaccatcggctcagccgacggcaccagtatcggctcctgcacctgctgcaccgtcatcagcaccaggtcaattagtgaatcctcgattgttggtgagagagaaaccacagcatagtggatagaatgtgaatcggctaacgcaggatcatgttgcagctatgttcttatctcctcaacctactgttgatccaacccagcagcagccgattcagcaaataccaccaaggcagcaggttgtacagccgattcaacaaacaccaccaatccaacaggttgtgcaaccaattcagcagacgccacctaggcggcaggttttgcaaccaattcagcagacgccattaaggcaacaaattattcagccgattcaacagcaaggcttgatgaatgcatcggctgggtttgcaacacctgacaatcagccaaggcagcatgctgcgaatcaagttgtttcagagcacttggttcatcatgtacagccagatcagacggtaatacctcaagttgtccccgagcatttggtgcacaatattcagccaaattttcaaaattaccaagggggcaatttgaattatcagtatcagcctccttcaccgcaagttcaatatcagcagggaggatcggctcaaccccagtttgttcctcaatacaatcaattcgagctcatgccacaataacctcaaggattaccaaagcaacgaccatgggccgatatgattgcggatgtgatgaaagagtagtttgggctcaggccgaaagacgctagaaatttgtatcggtatccttaccctgaatggtttgagagggttcctcttcctaaccgattcaaagttccagacttttcaaaattctcagggcaggatagtgtgtcaacttatgaacacgttagccgacttttagctcagtgtggtgaagcatcggctgtggaagccttgagggttacgttgttccggttgtctttgtctagatcggctttcacttggtttacttctctaccatgtggattaatcaacagttggcctgatttggagaagcaatttcatagttatttctacagtgggattcatgagatgaaactgtccgatttaacagtgatcaagtagagacatgatgagtctgtgcatgagtatattcagagattcagagagatgaggaataagtgctacagcttgagtttaactgatgcccagttagccgatttggcttttcagggtatgattgctccgatcagggagaaattctcgtttcaagactttgatagcttgtcacatcttgcacagaaggtaaccttgcatgaacagaggtttgcagaagccaggaagaacttcaaaagggttaatcatgtctgtccttacatatatggatcggatgatgatgatgatgacgactccgagatagcagcagccgaatgggtgaaaagcaaaaaggttatatcatgccaatgggtaaagaattctggaaaagaggagagatatgactttgatattacccaagctgacaagatttttgatttgctactccgagagaaacagattcaacttcctgctggccatacaatcccattggctgaagaattgggcaagaggagatattataagtggcataattttgggtctcattccaccaatgtttgcaaggtcttcaggcagcagatccaagcagctattgagggaggcaaaatcaaatttgatgattctaagaggccgatgaaggttgatggcaatccttttcctgtcaatgtggtgcatacagctggccgaatagccgatgggggacacgcaagaggtttttaggtgaattcggctaaaattatcgacaagtatcagaagaggtatgacaaacaacaggagaggcattacgaggaaggtgatgacggttttgatcctcattggggctgcgagttctttagattttgctggaacgagggtatgaggctgtcatctatcgaagactgtcctggatgtggtaatattgcagaaagctcaagccgatcgtataatagaggcaatcggctaaagcaaacaagagttcctgttcatcaaaggttagtcccggtgaaccaagattgtaaccaagagggcaatgaagacaggaagactcaatggtgtccttctggtatctttataaagaatcagaagagaagggttcaaagattgaggaacagggagcacttttaggaggtcgaacaggaaatcaatcatcggctaaagaaaatgaagccgaagcaggagtggcgagttaagaatcaagctcctatagccgatgaggccgcagccgatgaagcaaagagattggctaaagggaaaagtgttgtaactgcatcggttaacatggttttcacgttgcctgctgaatttggggtcaagcaagccgatgtcgatgaagttgaagaagaatcagctaaattgattttgtcaccagagcaagcaatcttcgaaaagccggaaggaacagagaatcggcatcttaaaccattgtatataaatggctatgtcaatgggaagccgatgtccaagatgatggtcgatggtggggctgcagtgaatttgatgccttatgctacattcaggaagttgggcagaaacgctaaagatctcatcaagacaaacatggtgctcaaggattttggtggcaatccatcagaaaccaaaggagttttaaatgtggaattgaccgtcggcagcaaaactatctctacaacgttctttgagcatcgatgggaagggttcctacagcttgttgcttggaagggattggattcatgccaattgttgtattcctccaaccatgcattaatgcttgattcagtggcaaggcgacaagattgaaattgtgccagccgacaggtcagtcaatgttactagtgccgatttagctctttgggagatggatggtcttgattgtttatctggaaaagtttaggatggagattttctaaaagtgtccgattctgatatacaaccaattgaagatggagaacctaagctattattttgagggcgtcgtggatgatctcgatgacaaacaaggacagggtttcatgtcggccgatgatttggaagaaattgacataggtccaggtgatcgaccaaggccgacatttattagtaagaatttatcttcggaattcagaaccaagttgatagagctgttaaaggagttcagagattgcttcgcttgggagtattatgagatacccggactcagccgatcgattgttgaacatcggctacctatcaaaccaggggttagaccacatcaacaacctccgagaagatgcaaagccgatatgctcgaacctgtcaaggctgggattaaacgtttatatggtgctggttttattcgtccatgccgatatgccgagttggtttccagtatagtttctgttatcaagaagaacgacaaagtgagggtgtgcattgacttcagggatttaaataaagctaccccaatggacgagtatccaatgccagtagccgatcagctggttgatgctgcctcaggacacaagattttaagttttatggatggtaatgcaggattcaatcaaatctttatggctgaagaagatatccataagacagcttttaggtgtcctggtgcaatcgacttgtttgagtgagctgtcatgactttcggcttgaaaagtgctggggctacatatcaaagagccatgaattatatatatcatgatctgatcggctagttggttgaagtctacattgatgatgtggttgttaaatctaaagagatataagaccacatagtcgatttgaggaaggtttttgagagaaccaggaaatatggcttgaaaatgaacccaacaaagtgtgctttcggcgtatcggctggccagtttttgggatttcttgttcatgagaggggaattgagattacccaaagaagtgttaatgcaatcaagaagattcagcctccagagaacaagacagagttgcaggagatgatctgcaagataaattttgttagaaggtttatttctaatttttctggaaggttagagccttttacaccattattaagattgaaagccgatcaacagtttacttggggggcaaagcaacagaaagctttggataatattaaggaatatcttagctctcctccagttttgattcctccacagaaggggataccttttaggttatatctgtcggccggtgagaagtcaatcggctcggtcttgattcaggagctagaagggaaagaaagagttgtattctacttgagccgtcagctcttggatgcagaaactagatattcccctgtagagaagttgtgcttgtgcttatatttttcatgtacaaggttaaggcattatctattgtccaacgaatttactgtagtatgctaagccgatgttattaaatacatgttatcggctccaatcttgaaagggagggttggaaaatggatatgttccttaactaagtttgatcttcgatatgagtcaccgaaggcggtcaaagggcaagctatagccgattttattgttgaacatcgtgatgattcagtcggctcggttgagattgtgccatggactttgttctttgatggattagtatgtactcatggttgtggtatcggcttagttataatttcccctcgggggggggcaagttttgagtttgcttatactattaaaccttatgcaacctacaatctagctgagtatgaggtagttcttaaagcattgcagttactcaaggaagttgaagccgatgctatcgaaattatgggggattctttgctagtaatcagtcaattggcaggagaatatgagtgcaataatgatacattaatagtttataatgagaagtgccaagaactaatgaaagaatttcggctggttactttgaggcatgtatctcgagagcaaaatattgaatctaatgatttggcccaaggggcatcagggtataagctgatgatcaaagatgttaaggttgaagttgctacattaacggccgatgattggagatatgatgtgcattaatatttacagaatccatctcaatcgacttctcataaattaagatataaagcgttgaagtatactttattggatgatgaactctattatcggacgattgatggggtgttgcttaagtgtttgagtgccgatcaggctaaggttgcaatcggcgaggttcatgaagggatttgtggcactcatcaattggctcataagatgaagtgattgcttcgacgtgcagggtatttttggccgacaatgctggaggattgtttcaaatattacaaagggtgtcaagattgtcagaaatttgaagcaattcagagggcaccggcgtcggctatgaatcctatcattaagccatggccatttagaggttgggggaattgatatgatcagcatgattaatccaccatcgagtaaaggacataagtttatattggtggcgaccgattattttaccaagtgggtaaaggcgattcctttaaagaaggttgattctgggaatgctatacagtttgttcaagagcatataatctatcgatttggtattcctcaaaccattacaaccgattaaggttcaattttcgtgtccgatgagtttgttcagtttgccgatagaatgggtatcaaattgttgaattcttcaccatattatgcacaagctaatgggcaggccgaggcatctaacaagagcttgctcaaattaattaagagaaagatttttgattatcctcggcaatggcatactcgattggccgaagcattgtggtcttatcggatggcttgtcatggatcgatccaagtccctccttataagcttgtttatggacatgaggctgttttaccatgggaggttagaatcggctcaaggagaacggagttgcgaaatgatttaacagccgacgagtattataacctcatggccgatgaaagggaagacttggttcagtctagattgcgagcccttgcaaaggtgttgacagaaaacacgaggcctgggagatctgcttaactccagtgcaggtccaaagctcgccttcgggtgtgctagtgtgccagttgatttgatcctgtaatcaacaagaaataaaggcaaagaaaccacggttaaatctataaatgatagccgatcggctaggtaccgatgacatattatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcgtcatgccgagacagtataaatcacttaaatcgaaatatatattaataacagggctatatatatgtttatagcatacccgatcagatagatttagcatgtatcggctaatactccgatactactctatatcagaatattaaaataggtataatatatcaaacaaagacctaatatacctagatacagcaatatctcgacataaagagcacatttaacatgtcaataaagcatacagagcaaatatagttaaaccagataaggtcggctgaaactccgacgctaccctaatcggcaaccagaaggcaggctagagattgatattctaagcacgacttaatagatcaaactcaactgatgcatcattaagtatgaaaagaagaacaatatctagacaatcaagccgctagaagtttcctagagtggtagataccttatacaatctaagtcaacattgatatataatctaatcggctgccctctacagacagatgttggacgattgtagattagattatgtaagacatatgataacttgacgaattacatagacaagattagagtgtcgtaaagatggaagcactaatcccgagaacacaatccatcataacaagttttacctcttgttgaagatcgaaaccgatgtagctcaacccgaaagcaagaactcgtcaaaataaaactaaagcaaaagggtggcgatgcgccgagattgtattgaacgtgtgttattaaaattacatagggcttgagtctatttatacccgagaattacaagatatgtccataacggacacgactactatctctaacaaactctaagatactataagtctttgcggcagacttttgcccaatcatatctccaaggagattacataaaacaccctaattaatagatgcaattgccttctcaggactctatccatgtgcggcaatcaccttgaagcacctcaatccaacccgatatcatatatcaagctgcattgtcggaatcggctgtatcggcttacctagtccgactcagacccatccgatcctaatcgtagccgatttggactccagctgattcctgccctgtttccgaacttgatctccgcctccgattttgcttcgatctaatcttctttcctgatgctaatgttaccaaattcggttgttaacaaaaggttaccaaggataaggaacgagttgctcggcattacaacaagaaagtggtgcccaaagcttttttggaaggtgaacttgtatggaagttgattttgccgattgggactcgggatagcaaattcggcaagtggtcgccgaattgggaaggaccgttccaaatctatagagttgtctctaagggggcttacatgttgcaaggcctcgatggagaagtttatggacgagcactaaatggcaagtacttgaagaaatattacccaagtgtttgggttaacacatgatcggctgatgttgccgatacatgatagccgatgtgtttgcatcgccttgagatggtcgatattgttatatcacccttagttgttttcatattgtaatcggttgtgatttgccgatgtacaatggccgatattgttatatcacccttagttgttttcacattgtaatcggttgtgatttgccgatgtacaatggtcgatattgttatatcgcccttagttgttcttataattttatcaatgcttttgtcattgtaaaattaggggggcacatatatgaaaattgcagatttttgagcaaaatatggagttctattgaatcggcataaaagttatcaagataagttcgataaagagccaaagtttcttagccgattacaaaaaatttctaagacctattacacaagatatcactgagacaaatgttgctggatagccgaaatagccctttgcctgatttgttctacttcttcaatggcttgggcatcttgagcgtcgattctagggatgacttttaaagacttggtgagatcagcaacattcttgatagccaattttagtcttgtcttttgttcttcgacagattttgggagatcggctagctttttatgttccatatccagctcggcgttgcattcttcaagttgtgccaagagttcaatcttacgagcttcgagccgatcaatgttagatttaatcgggccctcagatagttgatcaagtttggccttctcttcatgaacaagctatcaattggcctggattgtggcctcgatatccttgcgctcccgacgtttagctaatctcagcttggctttctccagcttgaattgatgctgctcaagatagacggctggagtacggacatcggctagctcatctgggattagagcttgaacctcgtgtagctgagtcctaattgagccacaatcaaccactaagctgtctaacgatgatgcctctagccgctgagagatatcttcaagaattttcttcacatcatcggataaaagggctaaagctttgcttctggtatcctcttctgtctcatcaagatagtctctaatgtcaaaagagaaaagatcagctaagacctgcaataattatttaaagagagttagagctaaatagacctagccaatctaaattcttgtctcaaaaggaaacttactaggatagcaggagcagttggttgttcttcttcttcaatatgatggctctctatagccgatggagtttggtcactcgatgattgttgtataggagaaggaggaggaggaggaggctataaaaaagacaagtgttagataaaatcggctgagatcaactagtggaagagttaagaatatcttactcatggagctggtttgagaattgttattgccgatttcttcttcacagcagttttttcttctgcaactataaaatatgtgagtaatcggccataaaatgaagtgattacaaaaggaatcaagggaagttgtttactcttgaaaaatgggctggggcagaaggagttggaggagtttgcttaggtgaagccgatggagttctttcagtatcgcttatttcatctgcggcttgatcaacatcctcgccgatttcttcttcatccagagcttgttcaatggatggatctagggcaggcagatcatcagttggcttcgttttctttgacttgactttcttctttggagcttgagccgatagatccgcagtcgatgacctggtttttctctttttaccggtatcggctggttctctgatgaacccttggagaagagttgaagtcctgggggcacgataaccaatgacatggggagatggcccgcctccattaggaatcagacctggagcatattcgatatttctaccactattgctctgatgaggaggagagaattctgtcgtctgcaagtcaaaaagaaaattagtcaagttatgaatcggctaagcaattattcagacaaagttaaatcggggcatacctgagggataacatctggaaagaggtatgtcatgtacatggaagccgattgatagaataggtgcagtttccattcaccccaccatctgttaaagtttttgctcctgaacattgccagctctatattctcaatgctgcccagaggaggtccttgaaggttgagcagccgatccatcatcaaggttgatgaaattaaccttgagctcccatcggactttaggtttgaggacattaatcatgaaagataccaaaagtccagggaagttttctcagctgcaatcagcccatgcatccttcctgtcggcatccatcaggaagaaatatccaagtctcttatgagttctatcatccaatgagctcagctagacaacttggaatgggccaactcccaatcggcttattctttgccgataagatccagtgccgagtggaacttacctcagcgtactcggctgacagcgcggcagacgggctatcggaggacgacatcgccgtgggcagagatttggccaaaaatgaagtctcctggggatctccttgtgcgtcggagaaatcgccggagagagagaagacagagttggcttcggcggtgaaaacggaagaagacggtgtgagatttctcgggggtaacggttagtatttaaagcgatggaataacagtcgaaaaacggcaagagcgaatttcgctcggagttgatatatggcaaatccgaaacattgctaaatattccggacttggggggcatgtgttaacgaccaaatttggtaatatcagcattggagatggagattagatcgaggcagaatcaaagatgaagatcgtttaggaaacagagtaaaattggctggagtccaaatcggctacgaccaggatcagctgagtccgagtcagactgtgtgagccgatatagcccattccgacaatacaactcggtatacgtcctcgggttgagttggtatgcttcaagatgattgccatgcatggatagagtcctgagaaggcaattgtatctattaattaggatattttatgtaatttccttagagatatatttgggcaaaagtctgccgcaaagacttatggtatcttagggtttgttagagataagtgtcgtgtccgatatggacatagtttgtaatctcgggtataaatagaccccggaccccttataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcagccgattaggttagacatcgatgttgacttagattatataggatatccaccactctatgaaacttccaatggcttgattgtctagatattgtccttcttttcatacttatagctgcatcagttgagtttgatcttataagtcgtgattagaatctcaatcttagcctgcttcttggttgccgattagggtagtatcggggtttcaaccgatcttatctgatttaactatatttactccgtatgcttcgttgatatgttaaatctgccctttatgttaagatcttgttgcatttaagtatattaggcctttgtttgatatattttacttgctttaatatcttaatatagagtggtatcggagtattagctgatacatgctagatctatctgatcggctttgctatgaacatatatagtcccgttattaatatatatttcaatctaagtgatttatactgtctcggcatggcgaccgatctatcccaatcatttgatttaagtatatatcgatataaggagtatatattgttaatatctacagccgatcgagtagatttagttccttcttatttattcatgaccgccgattgatacatatatgacatcggctcaaagataaatgatatgtcatcggcactcagctgatcggctatcgtttctaggtttaaccgcggtttctttgtctttgtttcttgttgattataggatcaaatcaactggcacgcttgcatacccgaaggtgagttttggacctgcactggagttaagcagatatcccaggcctcgtgttttacgtcaacacttctcaaggaggaatatgttacttacaagggtaatgaggggccgggcccttcataacctacaccttttaagatataaaccttataggcttgtacactcttctctgcgaagaacataagccctaaggatagatggggactcaggatcctaggccaagttgggctcctggtcccttcctacttgtaatcttaagatgggagccccctgtcccaagtcaacttgagctctcgggcttccttcatgaggcgggggcgtcggggcctgtctcgaaagtgggtcccatgcccgctatcgttaacgtgcacttaacttaatggtggtttaaatatggtttgttattttagttaacaaggaatatgtgttaagttcccgggaaagggtaccccaattcccgtttcaccaataactgtagaactgatctttcgtcatggtacctaaaaacacatactccgtatttctcagatccactaccaaccggcactaaatattatttttagtaccggttggttttaccaaccggtattggtattaaagattaacactttcgtatcggttgttgtcaccaaccggtgctaaagcttgtcacctttttatatgccttattcttcctccagcccaagccattgctgtcaagaggaggaggaagagaggtcataccaaaattttttgctaaagtattttggtgatattacacaaataaaaaatatccaaaaggttagcaacttcatcctctatttcagtcaaaaaaaaaacttcatcctctattgatgtatggttaacatattacatttctagctatgttttcatacgtcattctctcaaaaacgtttacagaaaaagaggagacaataaatttgacgagaaaataagagcaataattttagagacattggatgaaaatgtaaaacaagaatatcaaaggataggaaatgaagggaaaaaaagaaaactaagtccatttaaaaacactaaaatagttagaaataagaagaatacattaaaagtatgtttataattttttaaaaagatttaaaaaataaaataaagataattcatgaaaaaattatttaaaattttttaaaacttgaaaaagtatgaagtccatttaaaactcattgaaatagttagaaataagaagaattcattaaaaatatgtttataattataaaaaagatagagcatgaaaaaatatacttacaattgcgttgttttaaattattaaatgattattatttatttattttcactttcgttgacttcctttaaatttcattgtttctgttaacaacggaattttgcatcagactcggagaagaagagaaaagatcgaggcagatttggttcggaatcgagttgaattcagagtcggactgcgcatcaactgcaattgtatcggctgaaaacagggcaggggcttgacttagccgatatggcaagtagccaatacaatattacttgggctcaatttgtgcctagattggactaactgtcattgccaattagagatagagcttgattaaggcaattgtatctattaattgggatatttaaatcggtttgtcagagatttggcaagagaccgccatgtgatcttgtttgtatctaatctttaggaaagtttgagtcgtgtccataatgtactaagtttgcactcggggtataaacatgtaaacagcctctccaaaagacatgcgtgcatgatcatcttcatcttcatcaagggaaggtaatatggaattttgaagatactactggttgatggcattaactgcatagatattcagccgtagctggatgaaccaccaagggcccccatgtttgacagataagcccattaacaatctagtcgatgtctggctcaaagtttaatagactgctcctagaagatattttcccaagggaatcggtttcttctcatgaatggcttgggctagatgctgaaggatggctgtgggaccacaagttgtgccgcagaatacaaatctctctaaccacaggttgagaaaggcgatgtgttcttgatctgtcactgggccagtacccatgttattggttgcatatcctaaccagccaccaccaaccttggtctttatcttatattcactcttgattttcaacctgatggggttggctgatgaagtgatatctaaaccagttagcatcttgatgtatagaacggttggtgtcattggcccttgaccaaatatgaaggagttcagagtatcagaccagaaataggtcgcaactgataacatggactcattttttggcatatcggctagggatagtgacagacacttagctattcccatctttttccacaaggattgcttagaagctgagattctcctgtaccattccttccattcatctaatttagatggccgagacccgaagactgtgggccaatgggctagttctggctttgtttctctaaaagggatcctattggtctcaacgttaatgaagtaagttgggtttgagtcacccattggaccaaggaaatagtgtgttgggtcatgcagaacaggaatcacaatttgccctctaagatgttgaatcaagagatttgaaagggcaaaccctaagtgacggaatgaagcaattggaaaacaaaggatgataaagaatgaagaatttacctcaggaacatcggaagtggtcgccattgcattttgcgcagaaccgcttgagaacggagggattcaccgccaagagccatgtcgccagagacagaggggatccttgaagtaggagcacttgtggaggacttagccggaaaaggagattttgaagcagtgggcactacttataagcttaacagtcagaacagaaaaccctaaaatttcgtgggtttgatgagagcaaattccactgcattatataatacatcggaattggggggcatgtgttaacaacggaattttgcatcagacttggagaagaaagagaaagatcgaggtggatttggtgtggaattgagttgaattcagagtcggactgtgcatcggctggcatcgtatcggctggaaacagggcaggggcttgacttagccgatatggcaagtagtcgatacaatatgacttgggctcggtttgggcctagattggaataaccgtcatagccaattagagataaagctcaattaaggcaattgtatctattaattaggatatttaagtttgtttgttagagatttggcaggagaccgccatgtagtcttgtttgtatcttatttttaggaaagtttgagttgtgtccataagagcaggtacaatagcagactattagctagctataaatatattttaatgagataaaagatgagagagaagagcagtgggctatagatctgtagccagctgcagcacggactccaagacgcaatgtgtgtatagcatgtgggaccatatattaatagtatagcaagcaactattgtatgaattggctattacattggctatagatgaattgaagttagtagtaggctatactattaaacttgctctaatggactaagtttgtactcgtgggtataaatataaaccccaaaccattgtaataatagagacaatccaatacaacttcagcgcatcgtcaccctttttgttcttcttttcgacgagttctcttgataagaggtaatccgtttcgatggcttgtgctattggggctattatgtcggtttagatgttttagtccttttatcataaccatctgctatcatatgctcaatttagctctatcggctggttcttgttttagggttcttgccggtatcggctaaattgtcttactagattagattaactaaggcatctaccatcttgaaaaatatttaattccttgattgtttatactttaggtttctttacctactttaagatgcatcacccctactcttgtctagaatcctaaaaactaacctagaattaattataattagagatagtattggagtttaaaccaatcttacctaatatacatgcttcttcattagttttatgtatatttgccacttatatagacatatcactccatataaatatatcaaatctagatcagtatcggccgggttgccaagcttggtagttgatcgttatttgatatatttctatggattaatttgtttatataagtttgtactagagtattagctagtacattatatttatttacctatcttactctaaataccgttccatcagctattttcatgatatcgtctaaaatctattttatcaaactaagcagatcatattacagccgatgcggcatatttagggttttatattctttgatctactcagtctatagccgatttggtctaactacatcggctgagaccatcaacgatacgtcatcggcctatcggctaactcgctttcttttttgttccttgctggtagcaggatcaaaccagctggcacgcccttagcgcactcgaggcaaccttggatctgcactggagttaagcagatctcccaagctgccgtgttttccgtcaacaatttcatatagatgaatcggtaatggatgtacaccgtggaccgatggtcgaaggagtttattgatggcatgcattatttttttagtgtggccaatgcccataagcctaagggttttatatattgcccatgtaaaaaatgcaaaaactagaaggagcactctacatcgagaccgcttcgtgtccacttgttggagtcaagattcatgcctagttataattattggacctcgcacggagagttaggggttgcaatgaaagaagatgaagaagaagacaacaatattccagactgggctcaatacgatggatttgcagaaaatccaacaggcgaggtggatggagctgttgcagaaaatgatggtgcagatgatctcgatcatatgttgtgtgatgtaaagaaatactgaaagtgaaaaggacgtctagaaattggagcgtatcttagcagaccacaaaacatccttgtacccaagttacgaacatgggcataaaaggttgggaaccacactgaaatatctttttgatgttaatgttcttgtatatgtttcttaacatggattttccaatggtttgtattagtttgtaagtctttcgattaggactttattgtaaagtctttgggataataagtagttggtttgtatatgcttttcaaatatcttgcattggttttatatttcataacatatgttgtgataacgtgcattgcgcgtccacgattactattaatatcaaaagcaggacaagccgattaaggttttgttaggatcttcatttgggatttggttaaccgtgagcatgcttcctaaactattaaccgatatattttactaaaatctttagtaaaatgtttcctaaaataaatctaacaaatttatttttcaaatttatagtaattaatacttaattaatcattcgttaattgtctactccgttgtctgcaccacttactaacccagtcaaaccatacttatgaatgcaacctaagggtgtgttcttttgtgcaggttcccaacttctttccaaggatcaaacccccctcccccaccctccctagggcccaaaacccccctcccacctcggtcaaagcatcctcctgctggtcaaacccgcccaccactttgctgttctcgtcttgcaggaatcatgcagtaataggacggtcatcgtgcagtaacatgacaactttctcacagtaacaacgtcaaaaaacagtcatgatggatatagttttgttaagcgtttttttatgaacgtcatggtgcaaacggattagaaaaacaagatatgatgtgagagatattgctctctaaagattgagatttatctctttttagtccttgtctcactggaacgtcgtagtaacgcaacggccaatgtgtagtaacacgactgctttctgcagtaatgacgttgaaaagtagttatgatagttctagtttcgttaagcatttttttttacgaacgccatgatgcaaataggttagaaaaataagacatgacgtatacgttactactctctaaagatttagatttaaaatattttagctttacaaactatagtatagtaccactgttactatgcatattcttcgagtaaagtataccggcggtccataaacttgcaggagtgtgtcatctaggtctttaaactctcaaaatgcatatccaagtcccaaaacatgtcatagtgtgtcatttaggtcccaattcaccataaccccttcaggatcctacttggcgttgatgtggtatgccacatggatatgacgtggtattattttgactgacaaatggaacccatttatttttttttcctttttttctctttttcctcttcattctcctttctatgtgaactgagcaaagaaaggaaaaaaaagaagaatgagaagaaaacggaaaagaaaaagaaaaataaaagaagaaaaaaagaaaaggacacgtcacgtccatgtggtatgccacatcagcgccacgcaggatcctagaggggatgtgtcgatttaggacctagatgatacactttgacaagttctgggatctggatatgtattttgagagtttagggacttatataacacaaccctacaagattaagattaaggactgccaatacactttactccatattcttctgttactacaaaattcgccatgttgttagtgccaaacaacctataaattttgcagtaacgtatcgtgttattatccttctattgtaatgttactgccaaatcatagtaaaaaggtatgattcttgcaataacataactaaataatttgttatcataaaatttggacattcatacaaagcaagcaaacaattatttttaatcacagtgtcataggaaaaattggctaggagagattgctatgaaacatgggatcatgggttcaaatcttgtttgtcattttaattattagttttctttccaaggtgcagcaaagggagagaagagaaaaaaaacaaaaaagaaaaacgaaaaaagagggatcgggagggagagaatagaaaaaaaaaagaaaaaagaaaaaagaaaagaaaaaaagaaaaaaaaagagggatcgggagaagggatcaggaggcggcggcgacgggaagaaaaatgaaaaaagagggggatcgggaggaggggaagggatcggcgacgggaagaaaaacgaaaaaaagagggatcgggaggaggcggcgatgggattgggcgcaagaaggaggagggaggcgcgtcgcgcgggatgggaaagggaggtgggttcggttgggggagggggtgtagaaggaggaggagggaggcgcgacgcgcgggatgggaaagggaggtgggttcagttgggggagagggtgtagaatagttatatggtccgctgcgtcgccgaccggttcccgggcctcaccgatgtcttcctcgaccacggcctctacatcgccgccggcgcctccgccgctgccgcggagcggagcagggtgagtccttcgctggctggagttcgtgaatcgcgctaaatttttgcatctcttgtgttcccctgttgaattgaatgaatgatccgatgttttattggttcatcgcctaaatccgtggttaaggattttgttttctggtctccctgataaattagcattttgccagagctgcatataatttataattgagatctctggaaactattttcttgatgtggtctgtctataaattttgcaagtcactaatgcattatttttgtcacaggcacaagattgggataacgaaagccccaagtcagatgagcaacatatgcagtgttccacaccaagtgaagatacgcaagaagaaaatggcagtgacggtgtcaacccaacctcatttactgatgctgggctacttcatctcattgagggatatttaagttttaatgtcttgagggttgcaaagggcttgaaaagctgactctaaactggtttttgcacatttctgaaaaggggctaggtgggaattgcaaatcattgccggaatctgcaatcgttagtgctttcggtaatttcttgttagttgtacttgttctgttttctttcgtgcattcaatattgtttcacatgtagcatgatctgctttcatttccaaggcgggaaaatctttcaaactatgaagaaattaatgcttccttatggtgaatggtgatcatagatgcctcttttattttaactattttttcgaatgaaacttgaggatcatattgtagcaatagtgagttccgttgtggtaatggtctcctttttgaggtttatcattgttcaagccagcagttcatgttgtaaactttgcattgaggtttcatttcatgctgatatttagtgttgtattcccccgagtttcattgtttattgacaacatttcttacaaggtggttatgttcaaaaccatgggttgattactctggcagagggttgcaatcttagtgaattaaagctgtgtggtgttcaagagttgacggacgaaggactggttgaatttgtaaagatacatagtaaattattggtctctcttgatatttctttctgcaatggttgcattacagacagatccctgtatgctattggaacctactgccataacttggaagtcctatccgtggagtccaagcatgttaatgaaaacaaaggaataatctctgttgcaaaggatgccaatatttggaatccttaaagatggtatggcttggtgtcggcgacgaagctttagaagctattggttcatcttgctctgcattagaaaatctgtcacttgacaaccttaataagtgctcagacaggtaataggtccaattattaaatctactgttgcatttttacagggatggaagtatcggtgtctcatttctcttagaaatttgatatagcttatactgatactgcattgtgatgcttatagacttgaagagtagaaatgctgaaccatttgttaacaattgttttatattttttttatattgatttgaacacatgctcttttcttaatttcagtagtgagccacctgagtataagttctaaataatatggttctggtaattgacatcgatggtgtatcttaaatattctgccaccgatagtgacaagttattgaattttagcaacatttctcatatcttcagtaatcaacagtacttcctccatttttttatgtggagttggttagtttaaaattgaactggtagaaaaaaaatctaatgcagtaagcacaatgattgatggaataaatgaacagatgtgccaattgcggtctctgaatgaatggtaatttacctctgaatgaatatttcatgtgttgtttctgctattaggttgaacaacggtttcttttttatgagtattatttttcaacgtaatctggttattgatctaccaatggttcacatgtatggtgttggcttgggggtccagtctcctgcctgtgatgtgtgccaagatagactactgcagaatacagcttataaatactggactgccgacataattggacaatccgttgcttcccttaatgtaacttctggaagaagctggacctataacttatggatggcaagaagtggcagtgctcggaggaggctgccctggactcccaagtactgtgagcactacatgcccgttagatctggggtgattgttcatttctttttttttttctcaaatgccatatttcagtaacctgctatatactctttgattatttgaaaaagtgcaattgtctaactgattggtgtcatatgtatgcagtaatgcctttttacatttttgtgattggttaattattgtgttccatttgtttgcatcagtggcaatcaaaccagcactccatgttgtgtactcctacattggtttgattctgcaaaaatttgatttctaaatcatctatgtgatcctaatccatgtgaggattagaacaaaataattgattgctcctgaactgatcttcggaaatactgtaatattaggtgttatgtttgaaatgaccaaattcgtacatgttttttttttttttaagattttgtgggagtaagggtattacactatcagtagaattttccaaatttgctatggggctttcaatgaaagtagcgaaccactcccgtctgatatgagacttcctgattagggctaaatttatttattatcatgcacggaataataaatcttcctgattaggtttaaacttttgtacaaaatctataagtaacagaattgttctgattccaaacagtcctctggtttagagcatgatcagtgagttacaaaaacattatagaatacgtgagtactgacattgttttaagctcaagcacactccagatatggttgaaaactctgatcagtcatgtttgaattatatctcctctttatgcagataatttcaattgttatggtcctgttggtgtacaggttcagagtttttgttcctgagaatcatcttccattgtatgagcagcctattccaggcagctcgataaattaaattgtgtacttcatgaacaattaaaataactttattattattatttttaacaattcatatcatccatatataataataaatttgacaatatttgttactataaattctatctcattatatgcttggcaaaacatatcttattttggttatttgatttgtattactaaatatttccgtagcgttagcacgggtagattactagttatagtagtttaacttatataaattacgctacaaatttacatatctaaatttaagatcttaccaattagttgatcgcaaatgtctagatgtgcatgacaagtgaatcggaaacacatgcgatcatgtcttcgtcagtttgtccaactatcataacaactgaattaacctagcataggaccatacatcaatacacgacaaaaactaacacatcagatatattacaaattaacagataaattcacaatgttacaaaatttgtgctcatttggtgatggcgaattagcaatgatgtgccatgtattggtgttgcactcaacagaatacctgatcagacagacatcagtattcagtgaccgcgcgtcctcctcatccagtactcgagggcagctggcgcggccagcaagaagcagcggaaaccagccgcggaggcgcgcagcgcagaattgcgtcggcggctcggcgccggcgcgacacgcgccgatgcgggctgccatggattcacgcgatttcgccgtgagaagaagaggacgtgggcggcaggcggcggcaatctcgcgtttgttctgttcgcctttcacgcatcggccgatcggcgtatgtgttctgctcaccttccgtgcatgcgttctgtgacgactattgctacttcctccgtttcacaatgtaagtcattctaacatttcccacattcatattgatgttaatgaatctagacatatatatttatctagattcattaatatcaatataaatgtgagaaatgctagaatgacttacattatgaaacgaaggaagtattatttttcattgcccgctcggcgtatcaaccatttcaccatcaagatattttgaaagtgaatatagaatatgattcctatgaattatatttcaagaacatagcctacggatgtgtcatgtgtcgcaaccgtaagctatctttctaatctgctaaacggtttgtgtatttttttattaaaaaactgtggagtattaaagtttcttagaagaatcaaataaattcaatttttaagtgtgtcaaagctcatacttaattaatcacaccttacccactcgtctcgttttatgtgtaggtcgctttattccgtgtacaggtgttacacttgcacaagacgaaaatttagcagaggctgcaaaaagtttttttagataaaagtcacgagagcagatacaatagtaggctataagacagctataaatatattttaaagagataaaagaagagagagaaaagcagcgggctacagaactgtagccagctgtagcacggactccaaaatgtaatgtgtatgataggtgggaccagatattaatagtatagtaagtaactattgtataaattggctattacattggttatagatgattagaaactagtagtgggttgtattattaaacttgcactgtgtttacacccaaatttggcacctaggattaaaataggaaagattgccaaaatttgaaagtctaccggtttcctccaagtgggccggtctgaccgccgtgtgttggcggtcagaccgtcggttgagggccggtcagaccggcggtgtgtggccggtctaaccggcaggtccgagtccgactgcgtttcgtcgggtttcgaggtttctttgctcgggaaggcatgtttcgggtttcctttagtttctaccccgagttggacatggaggagggcctgtagaaggcaagaccaacccctatataagggacatggccgattcattgtaaaaaaaccaatctacaatcaatcaatcgaatcttttttcatattgcttttagttttctcttagtttgtccatctttgtcggtttgcgccgtaaaccgtccaccgctgctgcgagagtgcgacatttctttgtaggtttgtcctgaaaaccttccgttttgcccacgagacgggtagttatcttaaatcggctccgctagccggtttatttgtcaaaacccatctaggtttagctctttgctagatcgaggtggttggcaactctaggatcaccgcaaggcataaggtgctgcaatcgttgttgtcaacttgtcacaaaaagttgccaacacgattttggcgactccgctggggaggtccgttcagcgtcaactcaacttcgacttcgccatgacgaagccgccatccaagacggaggtggagccatctaatgtgatacctatcacattggatgatttcgaaggggaagaccgcaagtccatggaggagtacatcaaggagatcacacaggaggcgctgatgagagcatgcactaggactcgtcaaggcgtgatcatcaagcccaggccacgtcctaagctcgcttctgatttggtaagcaatgaagaggtaacacaatctatccaacagcaagtagcatctacaatagattcatctatgactgtttttaaagataagttggatgcaacttttgagggtaaatttgatgagtttttaagatttaaattcggccctcttatggccgattacatgtcaaaagataaagcctctaccactgctaaccaagctcctatagatcaagggtttgttggaaccatgccaccctaattttgcaaaatttaagatatgccacccgtatctcaatgacatgtacgacccacatgagtcaatgacatgtgggtcagggtggcatatcacaaattttgcaaaatttgtgtggcatggttcaaattttcccatagattagatgggttcgagtagcgggaccaatggagcggcgcatgcggccggtccgaccgggcctgatggctggtcagaccgcgacttcgccttcggtccaaccggccaagcggccggtccgaccgggtattatcccggcggtcagaccgggactcaggccggtctgaccgcgcctctggatgtcggtcagaccgggccctggaccggtcagaccggcgcaattataccgatacaggggatagatccaatgactaatgctagttatttgtatcatcttagaacatttgatgctcctgtatctactgctgcaaatagtccccaagttcccccacatgttcctaatgcttataatgatgttgctagggggtatcctcccgatactaggcagggccaatataatcatattgcgccacaaacacaacctattaggccaccaaatccactgccaaatcaacataggcctgataatatgaaggaaataattagtgagattattagggataaattcgggattgaaactaggaatcgtgccagggtttacaaaaagctgtatcctgactattatgataatgtgccgtttccccgtaattatagagttcccgaatttaccaagtttagtggtgaagatggtagtaccacatgggagcatgtaggtcaatttttagcgcaatgtggtgaggctaatagtgatacttttaaattacgcttgttttctttatctttatccggtaccgcttttacatggtttacttttttaccggcaaattctattcatacttgggctcaattagaggtgagatttcatgattatttttatactggagaaactaagcttaggttatgtgatttaacatcggttaagcaaaaatataatgagcctgtcattgattatattaagagatttagggatgttagaaaccgatgttatagcttgaatataactgatagagatttggctggtcttgcttttaatgatttaattgctccacttagagaaagactagatggccagcaatttcttgatgttagtcaacttatgcaaagggctctggctaaagaaagccgggttaaggataataaaaaaattgttagaccatatgagaaaaagcctaatgttaatgtggttaattaccctgaggctagtgatagtgaagatgagggtgatcatgatatgtatgttgctgaatggtcatggactaacaaaaacaagccttttgtttgttctaatctaatgccgtctcctcataaagatcggcaaagtgaggttaaatatagttttgatgtggccaagtgtgataaaatctttgattatcttttacaagaaaaacaaattagattacctaaaggccatgtcataccatctcaagaagaattgaaacgtcgagcttattgtaaatggcatgattctcattctcattctactaatgattgcaatgtgtttcgacgacaggttcaatcggccatagatgaaggacgattgaagttcactgatggctccaagatgaagcttgatcatgatccttttccggtgaatacaattaatttcaatgataagaaggtgttgattcggccggagcaagccaaatctactaagagaaaaggagtggtcattggcgaaccaagacctaagatgatagtgccaaagaagccggaggttggcgtttggaaggagaataagagtgaagtttcaacttctaaagcccctaggaagaccaaagtgacttttgatatgcttttagagaagtatgagcagcaaggtggtgagagggctcccaacaaaggaaaaagaccaagatcacctcctagggagcgatttggtcattcaccgagacggtcgcattcacctccatatcatcatccacaagacatgtcatggggttcttattcaatgccgccgtcgggttatccttatc

SEQ ID NO: 63881 - DNA, 12256 bp, Oryza sativa
tgtgtgtttgtgtgcgcgctttcaagcttctcctcgtgcttcacatcgtcaagcggtcaaacgaataatgaggtatttgaatcatacacttgagtttggaatttggtcttctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctctggcttttatctactttgaaagattatgatcttacttttgagaaagtacatctcttttgtgataatactagtgctatcaatattgctaagaatcctgttcaacactcacgcacaaagcacattgatattcgttttcactttttgagggatcatgttgagaaaggagatgttgaattgcagtttttggacacaaagttgcaaattgctgatattttcactaaacctttggattctaatcgctttgcttttcttcgtggtgaattgggtataattcatccttttggcatggtttgagtgggagtttgtatctcatggttttatcaagcaataatatgacaatgaaaaacttgagaaaagagagctttgtttatgcatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagcaaatatgcaatgttgatgctaccatatggtttgatctataaatgctttatatatatgctttattgacttgttattcctcaaatagctttaattgctcattgtgcaaaagagaataaaactatgaaaaaaatgaataccgaatccttggaaacagtcttgacgacaaggacgtattcgatgtgagcaaaataatgggtgccgaatccctggaaacagtcttgacgacagggacgtaccctgaataaaaagagaaaaatatgagcaaaaaggctcaagaaaagaaaaagttaaaaaaaattctcttggttattttgtgctaaaaggttatttgagaaagagtgatcaatgcaataggtatatgtgtttagtgtttgttcttcaacctatgtgcttgttaaaatgttgtattataaatcgtatgaaatcatgaattttgattgttgattcaagcttaattgtaaaatctttggttcatggttttactttaatgcatgcttgttttgttatagatgggtttatcttctttttattgcaacacatgacttgatatgctatatgtatgctaagctcttgaacattaatgaacataattcctatgcttgatgaaatcattgtcaaagggggagaagtaatgtaagtaatgtgaaaatttttggatttttggaaaattcactttcttttcaaaattcactttgaagtaatgagaagagcatgttgttggttcaattgggaatttctttcttttaaaaagggggagaagttttcttttggatttttgagcacgatgtgtacatttgtacgaagtgtgctttttaccaccaaatatcaaaacatttttataggtttgccaatgtgttcatcaagggggagattgtaaaatcaaagatgtttttgattattattctgtgatgaacaattgggcattggagattattggttttgttatttggaatttattcacgaagtggttttggagatgattggattcacaggtgaatatacaggtactgctgtggttttatgtggaccggtcagactgggctctggtagccggtcagaccggcgtgtaatgcgcagtcagaccggcgcagcccgcggtctgaccggccgacactgtgtcggtttcggtttcgggttgtttatttggatatccgagtttattccatgattatgacttctagatggatactacacgtatgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggattagacgacgtccgtggtggtcagagatcatgtgggatacttaggctagagttgatgcacgtggttgatggagattccatatggcatacgatggagttattgtgtgcgtatgggatgcggagtcgaatttggaaggagtccaaatttggtacgtttggttatgtaaagtttctttcttgtactagtgggtttcctaaggtgtttagaactcctagtatgagtttggttcgtggctttaggctgcctacttcatgtataaatagagggggagcgtgaggcttccctgtatcgcttttgagagcaattgagttgagttttgagttagggttttgagtttagtcgaaatttttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggtggcatcgcggcagtccgaccggcgaacacacggcggtcagaccggcggcgacaggagtcgtcggcaggctttctcggcggttcgaccgatcaatctacatcggtcagaccgacgttcatcaggcggtcagaccggcgcaactacttcggttagaccgcgatccatcgatttcgagggtaacttttatttccgctaaaagtttttcggtttttgggtataccaaccattcaccccccctctggttggcttagttcttgtgattcgatcctacaccattatcagcttagcaactgcaatctcatcgatgatgtcttcactgtcaagaaacttccttttcagctcaggaaatgctttgtaatttgagtctcttggctatgatacaccaaacaaggaagcagtgcaaaactcttgtttacttctgtaatcctagttcatttctgttaatgtaaatggagggcccaggccctttagtcaaaaaaagaaaaaacaaggaagcagtgggcgacctcatttattatttttactgtctcataagaaaaatttccaagtcaatgtacgttagaaattgacgtacttttgttattttgataacactgaggcgctggttggtatgttgttgaaacttaaagtgtagtccgcgtaaagtgtatcatgttacgttgttgtgatattgtttgcttctaaggctaatcattcgacacgattactgttgctgatcattagatattgagttaaaagcataacctaatcatattgctattactccattagaataaggagagaactatataaaggagctcatgtaccatattacgtaccagctatatctttgttcttgtcgacagcaaagctctccatggacgctgtaaaaagattatggaattgctaaacataagctgagtaaatttttttgttttcaatcgaatcccttcctgtttgatctgcgttttgataatgctttgaatttttataatcatttccattccgaacgcgcgttgcatcacgcatggcgagatgcattgccgtgcgcaaccacgaggggattagcctcttagttttctaccgatctttccgtcaacgcctcgcgttgacacgtacgccggtacgctcgcagccgggggttggaccctgggtgcctagccagacgcccacgcactaggtgggccatgtttacgaggcttctctgctcacaactagtaggaacaaaaagaataaagtccactaatatcccttaagtataagtcgaattcaatttgcgcctctcaactgcggtgcaattcaactcacaaaaccaatgcaaatatagtactttggcagtccgggatagcggtttggcacgttaatttggtccactcatgctaacgtgttgcttgcgtggcaattttatcataaaaaagaattcgtgggccaaatgtcgaggagggtaatttcttggaacaagttcacttgttgtccctcaactttacgccgagtctgtataacatccctaattgccaacagaaatatctacccctcaaataatcaaaaccgtgtaaaatagatcccatggcagtatatatgggtgttttgttgacgtagcatcctacttggcattctagggcccacatgtaagtgggaagaagaaaaatgtggggtctgcatccattctttcctctcttctcttttctcttttctcttttctttcttttcttcttcggcgagcctgggaagtcatcgtcgccgggcggaattcgctcgccgctgctcctcctacggccacctccatcgttgttgccccctccttcgcccgttgtctgctctgcctcgcctacctgctttacccgccgctaccccaccaagcgtctaccccctctgccgcccgctcgctcgtgtcgtccctcctgccgccagttgaagagaagaaagaaaagagaaaaggagaagaaagaagagatgggaacccacatttttttctcacttacatgtggatcccataattttttgtattattattttgatgactaggatgccacatcagcgaaattagagatcctatattgctataggacccaaattacacggttttgtaaaatttagggggtgaagatttctggtattagctgatgagcttattcttaaattctttcaccccatgggcccttttcctcttttgatctcctcctcgctgcactattgtaacattctgaaaatgtgtcattttctaatcttgcatcatgctgattcttatgttcttaataaccttctaaacctaggaaaatataattagagggacctcctaaaactaactcgcataaaacctctctggtatttaatcccttttgtgtttttcatttaaaaacatatttggtatttcttgttgaaattctattttcaaatattaaaccttctttcgactaaaactcttttattcaaatttagtttaaaaaccatttttattattatgaattatggtccaagaaatcctccaatttttgtccttgaacctagaccaaagtaattccaatctcattggaattaattgttagcccatcctttgatcttaaacccatcctttgattcttgatccaaatatccaaattcctccttttgatctagccaccaatttaatttctgtagcttgatttcctctttggcacaagaattgtattattgcaaatattgtgaataattgctcttgtgctaagaaaattccaatttatattcttcactcaacttccccttttagccacaaatatacataacaccaattttagagttcaaatcctatttattgccttcaactaattcccttctatattcccaaaaatattttgaggaatattattaatttccattcctatttgagtgcttccaaataaattccctcaaactccacctctaaatattgcactcaaataaattaggaaatatcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgggctgccggcccagctaagccgagccggcccaaatcggcccacaccccagccgagccgccgccgcctcctggtgcgcgtgccgtgcacggcgcacgccgccgcaaacgtcgccgctaagaaacataaatcggcgccgacatcctcctcctcacgccactgtcgtcgtcgtgttcctctttccctcctcctccagaaccgcctctccccaccgccttctctccctataaatagccggccatccctccccttctctacatacaatcagagctccatctctctttctctcccatgtccggccatggccgccaccacccgatctccctcaccggagcttcgcaagccaaaccatcgcgccatcgagttcgcctcgacgaggtgattccatttttcctgtttcccccttctcccccaccccatagcaaccaccaccgccacctctctttgccgccgaagataagctcttctactcgccgttccggccatctccctcactctctccgccagccaccgccctccccgggtgcgtcgtgctcgggaacatgtgtggccgccgacgtcgccgcctttcgtccaccggagagccggcgcccactctctccctctcctctgtagccggcaagaaaaagaagaagagaggaagaagatgacgggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcattttgatatcaaatttgctattttaagattttatttgaatttccttaatttattcaaatgccatttgaataaatatttgatttaatcttataattgaatttacaatttaaacttatatttgcttttcaaatattttcttttatttccaaaatgcccgttagccactaaaaagccgccggttggaactttacgccttccatggggacgtttgcgcggtctacggacctcaacgtcggaccgttggttgtaaagcccggcaaaaaccaaacctaaggtcgaagtgctgctcctggcaccccacgccttgatgcgtacagcggtcggagcttcactatcccctcgacctccattgcacgccgcacagttagctcttgagctctgtgtgatcctagccgctctgccgccactcacggttgtcggagtaacacttccgccccactaaacctgcacccacctcctattcttctagccgatatgttgtctatcgacacggctagaaataataccaaacctagtcgtcatgttgtccaactctagcgacgactagcaaacacccaaaaccctagccgatatttatcctacctcgatatcggcctaaacaactaaaccttagccactattctatcaaagccaaccttaacccatattagccacatgcctatttaaccatatcaactattcagtatatttcctatcgtccaaaccacgagagcctccacataaaatatagagcctagccgagatactgtcctactccacagtcgactcccatataactaaaccctagctattatactaccaaaacctaccactagcaaatactagccccataatccctataccctataaaagagataggttataccttaaaccctagccctcttagtcgtttatcgttttcttattattttatggcttttattgaatttggttcttcctctttctcagtaaagactattgtcttttggatggcaacctatggtatttcgagaatcgtataatcaggttgcctatcttggattcatttgcgttggagcaaggcaagttattattcctccccttgagcataattatcctatattctatatctctattctatgcattagccattcatgattttgaatgcataacttgaacatatagcaaaccagttatatgctagcttttgcttagccctgcctagttagattgcataaaacataatgaacttagattgggacagtacgcaagatttggttgatttccgggtggctagtactgtctcggtcgatataagtttaccaagtacttatgtcaaacgaacgagtacgaccgcagcttctagaatggggacagacctagatattatgttaattaacagtgtggtacctctgtacagtggttcttatgtaagtcctcgcgaaggaggcaaatatatgccgcgaagggcaaatgtgatatttaccgaggcgcaggtaaatatcttgattatcgcgcgatgtgtgtgtgaatttatgaaaacctggttgagatgacatggggtctctcatccagttctctctaaaaaccccgggaacgccagaactcctctcgctgctgataacgttacattcagagcgcatggggattagagttcatggaacaagtgccacaattgttaataacctaatactgggccatgactaagctaatgattattggcaagtcgtggactgcgggtaaagcgtacatctactgcagtatgaatatccttgaatctattcgaatagccgtgctcacggattgagcatcgggactcatatggtactttggttagaaatataattcaagattttcttaaatactgttgcatatcaagcatttcaggatttctacctctttattctcagctttctgcaagtaaacctagctctacacagatattaccatttcatatattcattattggttaatataatagcttgctgagtacgttgtactcacccttgcttcaacccctctttttcagagtttaattggagtttttgccgaagctgggagttcaatcacataagttagttccctttaaacctaatcttcaagtctagtgtagttagatggtttaattctatagtaaaacggcagagttgagtcatcgtatagcctctgctgtaatagttagccacaaacttgtgaatgtcctattattttatataaagatatctcctttgaagtctttaccaaatgtatgcgatgaagatccagattgttgaacctgtatcaatctactgatccagagcttgatacagttaaacatgtcggtttctgaatcgttagttttgggatccgacaactatgcattagacgaacgatggcggcggcctaagtttgttcaaatttatagtactataaaatgttatatctaattctaagtttttatattttgagatggagggaataccagtatttggggggaaaaaattctaaagtgaagtaaaggtaagaaaaaacgtgaaaatattagttaaaggggtctaaaataaatatttggtaactagagggactaaatcgaaattcactcgaaaaataaacccctccctctcccccatcgtacgcaacgaagccgattgcctagaggcggtctcgccgcgccgcttcccgtggagcccaagtggtggcgagggtttccgccgcctctcgtccgcctcgccgacctcggaccccggcctccatcctcctcgccgacgacagccaacgtgtgccgctccccttggagcccaagtggcggcgagggtttccgccgcctctgctccgctcgccggcgacagccccatgttctcgatcgccgtccccaggtccgcttccggaatctcatcctttgcgggctgctactgcttcgcgcgtcaagccatcaccagctgctccctccgtctccggaacaacaatattctctccgactgctcacgacgggagagcggcgcttcggcgacggcgatcccggtacgcacacgcttgagaggctcccactttcttcattctgctactgtacggttggattcgtgcataacaatcactcatatctctatgtctagcctgcccatgattatttattaagttcgagttggttgaagaatccactttgttttgtggggaacttttacatgatagagaaatgaatggtcttctattgtgaaacaccacgcttgattttacaggatggtgttgtgtcgtctcgtttctaggtttatagacggaaggacctgctttttatgtgacctgtcgtttgctatagaacctcatggtttatagttaaactgcacattagatctgtcaggagcagttgacagcagtactgaacgtttctcgagaatgttgaaatgttggtctcatcagtattgcacatttgttgacaatccataactattagtggccaatgtgaacatttcttgtaaaatgtcaatcgcagtagcaggctagcagcagtaatgtacatttcttcaaaatgtaattccaaggtttgtgcactatttacttcaatataaggacgcatagcatgcattcactgttgcacctcaattatctatgcgactattctagttttattttatttttagatggaggagcagcaacaggaggagaacagcccagtgcttttccgccaaaatgcaaattcttctcttggcttgctacccagaataggctatggacggctgacagattggggaaacaaggctggcgaaatcaaaaggtttgccccctctgccgcacaatcgacgaatcagtgcttcaccttctggccaaatgtagagtcactaagaggatttggacagaaatccagagatgggcgcatactgaccttcaaatggacaaatgaaatgactgcccctcgatcgaacactggtggaacctcgtcgttgaatcccccaacaccccaagagcccctctgcgaactctactgatgctagtcacctgggagatctggggggagcgtaatgcaaggatctttcgaagcacagcctcaacaccagcctcaattcttgcaaagatcaaagaggaaagcagagcttgggtcaaagccggagcggctaggctgcaggagttcggatttttgggagatatcacctaaagaacttctctcctgcgggccggtcttctgactggccctgtacatactttgtataattttttccctctctattaatatatgaggcaaagcttttgtcctcctttcaaaataaaaaacagcccagtgcttttcaagcaagcaccgatggcaagctgctatccaatgtgctcaagtacatgtagatcatcacctcctctactccccaagcatccgagggtaatggcactaatcatatgtatcttaggggcagatccaggaaagaaaaatgggggggggggggggggcgctgaactgagcaccaacataaactcattatctcacatacaagtcaaacatggctgtaataatttacagtggtttcatatgaaaacattgagaaagaaaaggcaaaatacatcacacgacagtccaatattcacttggctctaatctcaaacagatactcacaattagtttagcactcctagatcactaacaatatctgagcaacaaaactgcactcgccattttaggttgccttgtattctcattgttctctatagtaggagtactactgctgcaactttaataacattcaacaatgttctttttgacatgttgcaaacttgcaattctaggagcagccgagtagagatgatagattactagctgacacacaaaattttaactacgctaaatttccaatgggttgaatcattccagattttgaaaatttaaagcaaaattaagcatactttcttgcctttcttcaccggctgggttgtcgttgcagctcgccggcacaccgcacgccctcagcaagttaggcaagtcgcaggcagtagcttgccgagttgtcggctagccggaatgccggttattgcgctgccagtaccgctgcgtggcctgccctgccttgcacaacagccctcaccacaggcccatggcacaccggtgccttgcatgccgcgtgccgctgtgccgtcagctcgcattgtctgtgctcgctagggttggggatgccgccatgccggatgccatgtacgggattggggatgacctgactggatgggagattttggatttatgttagttcggctgatggctaaggctgtgttcggcaccccttgttcccaactcctctctctcgttttccgcgtgcacgcttttcaaactgctaaacggtgtgctttttacaaaaagtttctatacgaaagttgctttaaaaaatcaaattactccatttttggaaaaaaaaaagctaatacttaattaatcactaatggaccggagggaatgagttcccatcgaggacatgtgaacgtagcctaagttgaaagcccaattagtgaacaactggacgtgtgcacctagccacttggcacaattgacattgcattactacattcactgggtagtctggcccaatcgcgtgtcttcttcaaccttcagccatcaggcagcttcagcagcccctacttctcagtgttttttttttctggggtaggggggggagggggagggggctccatgggtccagcgggtgtaggggggacttgagcccctctgcacccacgttgatatgcccttggtatctcttgctctcaaatgatatagtatgctattg

SEQ ID NO: 63882 - DNA, 745 bp, Oryza sativa
tatgggtatatatattgggagaggtcttgagaggttggttgatgtatccgcatatagttaatacaataaagctgtgatgcccctccctatccgtgttcatctactatatgattgtgtgcatgagattgtcgtcttctactccggatcaacgaatagaccactagttatttaacaattatgtcatcttcgcaaacttttggagaagataatttgttttgaaacgagaactacgacgagccgaacatcatcctctgcctccatcaaaccctgcctcacatgagcacccaccagtgcctatagcaggttggcacgaggagctgatctgagctcccatctgaacctgacagcgagacgggcatcgaagctgttgcagaattctgaaggatcaacaacaagcaagcgcatgctgcacgcatgcatgtttcttctcgatgtaaggccgcgccgcctcccttgtccctggcgatggcgattccggcttttctcctgttcaccgctgttggggcgcctgcgctgacggcgaccgcctagcgcgcgcgcagccgcagcctcgatcttcttgtggtctttgatgcagcaacaagaagctacggcactctcctctgcgtgacgccacagtacgtttcgttggaaacgatcggaacggaacggtgccgtgtgcgggagaaacggttaggatgacagcagcaacagccaggcgccagcgagcgagcgagcgagcctactgatgtggacgataaacacc

SEQ ID NO: 63883 - DNA, 4955 bp, Oryza sativa
tgttcgtattaaaaaacctagaaaaaacataacatataaaatttttatatccgcacgtatacaaactttgcatcccatacatataaaaaatgaaaaccaaaaacccgtaagagaaaaaaaaaaggaaaaaaaaaaggaaaaaaacccacgcatgcgcggcgtgcgccgccctcctctccccgcgcaccacctgtccatctgcgtggagggagcgacgcgcggacgtccgccaattagcaaatcttttcccctttggccttcgagctttccccaatccccattagtcctgcatgattgcacccatgatgcttatacttgcccgtgcacgagggccatgttgagtagtgcccgcgctgggtggtttcacggaggcaattgtgtgtcttgcgcttccgtaattttacatatatccctatcgcaccatctccattaattcttccgtgttttgaagagtttaccatatcaatcttacttatggctccttgtcggtgataactgataaatctataaagaaataatagaaggttaaacaaactagaacaaagttacagatctccttctcatttacatatggcaaaaataatttataagggttttgtgggggctcacatgatccttacgctagtagtggattatcgagcccctgttgtcccatgaggatccgccatgctcctcgtcgttgctggtggcaatttgaggggaaaaaattggatgtgcctacttcacgctttaaatttcaataatgctatataaaatcaatatgcataagtaaataaattaaaatcaccagctaaatttgaaaaattaaatattaatagctcatttttttaataaatgatttatataaaccccgcttctacatcccaaaaatgtatatagccaaccaactccacacaggagcactaaggctcctcccgttacatgggtcacaaaacaaactaatagctcatatatggaagatcctatattaaggctacaaaactactactcgcccggcctatacgctgcaggttctcacatccataaaaatgaaagccactattattgttatgaaactattatctcctgctagagataaatataggctcataccaaatatatgaaaacgtatcataatagaactctttctattatgggtatatatattgagagatggtttgagaggttggttgatgtatccgcatatagttaatgcaataaagctgtgatgcccctccctatccgtgttcatctactatataattgtgtgcatgagatcgtcgtcttctactccggatcagcaaataggccactaattatttaacacgtatcagcacgagattgctcgtacgttaatccgggtaagtgttctaatagatcaattgatttcggtactaatcagattgatctacgtcgccggccaacacgaccgtctgtcggtttgtcgttccaatccgtttttggtattagattgatttctaatttacagattaatgcgctagtattttctgtttaatgtccggatgatggcgagcctcgtgatgcaaatcgccgggatggtacggtgtggttgctcaccatccgtgcaagccaccttgacaactggacgtcaggaacgacgccacttgaaccatctgcttcgtctggctggatggattacaggcacatgaaggcacccggcacaccggtgcgctgtcgccgtgcgggtcagtcggctgcggtagtacggcaccgcaaggctcagcatgcaggagaaagtaccgatgtggtgcactgtgcaaattggttttcgataccaatctgatgcatgcaaggaggattagattaacatgcatctacacgcatgcatgttgcatgcatacaactgatatatgcatatatccttatagtactgctactagcctgacactaaccagatttattttcgtgattaattgtcttgcatgtacggccggagctgcatgccgttggctgttgaagattgtttctggactctagccacacgcattgcaccggagccgagcgcctcggctatggtccacatcgactcccccgggagttcccttgtgtaaagcggagcggcagctgcatatccggaccggctatctttacatcagataaacgagatgagtatcggttttatctattctaatactttgcagtagcgagagtaacatgctagatcatgcctctagtcgttttattttctcgcatgaatagatgtatttgtccggcatttgcgccgactcttctcttgttatatcgccgaccacgaagtttggcaccacgcacccgaatgtgcttaccatgcacacaagaaggtgcacatacataatccattgaattgaacgacagagtgttgtcccgaatgacgacacctaacactcggtaacacacgacaccacctagaagttgtcgtctttctagctaacatagtcgttaatctatgaatatattaacacactcgtcatcgctgatcttatggatcggcgcgcttgggacactctgtcggttgtgacttgtatgttaataatccgtcatattgctatctgtatgaagtagatggtaacaaatccgagtcatcggcacctgcatgcgccaccgccgccgcctgcacgtagcgacacccggacgcaccgcatgacgtcttcccctttgtcaatggttgccgaatcaatccaaaacctttccctcgtcaatctgccatctgaaacgccgactcgacggcctttcgaggccatccgcaacgcaattgacgatcaccgcccgtagcgacgccaaggagcttacgcccgcctcccctcgctgccggtacgcaccgcatgcctcccgcattacttcacgcggccgggacgagggtcgaagccgcggtgagcacccgccgtcgatagctgtccgccatgccggcctgtatgccgagccgagtttcatcgacacgtaacatgaagctatgattgtcggacgccggtcacggcttgatgccaacgaatgccggtgtcggtgctactagatgttgcaccgccgctccgcctctgaccatggcaacttgccatagttgtccatctctaccgagggctcactagcacatttgccattggttccatccgttgtctccattgaagaatggcaattggatcatacctcacccacttcttgtgggagaaggtcgtaatagcccattaggcgacatatgagatgggctggccaggttttaaagctagctagtataaggaggtgggccaagtagaaattggcctattaaaaggagtcgggcacgaaccgtgattttggtccgaaaatggcattttatttcaaaagtccttggtttccaaggtattatgcggaattcggaaattatgcggaaaagtcctatgggacattagaaactacggggaatatacattcgccatttatactttgaaccttcatgaattgggtttacgccaaatagagaagaattaaggatttattccttagtcccgtatttctaaatatttgctttaactatttagttagtttcttgaataatcataatcaatcctaaaaacattgtttttaggcaaaagagcttccatgaacttgtgaaacctttgttttagcaccccttttgaaagcataatattttatggtttatttcctggcaattgtttgtttagggtaattgattgttctgtgggttagtagttctgtaaattacacatacctttgaatagcagaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtctaattgtcgcaacatttgtagaaggcacaattatatattctccgtatagaataaatgtatacactcatcatgaagagagtatattattgacttagagatatttattagtgcatgactatcatagaagataagctacagctaaatttatattaattgtgtccaagtagatacaatgtcatcgaatttgtgaatatctagacgaggagtctatatgccaatatgccctacaccaaaattatctatcaaaagactatgtacctatgcagtgtctatagttaatttgattgataatgttttgtccatcttccacgtataaatgactttaaaaatgaagtattgtttttatggatgtatgtacattattttgagtaaattggtcatttgcatttgaagcaattttggcctagatgcaacatgtttagttgttagaattgatacacaagaagttgtattactgtcaatatgtgcatttgcacgcacatatatgacttatactattaatatgttcatgaagaacatgcatactcaaaatttgtgaaaggaaaggaatttggtgtatttgaatttgatgttcaactcaaggggagacaaatagtaatgacagcaatcttgcattcgttcttttgagatagtagtttacaatacacgagttagattatagtttagattaagttcaatatgaagaacatggttaagctcatgtagagcatctttatcttttgctttaggcatagaagcttctgcagtagattactgaatattttttttatataggtcatctcaccttacctatattgcctttttttacctgtagtaattctttaaccttttgtggaataaaattgtgaattgtatgtctaacattgaatgtaaatatttgtcttgcctgttatttgaagtatttttggtgaatgtattcttattatccactaagcctcaatcaaccatgtaggttgatagttctaagtgcattgacgccacattggcatacatgtaaagttgtttacttatgcacatggacaattagaatatttatgtttaagcattgaagctt

SEQ ID NO: 63884 - DNA, 1302 bp, Oryza sativa
aattcctgcagcccgcaaattatggctgtgttatatttactatggtacctcacagtaccacctagataccatgaggtactaaattttatactaaaattttagtatctcatggtacctcctaaaagactgtaaaattactctatttactaacatgagtcaagcaaagttgaccatgttgcctttatggccatctcaatgccatccaagttgtcggccatttgtgtactcgtcccatccttctgcggtgtaagactcctgctctcacacaaaaattcttcaagatcaaaacgtacacagcccggaaaataatcactaataacaccatcaggagtgtgacgggcatcatctagttggtcttggtacgcgtaaacgtaaatgtgcatgtacccatcatggttcacagggagtgtgaacggtggtagcttgccaacactcaacttgccattgaaggttatgaaggaaccctgaaacatattgtaggtggcagctattgtaagcgaattatattggtggttctcttcaatatggtacacctcaaactccaaacgaaccaataccgctctggggatagcaaccattcttagatcaagagtgctgaagtgaccagtgtcgatgtgccaatggagcctttcaagttctccatagaaagatggagcgtagatagagtagccatcgattaatacttcatcttctccctctatttggcccttaataattaaggaatactcaataagtacaagtccaactgcataaatgcctcgtgaaggggttatgagaggttgcagcttatgagcaccctgcatataatatatttttggatagaaaaaaaagatcaattagaatgttcttcagaaaaaataagttatatgcaacagtacgtatattcttagatggaagcaagggaaaaaaatgtagaacatcaattactcacagggttaagtttgcatgggttttctcttgagtattcaaagatacagttgcgtagctggctgttgcgtacatctctaaatgcgaacgtaccatagatctccattgaatcattagaaggagaagataaatctaaactgaacacttggatagcccgacagcatggttccttcccatccccattcacccagcggctttcccacttcggcagttgaggaactgcaagaaaagagaaaaatatcaccatgtatcagtacgtacatattcacaatccgtaaaatgccaatgtgactaagaaaatatatatagttggtgtcagctggattaatttgtagcatgcagacgcacagagatgctccacagatactcgatttg

SEQ ID NO: 63885 - DNA, 22679 bp, Oryza sativa
aaaaagatacaaccaattattatagaggttgtatgatgaacgactgtaaattttacaatcacaatttattagaaaacaagaaatttactaagaataccacctttaaagtatagactatttttatctatggttggcgagaatatgcataaccattttttttctctaacggcttacaagttctatatagttcttgtcttaaaccgaaaacagaatctccaaaatcaacaattaattatagtttcgattgaatttcacacacatcactataggcgggtaacgtcaaaccgaaaagaataacaccatagagcaacagagctgtaaatcaatgattcgctcaaatcttgctaacgttgtagccatcaaaacgacgctaaggacgcccctgaactctggaatctgaactcgagcggttttctcatggctctcagtgccggtgtgggatcgtggttgtgtgtgtgattgcagaaaaaaaaaatcctatccattatccatacgtttttctccacatcactcgccggccggtcagtgttcgcagtttgctttgctcagaactaatcggaggagaataaacatgtacgcaaccgatgcgagcttatgtgcaaccagagctaaccacagctaccttccaaaacgcgcccgatccaactcttgtcctcgcgcgaaaccgatcaaaatcccggacgccaccgccggctctcgcgtacgtacgtggcgaccataactcgccgttgcagccatctcactgcagtgtaccctgcaacatgccaattaacctccaagataagcatccatcgatccaccgctggatcaaccgcagcgcgcgagagatcgatcaacgtacgtaacgccatgcaccgtagccaccaagttccatgcatgcaccgatgcacgagtgatcgagcgagtgatctgatcgagtaataagttgcaggtttctggacgccatcgctcggtataaatacggcgttttctgcaggcgaagcagccaaggcatgcatgcacattcgctctagccttcctcatcgttgacagtgcgtggcagtgtactcttggttatcatgtcgtcgccgttctccgtgccatctctggtacatttcacgaatcgattagcaatttgttacagatgttaagcgtgatcgataatatatcgtgtgattttgatcgtgcagatcatggaggaggaagggcggttcgaggcggaggtggcggaggtggaggcgtggtggggaacggacaggttccggctcaccaagcgcccctacacggcgcgcgacgtcgcgctcctccgcggcacgctccggcagagctacgcctccggcgacatggccaagaagctgtggcgcacgctcagggcgcaccaggccaacggcacggcgtcgcgcaccttcggcgcgctcgaccccgtccaggtcgccatgatggcgaagcacctcgacaccgtctacgtctccggatggcagtgctcgtcgacgcacacctcgacgaacgagccgggccccgacctcgccgactacccctacgacaccgtccccaacaaggtcgagcacctcttcttcgcccagctctaccacgaccgcaagcagcgggaggcgcgcatgtcgatgtccagggcggagcgcgcgcacgagccgtacgtggattatcttaagcccatcatcgccgacggcgacaccgggttcggcggcgccacggccaccgtcaagctgtgcaagctgttcgtcgagcgcggggcggccggggttcacctcgaggaccagtcgtcggtgaccaagaagtgcgggcacatgccggggaaggtgctcgtcgccgtctccgagcatgtcaaccgcctcgtcgccgcgcggctccagttcgacatcatgggcgtcgagaccgtcctcgtcgcgcgcaccgacgccgtcgccgccacgctgatccagaccaacgtcgacgcgcgcgaccaccagttcatcctcggcgcgaccaacccgcgcctcaggaaccggagcctcgccgccgtcctctccgacgccatgtcggcgggcaagaacggcagggagctccaggccatcgaggacgagtggctcgccacggcgcagctcaagaccttctctgactgcgtcagggacgccatcgcgagcctcaacgccaccgacgccgacaagcagcgcaagctccaggagtggagcgccgccaccagccacgacaagtgcgtgcccctcgagcaggcgcgcgacatcgccgcgggcctcggcgtcacatccctgttctgggactgggacctgccgagaacacgggaggggttctaccgcttccgcggctccgtcgcggcggccgtcgtccgcggccgcgcgttcgcgccgcacgccgacgtgctctggatggagacgtcgagccccaacatcgccgagtgcacggcgttcgccgagggcgtgagggcggcgagcccgggcgcgatgctggcgtacaacctctcgccgtccttcaactgggacgcctccggcatgacggacgccgacatgtcggagttcatcccgctcgtggcgaggctggggtacgtgtggcagttcatcacgctcgccgggttccacgccgacgcgctcgtcacggacacgttcgcccgcgacttcgcgcggcgcggcatgctggcgtacgtggagaggatccagagggaggagaggagcaacggcgtggagacgctgcagcaccagaagtggtcgggcgccaacttctacgacagggtgctcaagaccgtgcagggtggcatctcctctaccgccgccatgggcaaaggcaagaaagcttgctgatgatgctagtgttcaatactgatttaattggctatttttttggaaattttttcaagatgatttgctcaaacctgtgtttggtttctgtgcttgcaggagttactgaagagcagttcaagggctcatggacagggcctggaagtgagagcagcagccatgttcttgccaaatccaggatgtgatgaggattattcagaggaaaattttaaacagttgaaatttatgtaataaaagccactctggacttcagccaaggagccttgatactttacagactgaactacagcacgcacggatcaactaattacatatagttacagtatatatgaatgattgagttatgactcaaaatggaacaatcagtttggggtaaaatgtaactgatctgtgagtttatcacagaaagtattttttgcacctagatgcaaaaattgggtacatacagtattgttatgcatttacagagaattctcaagttcataaaagaagtgtttgcaaatgaattatttagtaaaaactttttttctctttcttgataatgtatcttgcccaaatttatctaaatcctgaagcatcagcttcaaaaacagtggtaatttcttgtgcaacgggatggttacaaagcagagcacttgttcaaaggagggtgtctgaaatgttcaaaggaggttgtgcactgtgttcatacgaaaatgctcgtaatatcaattgtttttctagttttctacttagcccagggctttaagattgaaagaacgacaatagctgcaatgaccaggagtatgatgattgcgatgaacatgcacttccttgacttcttctgcagtctcttagctgtgcgcagctctcctgtaccacgttgtatatggtccacagcattttgaacctgagagttttaaactcattatcaagctaacaaggcgaaatatttccagccacattcgttaattgtcttttgagttttcagtaagttcggcaacaaaatggagggagattgcaaacctggttctctatgtcgttcaatgtctctccttgtgcgtcgacgagtgttgccatatccgcaaaaatctgacagcaggtggaagaagtcataataaagagataattagtgatatgggatatagttagtccattgattatatgagctcaattctgaagaacaaacgtgcaatcttgccaaagctacctgttgcaattcaagaagttttttttcaatttccatgactacatcatgcctttcatggatttctttaaccgtggctattatctgtaagtatgtgcaattatgaaacatttgagcactattataagaattgccagccttaatgacatggaaggaacatataatgtactggtgaagctgaacacgatattcaacctgccctctcccaattccctgaatcgctttctcaaatatctgctcactgctgccggtctcaatcaggtggtcaatcacctagtcatgttttttttttttttaaccacaatgagatcagaggagaaagcatctctcaacaccaagcgtagtagcactactgtcctcacctgatcagaaggctgctctccagtgactgttcaagattcaggtttatcaagaagcatgtgatagaatagcttgaagtaaattatactctctccgtttcagaatagaagttgttttggatttgttctaagtcaaactactccaagacaaaccaaaacaccttacattctagaacgaaggaaatatttatcagaaagaacgtaaaacgacttgaaaaaagaactccttacctgtgaaaaccatcctcgcaacgccttgtcggtactcatcttgaataatttgtcttagattctgtatgaaatgtggattactgtactgcaagctcttcaatttgttttctcatagaagatggacaataagctagaaagtttacctggaaatttttcattctttctttgagtttatttttcagcgcactgcaatcaacaagaaccaatcaaaattcacctcttttgttatgttgaacaagcaaaatatggaattgtttcttaaactttacaaatactttgggactacagtgatctgataatagacctaacaaaccaattttactcaaaatatgtcacaattctttttttggtggtgggtcaatgatcaatgtcaatcatgctgaatttaatttatcttgtcttgatatcaaacatatctgattatatcttctaaattattaaatttactgaagaaatgtatgaacaccttacatggtcattgacatccttgatcggtctacgcctgtgcccttttcacacccttgcttttttctgttttcaagattctgcaatcagaaaacaagtgagatcgtgagaactgggctaattcacatagtagtgcagattagtagacatgctaaaatccttacattcctatccatctcctccaacttcacttttatggtgcgtgtaattttcccaacttcattgatatctttctccatgcgcttgttgattgctggaatgtgtttttatttcagatgaatgcattagtatgatcattctactctgaaacttagctatatatgcagatcaatcaacagattaattgacgtttgcaacctttcatttcggaagccttagtgacggattttgattcctcattggcttcctatagttgataagaatgtatcaattctccaactccatagtatggtaatgggggaaacgtaagaaaaatattgtcatggacaattaactcttttgacaaaatgttggaaaggaattaagtatacctgaagtttgtggtttatattggacatcttgtccaacaacgtctcaatctcctgaacctaattcaacagaacacaaaatcagaagatttcatcatcattttgtgaaattagcactcatggctacaaaatcatagacaatagtgcatcaaaatcttggtgtggataaaattgttatgatacctcctggaagaaatcctcaagcccataatccgatttattctttgaattttgataccccatctcgatgtccctctccgattcaaaagaattctacaatcaagttgaaaggtcaatagtgatgtaagcaaggaaatattatggaattagcatatgtatcaaccctaacataattataagtttgaatcgtttacaacttctatgacagaaggacaatcatcagccatcaaagccctataatttgatcagtttatcctaaacttcgaaaagaaggttcaggattttgcatccagccaaattactggcccagggtgaaactggcagagaagggatcataattcataaagcagattggcacgacctatgaaaatttgttctctaatcaactgtttctccatcaagagaacatcaaaatcacaagaaagaaggaagcataatgatagcatcttttcgcagaaaaataatcgtaataatcctatgaagtaagaacattaccgtcagaagattgttcatctcgtccttgtggccgcagagagggagagagacgaagagttgaagaagagtagatacgaagaactcgtctgctgtgaggagactttggagagatcgttcaggcgaggaacgccggccgccaatgctagaaacaaataactagcagacagacgagtttagtaaccaacttaaacgcgaagtaaactatttcctctctcgcctccgtgaaacattgcggcaaaaaaattccaaatttatgattacccgatgttaaacatatgcaatatataccgcgattatatttccttagtacgatttatgaattgttttcctattaggactcctaggtttttatcccctatatatctatggtaataagcaatagttctgagccggaatccgaaatttcggtcatttcggtcccctacggtacgatattacttcggccgaaatttttcaattttttcatgaattttggtaatatttgttcaaatttaactaaattttgttcaaaattttagaaatttcggaccgaaatttcgagatttcgatgacctccgatcgaatgtcctaaaccgataaagtgaaccctagcttgaattcatcaaagtaagcaaatcaagagatgaaatcggcccataaagatcgcgtgttcactttgactcccttaattagttgtcgaatcagatctgtatccctgaaccataatatctaattaatatttcaacccatccattgttaaaaccggtgcaatttgactccctcggtggttttggagagcggtttcgctgacgtggcatctacgtggcgatgttgacgtagtctttatttcacgtggcattgacatagcgtttgtgtggtattagaatttaaaaaatatgtgtgggatctgtttatccttcaaaaataaaaattaatgggggacacctcgatgtgaggtaagcacatctcatccaaatcgatgagcagaaatctcttactagagaaaccaagccaacggtgagtatttcaacaggccttgctccggcaagaacttgtccacgtcctcggcagctgccagccacttgccgctgtctctgcagggccagcagtggcaccgccgctcctcggcgtcggcggcggcagcctggatacttgttcgcctcgtacgatctagagcagcctcgcgcgacgaacagcatccgcccacccagcgacgaacaactcctttcaagcgtatggtgcccgtggttgtcgttgggagtctccggcgactgagacgccggtgctccctcctcttcagcggcggccgcccctccccggggtgcccccacaggcgcgccttctcgacggcgggctacggcaaggatgtcgacgaggtaaacctcaagttcgcggaggcgcgagaggagatcgaggccgcctgcgtgcacgccgccgccggcgagactctcgcgaccttcgagtgatcgagtcccttctcgcccacctcctcgatctgcggcaggttgtgagcactctccactcaagatcacaagaacaagatatcttcgatggatcaacgagatcgcatcgccttcgctgccagtatatttgatctttttcgagatgagttctgttacagaaagtgtttgtcttataactctgtctctcgctctctcgcttggatagaggaatcaactactcagtgacagctaattgacaactgttacatagcccactctggcccagttacacgaatgtttggtttacgcactcgtgcggcccgttggacttgtggtttctgtagctcttcaggcacgacagtagttgggctgctggcagtagctgggctgttgacaagcccctccccttggaatttgacttgtccccaagtcagagcatttggagatctttgcttgagtgcagcttcacgttcccatgttgcatcagctgcagcaggatcagaccaacgaacaagcaattgagaaacaatacgattaccttttcgggtaactctggtatccaggacttcagctgggaactggatatttgcagttggggaaggcagttgttgctgaactgactgcttgaaccctttagaactcttcagttgggacacatgaaaaacacggtgtatggcactgccagatggaagctgtaacttgtaagccacctgacccactcgagaaatgatcttgtaaggaccaaaatacttgaaggagagtttatggtttgctcttttggcaacaaaagactgtatatagggctgtagcttgagaaaaacccattcaccttcttggaattgcctgaaactcctctttttatctgcttggtgtttcataacctgctgggctcggttcaactgttgcttgagaagttgggtcatcagtttcctttcagataaccacatatccaaatctggaatattgcaagcatcctctctaatgccaaaatgtgcagggggtaacgatagagaacctcaaaaggtgacttatcaatggaagagtgataggaacaattgtaccagaattcagccaaatggagccattcagaccatttagaaggagtagcacggacaaagcaccttaaaaaaatttctaaacattgattcactctctcagtttgcccatcagtttgagggtggtaagcagaactgaggtgtagtttagtgcctaacctgataaagagttgttcccataatgtaccggtgaaaattctatctctatcagaaacaatggcctttggaagtccatgcaatttgtaaacattcagcataaaaaccttagcaacatcaagggcagaaaatggatgggaaagggtcataaaatgagcatattttgagaaacgatcaaccaccactagtatgcaatcttgctgatgagatctgggcaaaccttcaatgaagtccatagatatgatttgccaagctccttctggtactggtaacggttgcaaaaggccaggatacttagccctgtctggcttggatagcagacaaacagagcaagaagagagctgatgctgaatggcagctttcatgtgtcgccaagagaacagagccttgattcttttgtaagttacagggaatcctgaatgaccacccattgggctatcatgtaaagcagagataatttggtattgaagagatggattatcgcccacccaaactcttcctttgtgtttcaaaagtccttgagacagcttataatgagtatgagcatcaggattaatagccaattctatcaaaagtttagttgagacagggtcctgttcatatcccttcaccacctcctgcagccaactaggagaacatacagaaatggctagaaattcagacaattctgttggcacattcctggatagagcatcagcagcaacattatacttccccttcctatacacaatcttgaattgcaatcccatgagcttagtaaaagccttgtgctgccatggagtattaagcctctgttcagtaagatgcatcaagctatggtggtctgtcaaggtctgaaattcctgaaagtgtaaataagggcgccagtggtctactgccatcataattgctagacactctttttcataagtggaaagtccctgagttcttggctccaatgccttactaataaaagcaactggatgctgattctgagaaagtacagccccaataccaaagtcactagcatcggtttctactgtggaagtttggttaaaatcaggaagtgccaacactggagcagaaactaaggcttgtttgagagccacaaaagcctcatctacctcagcagtccactgaaagggaacatccttctttaagagttgggtaagtggcttgctaatggtaccaaaatttttaacaaatttccgatagtatcctgccagacccaaaaatcctcttagtttcttgatggtagttggtcttgcccaatcaacaatgctctggatctttgatggatctgttgctactccggagccactgattatatgacccaagtaagaaatttgttcctgagcaaatgcacatttactaagtttgactttccattggtggtcaacaagtagctgcaacacttgtttgagatggcaaagatgtgatggcatgtcagggctgtaaataaggatatcatcaaagaataccaaagcacattttcttaagactgaccaaagggtatcattcattgcactttgaaaggttgcaggagctcctgtaagtccaaaggacatcaccttatactcataatgcccactatgagtttggaaggctgttttatgttcatctcctgcagccattctaatctgatgataaccagctctaagatccagtttagaaaagaatttagcaccagctgattcatccaagagctcatctatgactggcataggataagtgcccttttgagtaatagagttcaactgcctataatcaatgtaaaccctccaagatccatccttctttttcaccaacaatgcaggagaagaaaatgcactggtactatgttggatcaccccgttgtgtaacatttcttgaacttgcctttcaatttcatccttctgcctaggagtatgtctgtagggtctaacaaacactggtccagaatttggaagcaagggaatgtgatgatcacagtaacgttttggtggtaacccttttggttcctagaagacttccctaaattcctccaatagagactgtaccgcagcaggaatttcttgaaaagattgctcagtgttcttatccagttgaactagatacatgattccaccagatttagccaatccattcaattgatcaggagcaataggaaaacaactctctgtgttagaatgaatgccttgtaatctgattacagaatttcccaacttaaattccagccacttttgcaaccaatccactttcattgggctgaactgctctagccagtccattcccaatattacatcataggctcccaatgctaacagtctgaaatcacttttgaaattgatgccttgggtcaaccaatcacagccaagtatatgcaatgaacaagagagatgccccccatatgcaatcttaactctgactggttctgtcattgctttaactccagacaaccttaatccaagctgatgatcaacaaatgaatgagtgcttccagagtcgatcagcatcaacacttcaataccctgaacccaccctctcaatctgatagagtgacttgattcagtgccattaacagcctgaggtgaaatagccataagtgtatcgttttcctggaattcatatgcttcatgatcagacaacaaagtgacatgcaagacatccatcaattcctgtacaacatgcagctgaattgaagatgcacatttatgatccttgctccatttttctccgcagacaaaacaaagtaccttcgatcttctataagacttgagagctgccagcctttcagcttcctttgactgagcgacttgatcagcgcttctcctgtcttgtgataaaaatggaggtccaccccttgtagttggaggtaaaggaagtggcatagcccctttatgagagcccttctgatagctagtggtatcaaccctcttggattcttttggtttatcaccttccaaagcttcttcctgtaaaaaggcaagagtacaagcagcatccaagtcgccaggcctttggagtaacatagctgatttaatttcatgtttcaatccttctacgaacttagtgacaaagtaaactggtttaagagaagggtcataggccatcatttgatgcataatgcaatcaaactgctctacataatctgctactaatcctgattgactgattttaatccattgcctaataagagcttgttgcctatctctgttaaacctactgcaaaccttatcacaaagttcaccccaagttatcccttccaactgagacctaacagcttgcagtcagaaagcagcatttcccgtgaaatttaaggttgctaccttaacccaattacaaggatgtgtgccatatagatcaaaataagcctcacagttagccttccacataatggggttatctccatcaaacttagggcatgtcatgggcactactccaccactcagaccaacagacaccgcagtttggaaagaattcatggcagaggcatcaaaattgaaaggaatcagggagacattgtgggacacgtacgtaccattgactggggttggccttggggtaaaccccgtaacctcctcccgtgtaagattttgaatgcggtggccatttggaccggttgagccatttggtcgaacacctggtgagtccaggtactcgactggaatggatggctccagatttgccggagcgctcgccagcttctccacttgcgtttgcagcagatccatggcggactggagtacgtccatcttcttctccactaccggtatccaggattctaccgcctccttaaacgagcgcatctccagggactgcctcttctccccctcctctctcttccgctctgtttcctccatcttcttcaggagcaagtcaagtttcgccttgttctccatgatcttcgcggtctgtttcgtcacgaatcatggtttctccagggttacagatcctgtctcacctcatcccgaattcaaccaactcaagcaaggcaagttgccttttcgcggatcaacccgaaggtaatccaatccttgctcgagaatttcacggtcgaatcaagggaatccgaggatcaacgaagctctgataccaagttgtgagcactctccactcaagatcacaagaacaagatatcttcgatggatcaatgagatcgcatcgcctccgccgccttcgccgccagtatatttgatctttttcgagatgagttctattatagaaagtgtttgtcttataactctctctctcgcttggacagaggaatcaactactcagtgacagctaattgacaactgttacatggcccactctggcccagttacacgaatgtttggtttacgcactcgtgcggcccgttggacttgtgggttctgtagctcttcaggcacgacagtagttgggctgctggcagtagctgggctgctgacacaggtacgaacgagcagacccacccggtgcccgagaagtcactgaggtcgagcctgtaggtgagcgtgcccaccatggtggtctgcatcaccttctgcggcggtgtgggagcgggagcagctactcctccagctgctcctcctggagttcacgtgggcgcgtcgtggtggtgcagcatcatcatctacaacgtaagagtacaaggtggtgacgcgggaaatggtggcgctgggtcaatcacgggcgtccctctccagcagtctgggtgcctcacaaacgggcgccaccaccggccaccctttcatctggactctcgatccccgccctctcaacgcctccctctgaccctttacacaccatgttcgagggcaacttcttcctctccctcgccatccacatcaacttcggcaaccctgccaccgagcccatccgctaccccgacgaccgcatctgggagtttgacatggcacacaggtccaacttcctcgttgacgtcgtgcccgacaccgtctttgtggcctccggcgagctcccgccgcagaaggtgatgcagatcgccgtggtgggcacgctaggcgcggggggagagaaagagagagagagagagtcagataggtggcgggatgcatgtaattcagttgggttgtcaccggctgagatccgttggaggcgttcgtgacgggcgcagtgttgtggatgacggaatacggatgtcggacggggagggtaccgctaaacgattaatcggagtatggacgaataatcggaatttgacggaaatttaacgttttggacaaatatatgtacataactcataatagcttattatttttgacatataaatgcatataactacatatatatatacctattattcttaaataaaaataaggataacatgacattaactcgacatatagtaaaatataggtctgaacactcatagttgtgcatcaaatagtgataggtttggttcgtaatgcataaagaaataccaaaagcaggtaacactatataagtgacactaaaacaaggtcccaaataagatatgagttactccgaagaatcatcatcaagtgtaacatcatgagctgcgagtattttgggattgcaaatgacgttctgttagctatatagtgctaggttacacaattaatgggccagtatatatagtgctaggttacacaattaatgggccagtatagttatcgtgggctggctgggctaggtcttgtcacgtgattaggcccgtttattcggtcgattagtcagatacagctgattagtcgctaacgacggtgattatacgtcctgaaacgactaatgtgcaccgttttgctaaaacgtgacggagaggtaagcgccacagttttaacgtccgaatatacggccgtaccaaccgttatccacaacactggacgggcgaatgcctgcgaactagactcgtcggtccataagggacatactccctccatctaaaaataaatccaattctaaatataaatctagacacgcatatatatagaattagattttgcgtgtccatattcatatggagattagatttttttttttttacggaaagagcaggccgaatcgatgtagtcacgcaggacggaacagcggagtactaatcgcagcaagccgtgccacgacagattcatcggccaaatcgcctcatcaaagtgacatgatcttgctgctctgaaaatgattagctattgactccaaaagaaaaaaaatacaaaagactgattagctgttaactaaagaaggagatttccatcatatatccttaatctttacccgtgttcatccttcccaacgacatttcgtaatttcagtggtcaccaaaattttaaaatttcggaacatttttctcacgaaataatttaaaattttaactaattttaactgaattttaatatatttttttaaattacacagtgcaacgcagtcactcacaacgcacgcactcacccctatgaacgcactcactcaaaccttatccctatgagcatcttcgtagactaggtttggtcaaatccaacaaatagaaaactcaaaaagttcaggtgagatatttgcttagtggaggggacgaaatttcgaactggaattgtaagccttgaaaaatcttgattacaactgcaaacaagacaattttcactccttttgagcaagagaaaatcccttatatacccctgaaatttttcctaatcccttctatacccctgaattttgcttacttccttatatacccccaaaatttgattttgatcccttgcatacccctcccgtcagttgactgttagttgaccgtgtattttctataaaaatgaccattttacccttggatgaacaaagaaaatcatgaattacgttattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacagtaggggcatggaagggatcaaattgaaatttcaggggtacagaagggatcgggtaaattttaggggtatgaaagggattgagtgagttttcaggggtacacagggaatttactctttgagcaattcagggatttctcccccttgtggtaggcttccccttcgggactaggatcccagccttttcgctgtcagccgaacgaagcctcaggggttatgcctcctggtagtccctagatgcttccctagagagtaatcgagccgccgtgcgaggtccttttttgccgctgtcctaaacccattgtcgccgtcaaccatggtgcatgccgcctccagccaccctcggctgtgccgccaccactagaaggtccgtgaggaccccctccccctctagccgccccggccgagccctgccggtgagcctgtcccgtgccgccgcacgctctccttctttctgccgttgatgggaggaggaagatgaggactctgacgtaaatatgaaaactctagggttcatactataaaatactgagacacggacttgtgaaccccactgtttaaattaggtgcgcaatataggaatacaccttcacagtaggaaaacattctctggacagtacgctttagttcttttgtaaataaattaataaatccaagaaaaggttttctgttaattatttttgtatgctttagttccatccctggtgccgacaaggtgggtcccacatgagctagctcgttttatctttgcctcactagaacggataccctcatctcaatcgggcggtaagccccatctcaatcgagcacagcgtccgtcacaggctagaagtcactgatgtgaagagttatctcaatcgggcaaacggccgtcacgaatgaatatatctcaatcgggtcctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcaactcaatcgggcctaaactatagcctgtcatagatgactgatgacctcaatcgggcctaaactagaacccgtcacagatgactgctgacctcaatcgggcctaaactagagcccgtcacagatgactagtgacttcaatcgggcctaagctagagcccgtcacagatgatctcatctcaatcgggcatttagttatggcccgtcacaaatgactataatccacaaaaaaaataaattttgttttttggctagcctcaggcctttgctagccatgcccactgcaaaaatgacagaaacaaacacagatatccaatatccccagctccccagcatcacccattcatacatatgcattcacatacacagacatcaacatattttacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcccagttacatcaccacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataattctagattagttgatcgatcatatataagtactaaaatgtagttagtctatcacaattgagaccaccgacctcaaactcagccaaagtcttcaccttttctctatacagaagtcgcatgttgtggcacacatgtaatctgcactggtcacctatttgttgcttcaccgggaagtcttttttgtggatgagggtgtcatgtcctgtcttcctgaggcctcctctttgcacgtattgggcccacgcttcatctatcgctagttgaattgggatccaattatatgcgttcttatcaattctggagttcaggtaatgacatgtactccatttaggtgttacgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcatagatgtagttgaccattccttgacggtcattctggagatttgtgacagtgaccacttatggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccgctcggagcctatagaggtcgaaaagatccttgaagtcgaccacgatataatttgttggaccaaggaatggctttccatcgtgctgtccaaggatatcggtagctttacttagcttcctggcgttagatttctccatgtagtataagtgaaggtccttacaagtggtgcccattgcggcaagcatgtcatctccaaccaatggcatgcctagttggaactcctgtggagcgacgtatttcttcttgacctctttgcccttagtctcttcctggcccttgcctagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctctgttcggtcctccccaaaatccgtgtcgtactgcaactgcacatcgtaagattgtgcatgacgattttgagcaggaggggctgaaggagcagaggcaggtctctttggtggacgaccgcctggtgcagtggttggcctcgctgtaaccctgatctcaatgaggtccttgggccattggatgaaggtatcacgggcatttcctagtgagaggacctcgtcgttcggtggatacttcagagggaacaactcgtattcgggcttcaccgagtcgacttgaacttttgcacagtcggccctgagttgagctccatgcactcttgtctctgggatcggcttgtacgcaagtccctcggctgctggaacagtgaaggtcggcatcaccctaactgtgagggtgcagctcgttggttcctgcgatagattaatcaattttttttagaatattatatatcatatggattcgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccgccttgttcgaagtccgcttcttgtactgccacgcgtagtctggaaatccatacttccagggaacagaagacccatcgccccgtgtccgtccacggtgttccttgttacccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgagaacatctagtttgattagacacttactatagcttcgtatactcgttgatcttctgcatttggcatgaagattgtgccatcatcatgtttctagtacctagccctagcccagttcctagcccgagggtgtgggatatcgccaaacacgagcggtgtgcacgattcctccgcttcttcatcctcacgctgccattcctcttccttaccggcatatccagcggtaccaagccggtgcggatgttggttcctggtctggagcaagcgatatgcctcgcttctagctctggactcgggggtcgacttcttcgcatggaattccgaccagacctgttccgtgatccaaggaaatttgtctcttggatctggatttgccgggttgtagacgaactcgccgactagcttagtcttaaagttcttccaagcagtgcccataaccttgaaagcagcccgcctgagacggtcctcatgctccgcaggataatcaaagctctccttgaacgttagccaagcaatgtccttctctgcggccggcacgagcttgaagtcgtcttgcagaatactgaatttctgcctccctatgaccccgcagatagacctaaatcggctcaatattttccttggagctgtcagaaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatgaattgaatgtcacttataaaaataaatgaaacatataaataaattaaattgcgcatatcacaatgatagaatgaattgaatggcacatataaataaattaaacatatcaccaaatcctaaaatcataaattcacctcataccatctattcatccacatatcatgcatctatcactaaattgattaatgcaccacattccatctattcatcatcatgtcatcaataaaaaaaatcattcgtttaccatatatcatcaatccctaaaatcatctatcactaaaatcatctatcactaaattcattaatgaaccacattccatctattcatcatcaagtcatcaatcactaaaatcatctatcactaaattcatcccaacatccacatttcatcccaacatccacattttcattatcaaccacatgcaggtagcagagggaggcgcgatggaggactcacatgaggtcggccgggtgggctcggtggtggcggcggcgggctcggtggagggcgtcgccggtcggtggaggcggcggcgggctcggtgcaggcggcgggctcggcgaaggaggagttcacggcggcggcgccggtcggtgtagacgccggtcggggaggtcggcgtcgggcgggcggcgtcgggcgtcggtgaggagtaggcgacgacgatgaggaagaacgtcgccggcctcggtaggggctgttgttcgtgtcggtgaagaggcaagcggcgacgatgaggaaggccgaccccggtcggtgtaaaggctcggtggcggcggcggcgggctcggtggaggcggcgggctcggcggcggtggcggcgggcttggtgacggtggtggcggtctcggtggcggtggcggcgagggaggacgacggcggcgaaggaggagttggcggtggcgctagggttctaaggaggcgggaaactgtagcgggacttagaaaaatttttgatccgatctgagaaaccctagttatattagagtgatgagtcatctcaatcgggctttgccgtagagcccgtcacagatgactcatcggtgacgggctccatactaatgcccgattgagatgacattcaggcccgtcacggaagactcatctgtgacgggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacattttctgatagtaaatgatttcaaatcgaaatatggtcaacaacaaaattgatcctctcatcaagatctacaacttttattttggtcatttatctatataattttgtttctaacagcttgaaattgattttaacaatatgacaaatgtaaacagcatttgtaaatattacatgactttaaatgggaaagccataaacagctaacttgtacagctaatcaagatctgtaacttttattttggtcacttcttcatccgacaaagtgatagtaccaatgtttataaaattgacatatctgtgttgatatttataaaccagatgagagaaatgtgatttttgtgaataatataactatcactttatcggatgaagaagtaaccaaataaaagttgtagatcttgatgagaggatcaactttgttgttgaccatatttccatttgaaatcattaagtatttacaaatgatgcttatatttgtcatattgtcaaaatcaatttcaagctgttagaaacaaagtt

SEQ ID NO: 63886 - DNA, 2957 bp, Oryza sativa
atgtgtggacccacatgttagtgggtcccatacattcttttggcaaatgacaaatgggtcccacacatattttttaattctaatgccatctaagcgtcacgtggaacgaagaccaaatcaatactgccacataggcgttacgtcagcgaaaccgccatccaaaaacgccgagggagttaaattgcaccgattttaataagttgggggtcgagatattcggtattgtggtttagggatgcaaatcagattcggtcactagttaagggacccaagtgaacttactcccattggagtacgcctgtatgttagtagtgccaatggacaggagaaccggcccaaatagcggcaggttgtgttcaactgtccagcggtttcagtccggtccgtttgcgcctactcgtgatttgggccgctgatccgtcgtccacgacgaccgagatgagagcgatcccctcgagaatttcaggcgaacgcgcgcgttgagcgagcacttggatctcagagggcctctgctccctcgtgttgcgatgctctgcttcgttgaaacaagccagtcaggccgagagccgataggtcgcgtagaaccatcccgaatgaattgaaaagaaaagaaaagaaaaaaaaatctaactgtgacatcaaatacagagtacaaagatatacagctggtactcgtatcaattatttatatattaaatctaaaaactgtgtatacaatacagaattatatacgagagcatatataagagaatagagaatatatatgacagcataccactttacatgaactttggccttgatctttatagacatggttcacacatgatagaccatgtcgacttcatagccatctgaatgccgtccagattacgggccaatatttttgaactctttccatatttttgaggtgtaaaagacaagctttcacatagaaaatcgtcaaaatcatattctgtaccgaatctacagttcctgataacaccatcgggatggcaacccgaatggttgtagtatttataaactgttatggggaaatgtttatcatgtctcgcgctcaatgtgagtggaggtagcttgccaacacccagcttgccattgaagataataaaagaagtattaatgttaaagtaggttgcaactattaattgcgagtgaatcatgctcgtggttatcttcaatttgacacacctcaaactccaaatcaaccaggaccgctttcgggatagcaaaaattgtcagatcaatggtgccgaaatgaccagtgttgatgtgccatatgagcttttcaaaatctgcatagaaagatggagcgtagatagaatatccatctattaacacttgatcttcttcctccttttgacccttaataattaggcgatactcaattagcacaatcccaactgcataaatgcctcgaggaggggtcatcagaggttggaggcaatgagcaccctgcattgtaattaagatatttttggaaaagattagaactgcaatatgtatatattaattgttcaggaagtagcagagaaaactgtatggcatcatcaggtactcaccggcttaagtttacatgggttttctcttgagtagtcaaagacatagttgcgcagctgactattgcgtgtatctctgaatgcaaatgtacatagatctccaatggaacattactaggagaagatagattcagaccaagtacttgtatagctcgacggcatggttccttcccgtccctatctaaccatcgcctttcccacttggggagtgcaggcactagaagtagaaaatcaaaaaaagtcaaatcagtacatcttgaattattgtttgtgatctaaatgtgattagataaaactagaatattagggaaggacctaatatcaaataattagaaggggtgaggctttaaacccaagtcgtctagcccaccaccttgtggagctagccggaagacccctgggcatttctcaaatgtgattagataaaggagtctgtactgataaaaactatttctacaacagatggcatttggattgttagtacacgaattggactagtggacttactcaaatgatccgtaagtgttaggtttggatctaagttgaatggcccttcaaccacaagagacccctcccaagattctgaaagatcagggatgggaaacttcatttgtctgagaatttgcttctcccatgtctcctccctatcagctgcataataagggttcccgtcttcatacctaaacccatcgccgtatttcatgaaaatgttccttccattgctgtagaaggacactccactcccatcggagtcataatcagtttcgtacgtgtgcggcccatatattttctccaattcatgatcttcaagatgacagggttctccgtgtcgctcctcgatcatcctgcacacgtataggtcgtcttctctctcttgctcgtgtcgaaggcgacttagttcgtcttgctcctcgatctccctctgcaataagtcgatctctttgtcccatatccaggtgttgagtatctcgcgctctgcttcctctcttgtcgccgccaaatcctgatctaactccacgccgtcctccatagaacaacctcacagagtattgagcctccgttgacgacgtggatggacttgagatgaaattccgatcaactgaatccatgccactaacgcgaaccctcgttctatattcatgttctgcgtgtgtatacgagatccaatgggtattccgtatccgatatcaccaacctacagacgtgtaggatgctgttttatttccaaacggaaaacgtacatagaagttcctcaacttatcatcggattatagaatcatcctccaaccctaaaactaatactccctccgtttcgttttatttgacaccgttgactttttagcacatgtttgactgctcgtcttattcaaaaacttttgtgaaatatgtaaaactatatgt

SEQ ID NO: 63887 - DNA, 18397 bp, Oryza sativa
cgaagacgacggcaaaccctgcatatgaatcctggctggccacagaccagcaggttcttgggtacctgttctcctccttatccaaggaggtgatgacacaagttgctgcatcaaggaatgcagcgcaggcctggagggccattgaggagatgttttcttctcagacacgagcgcgcgccatcaacgtgcgactcgcacttaccacaatgcagaaaggtacgtcttccattgcggaatactttgggaagatgaagagcttaggagatgaatttgctgcctctggaaaaccactggacgatgatgatatggtcgcctacatagtaaatgggttagatgaagattacaattcagttgtctctgctcttgttactaggatagaaccaattactgtttctgagttgtatgcccagcttttaaactttgaaagtagattggaactccaacgtgtaagatcaacgtgtgttttgattcttattctgtgatgaacaattggcatctgtgattattggttttgatatttggagattattgtcgaagtggttttggagataatcaattttcaggtgatgatcggatttgctgttattttatgtggtccggtccgaccgggcggaggttgccggtgtcacgcccggaatttctatccaaaattccaaacgcttacatgtgtgtgaaccctcgtccaggaatcagccgaggcacacaataacaaattgataatagagtacaattattactctaattaataaacgtataaaatgtcattacagaggtagatagttcctctcaatcaataaagatctaagcagcggaaaataaaataaacggcacggacggctctactccacaggcaacttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggttccatttgcaaaaacagcatttagcaaacatttgagaattttaataaaacagttgagtaatagttaaacaatattaatccaacgctatacaacataccctgttgtataggcccaaccatactgaacaaccatcccggctgcacagttctatctccaaaccaggaatataccattccaaaccaggagctaaacaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgtacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattaccaggttttagttggcacattaattaattaactaatcacgattaaccatcgtgaactatcaataaaccatcatgaaataatagtgagtcattagttatcccataagtgtgctaatgtttctaaacagggctaagcaattatatctaatatctagttgaaccaatataaataaagctcaactagtcaaattattataacccaaggtatcaaggaataaggtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccgacgaaaacggactctccggaaacgacggaatctaagcagaaaagagcaaaatcaccaaaacagcacataaacaagcatgaacaatatatgtggatatttttaatgtgtagatctcaattttagaaaaatttagagacttgaaccaactaaatcggagctaagatgaattagttatgaatttttaaagattaaaccggattaaaacacttatatcggtttaaattgaattatgacgcaataatgaattatttttgaaaaggaaaagatggtttattgcgtcagcgggctagggtttcggtggaccgggcgcacgggcggcggttcacgcgaacggacggccgagattgatccaaaccaaaacggacggccgagatcgatcgggtccacggcggttcacgggagacgactccgatgacgtcagcgatgacgtcaccgacagcggcggcggctcggcggaggagacggctcgaacggcgcacgctcgccggcgaacggcggcactaggacgcaaacggagggcaccagcacgtagaggacgacgcggcgaactcaccggtgaccacaacggcggcggaggaggaacggacgacgacggcgacgaggaggaagcggcggcaaccttcgggtcgacggtgacggcgatgctccggcggtcttcggcggtggcgaagcagcggacgaggacggcgacgacttggcgagcacgacggtggtcttcccgagcgacggcgacggctgaaacgacggcggcgcacggctggagcggcggcggcgacggcaaagctagggcacacggcgctagaacgattccgacgacgagaggcgaaggcgagggtggcggcgggtagaggagacaccgggggtccttttaaaggggctcggaggcggcggcaaaggcccacggcgacggcaacggcgaaggaaacctcggcttggagagagggaaaccgatccgaatcgacctcgaatcaaactcattccagaccgatttagccgaagattccaaaggagaaaaggtagaggagatcccggagattgtttcccctcaaacaattcggccggagaaggaaagggacggccggatttggaaggaaacggcggcggcggcgcgctagggtttcgggcggcggcggccgaaggttgacgaagggcctgacaggtcggacccacctgtcagcgaccgaacgcgcgcgcgcgcggctgcggactgggccggactgggccgaggagagagagcggttttgggccgactttcggcccaaagccaaaagagactttttaaaacctttttcaatttaaattatttcttaaatgcaattccatttattaaaaatacttccttagctcaaataaatcccagaaaaatctaggaaatatagaattaagcaaagtatttaatgaaattttatctggccccattttatattggaatttattaattaaaattagatcttcttttcaagacttttaaaattatttctaaaaattccaattaaacaacaatttataaattttgaattttcagggtgtgacagccggtcagaccggcttgtgttgagcggtcagaccggccggcccgcggtctgaccggccgatgctgtatcggttttggtttcgggttgtttctttggatatccgtgattgtttcatggttatggcttctagatggatactatacgtatgtaatactgttgtttgctaacaatgagtcaagttggagatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatggcatacgatggaggtattgtgtgcgtatgggatgcggagtcgaatttggaaggagtccaaatttggtacgattggttatgtaaagtttctttcttgtactagaaggtttcctaaggtgtttaggactcttagtatgagtttggttcgtggctttaggctgcctacctcatgtataaatagagggggagcatgaggcttcccggtatcgcttttgagagcaattgagttgctagtttagctagggtttcgagtttagtcgagatttttgtaaggagtgctgttggtgcactttgtaaacacagagagaagcaataaagttgttatctactttgagagttcttcagtttgtgtttcaccgggtttcggcggtccaaccggcgatataccggcggtcagaccagtggcaagcggcggtcagaccggcggcatacgagcggtcagaccggcggcggcagcaggcacgacaggcgacttcggcggttcgaccgatcgatctacatcggtcaaaccgacgtgttccaggcggtcagaccggcgcgacaacttcgatcagaccgcggtccatcgaattcgagggtaacttttatttccgctaaaagtttttggttttggggtatctcaaccattcacccccctcctctggttggcttagttcttgtgattcgatcatacacaacgtaagggctcctactcatttgtgaatacggtgagcaaagggggccgtggtggcggcttcaaccgtggtcgcggtggtgcgaaccacggtcgcggaaagggacgcggcaatgcgccgcaaaattctggaggaggacgcggtaacaagccgcgctgtcagctgtgtttcaaagtcggccatgtggtggccgactgctggcataggtacgaggaggacttcgtgcctgatgagaagttcgtggcagcagcgacgagctcctacggtgtggactcaaactggtacattggtaccggtgcaacagatcacatcacaagtgatctagacaagctcatcattcgggagaaatacaagggcaatgatcaagttcacactgcaagtggcgcaggtatggctattagtcatgttggtcagtccattattaaaacccctgttcgaaatctttagttgaacaatgtcctacatgttcctgaaaccacaaaagatttgatttctgctcataaacttgctcacgataatttagcttatgttgaacttcatccaaaattcttttatgtaaaggaccgagccacgaagatacctctacttagaggaagatgccaccaaggcctttaccctgttccaccttccaagtcttcatccagaataaagcaagtctgtggtgctgtgaaaccttcctatgagagatggcatagccggcttggccacccgtcacccgtagtcgttgctagtaataatcttccatgtttaagtcagtcaaacaaagagtctgtttgtgatgcctgtcaaaagactaagagtcatcaattaccttattctgagtccattcataagtctgagtatcctttgcaatgggtgttttctgatgtatggggtgctgccccagaatctgcagggagatacaagtattatgttagttttattgatgattttagtaaattcacttggatttatttattaaagttcaagtctgaagttttcagtaaatttcttgaatttcaagctcttgttgaacgcttgtttaataggaagattattactatgcaaaccgactggggtggcgagtaccaaaagctccacaatttttttgcccaagccggcatcacacatcacatctcatgtccccatacacaccaacaaaatggttcagccgaacgtaaacatcgccacatagtggaagtaggacttgccctactagcttttgcaagtatgccattaaagttctgggatgaagcctttttggcagccacatatcttataaaccgtatacctagtaaagttatcgactttgctacacccctagaaaagttactccaacaaaaaccagactattcctctatgcgcatttttggatgtgcatgttgtccaaaccttagaccttataatgtttacaagctccaatttcggtctaaacaatgtgttttccttggctatagcaactttcataaggggtttaagtgtcttgatgtggctgccggccgtgtctacatctctcgcgatgtcatctttgatgaaacggtgttttcctttgctaatcttaatcctaatgccggtgcaaaactccgttctgaaatcctgctacttccatctcaccttcggaattttcagcctgctgatcatgggggtgacaatgtgactgatcaacagactaattcagccagtactgctaatgccgctaatgatttttctggtgcaaatggaagcaataatgcaggatctggagctgcaagcgatgatgggcatgacgagctggagattggcaggaatgacacggcctccgatgacactgatcctgatgatgcaggtactgtcagtcctagcagcaacagaatggaggcgcagacgcaggaggatggcgatgggacttcattctcttcgccgagccaaccccgtgcagccacgtcgccaacacaaggcgcgggtgcgtctgccagtatgcagtcgcccggagcaacgggcccgtcctcggcagcagatgggcagagcacgggatctgctgtgccggcgcctccgacggtagaagatgtgatcagacccagatcaacccgcttacagagtgggattcaaaaaaaaaggtatacactgatggcactgttagatacaagcatgctggtcttactgcttgtggagaaccacaaaatttagatgaagctttaagaaatcaaaattagaagcttgcaatggatgcagaatatatggcactaatgaaaaatgagacatggcacctagttccttcatctaaaggccaaaacattatagattgtaaatgggtctatgagattaaaaggaaagccgatgaaagtttagatagatacaaggctagattagtagcaaagcgatttaaacagagatatgacatagactatgaggatatttttagtccagtggtcaaggcagccactataagaatagccttatctctggcaatgtctagagggtggtctctacgtcagttagatgtgcagaatgctttcctgcatgggcttttagaggaagaagtctatatgaaacagccacctgaatatgaaaataaggctatgtctaatcatgtatgcaagctagataaggcactgtatgggttgaagcaagcacctagagcctggtattctcgccttagtgctagttatgtgagcttggatttacagcttcaaaggcagatacatcattgttcttctataacaagggttctgttacagtatttgtgcttatttatgttgatgatattatagttgctagctcaaccccagacgctacttcagctttgctaaatgatcctaagaaggattttgccttgaaagatttaggagacttacattatttcttgggaatagaagttttcacaagaacaagaatggtattctgttaacacaggagaagtatgctgctgatgtgttgaaaagagtgggaatggaagactgcaaacctgtaagtactcctttgtctactagtgagaaattgtctatcaatgaaggtacagttcttggagaaaatgatgcaacgcattatagaagtattgttggtgcattacagtatcttacattgactagaccagatatttccttctctgttaacaaagtgtgtcagttcttgcatacaccaactacagttcattgggcagcagtaaaaagaattcttagatatctgaaacatacagttgatcttggtctcaagataagtagatcttcttcactgttggtcagtggatattcagatgctgattgggcaggatgcttagatgacagacgttccactggtggctttgctgtgtttttgggaacaaatctggtatcatggagtgctcacaaacaagccacagtgtctcgctcaagtacagaatctgaatataaggctttagctaatgcaactgctgaaattatgtgggtacagtctgttttataggaacttggagtccaagcacccaaggcttcccgactatggtgtgataatcttggagcgacttatctatcgtcgaatccagtgtttcatgcaagaaccaagtacattgagatagattttcattttgtacgggaacgggtatctcaaagattgctagagattgcatttgttcctacgcaagatcaagtagcagatggtctgacaaaaccactgccgctgcaattgcttgaaaagttcagatacaatctagacctagaaaggttaagattgagggaggatgttagataatgtagtgtgcgtgtgtaatcttatcatgtaatcctgagttggtttggtgcggctgaggaggagtagttagctgtaactaatcattagttgttgtatcttatctagattacatctcctccttagtagcaactgaacttaacaaccttgtaatctcctagccggttgatggctctatttaacacgcacacgcggccctcacgagggtatcacgcttcctcattcattcactcgtttctacagatccatccctcgcacggccgcgcctcgagcccccctaccggccggatccgtcccccacgcagggccggtcctgggtttttttgggacccagggcaaaaacttatatggaggcccatatatatacataaactaatatatatatttatataatcatataaacacacaacatttaatattcgatgtgataaaattatctacatataatattttaaaacttcaaagagaaataaatagcggtagcgagcagagaaggcgatcggcggacgatcgacacgagcgtggctactggtgagccacgatttgctgacttgctgtttccgtttgtgagatgccgagaagtcgagaagtcaccgagagcgcaggagcagcgagcgacgtgacgtgatcgaggcggcacgacgcaagtggcgtgatgtgatcgaggtgaagcgacgggaatcatatgaagatcgcttcggcttcgctgaaataggtctcgatggactaaaattcattttctatattgggctatttagctctctaacttaatataaacctatggcccatgaactaaaattatacggtacgtagtatatatactatatgtttatatagagggcccctagattttggggcctcgggcggccgcacggcctgacccccctagggccggccctgcccccacgtgccgcatctacagctcccctaccggtcagatctgggagatgttgagggagaggtggagaagagagttggatccatcccctacatcgtcgccgcctgtgtccttccctacagcgcggctacccagtgctgccgccggagggagggaagggccgggttgccgtcgccactccctgcaacacggctgcccagttgtcatggccacgcgctggactggccgcgccaccgcctcccctgcgtgctgccgcctccctagccatgtcaccgctgccagcacgccgcctccaaagttgtcgagaaagagagagagaagagaggggttggatatggggagccgagaaaaaaaacagagagagctgaaaattttacttccgcgttgtatttaatctctcccgcgattttcgcaggcggtggcttcggtggccgccagcaagaatggatacatcttcgttagagagtttaatagtatagccaactacgggcttcaaattatttatgattcatctaataaactattcatataatagttaactataaaaatatactacaccattaatacccggtcctacctctgatacacacgtaatgtattgaagtccgtgttacagctggctacaaatctatagcccgctttcttttctctcttctcttttcttcttgatatgtggttatagctaatttatagtatgagcaggtacaatagcagactataagccagctataaacatattttaaagagataaaagaggagagaggagcagtgggctacagatctgtagccagctgcagcacggactccaagacgcaatgtgtgtatgacaggtagaaccatgtattaataatatagtaagcaactattgtatgaattgactattaaattggctatacatgatttagagatagtagttggctatactattaaacttgctcttagcggccctcttatcctggccgccagcaaatatccattttcgatggtggtccttagcccctcactcctcgttacattttcactggcggttatcgtgtatggccgtcagagaaaaaataggttgacgccatgaaaaattgattttgtagtagtggataagccttaagcccctaacgtaccccatcaaatgtgatcagagtcatttttgacggattgatttttcggaccatcacatataagtcattcataacgggctgtagtttaatcaagcagaggggtgcacctcatgtcctcatcgatgatgggatttcattaagacccatttaaggtaattgtcataggtgacggcttctcgcccaacatatgatttcatatcactaaaccacttatgtcaccaggccggatccggttcacctgcatgccctagtgtgactgcaagttaagcagtagatcatccaagatattattcatccaaaaaaagtctacattttttactgtagctcggatactgtagcgttaaatctgaacccttcataggaaaactagatggccaaaatctgaaccctatcttgtagttcctagtgtaactgtggccgagttccaaactatttcttcgaacttccaacttttccatcacatcaaaacatttctatacacaaatttccaacttttctgtcacatcgtttcaatttcagccaaacttataaatttggcatttgatcaaaatcccaccaggctttcctccaacacggatgagggttttcgcctgacagaaatgacctgcgccccactaggcgtgtttgtttcgtgcatgtttttgcaccaagaggataaaatatgcacttcttctgtgaggactttacatctgtcctggatttgtgttgatagatgggaaagtgatttcatctctcgaggagatatcctttcgttttgtgcatgccacctaaatagtcactaaaaatttgaaaaaaaattggtaagatagattaatatgaaacatatcactccacaagcatgcatgttaaaatttaacttctacaagttgtaacaaaaataacaaatatagatgcaaatatacgttaactattttcagtttaatttgtttttttaacttgtagaaatcgaatttggtcttgcatgttcgtggagtgatatatttcatattaatctattttgttaatttttttaaaaaaattttgataactactcctatttaaatggtatgcaaacaacgagaggatattcccgcgggataaaaatccatatccttgatagataaagaatcttcagactcgctatatataccactatcccctccctcgttttgtttatcatagacgattttatcgatgaacctgaaatagacatggcttgccacttgagattatttccctttactcaactactagtattggttctgtacaaaatcgccgccgtaggggcagatcctgcaaacgcagaactatccacaaagatcacccaacactctccattgtacaacccacagcctcaagactttccaaacgaggagctctaccgcaactatctagtcatccagcggttcaagaagacaatcacttccgaccccaagaacatcaccgccacctggaccggccatgacatctgcggcaacacgacctacctcggtttctactgtgcagcattgcctgggcgtactaagaagcccacggtcactgtggtgatctttaacggttatggcctgcgtgcaccgaagctggaaggatttattgaccatctccccgatcttgcacttttccatgctgcctccaacgacttcggtggtgacatcccctacctcacaggcctcgcctacaactacaagatcaatgtcgacagcaatctccaaatacaggatgattttagtcgtgacatggtcgggtcgcatgtaacaactaaagttcatggttattgcgttaatttagatctagatatcacatttcacctccggcccggaaaagacgacaagaaaggacgaagcatccccggtgccacagattctaaggcgctcctcctcaactacaatcacctgtccgggccattaccggtgaacatcggtttctccaagttaagctacctggccctcgccaacaacaggctcaccggcgcaatcccgccatcaatcttgcatttgcaagactccctcctcgaggtgctcctcctgaacaaccagctctccggctgcctcccccacgagctcggcatgctcaccaaggccgcagtgttcgacgccggcatgaaccagctcaccgggccgatcccctcctctttctcatgcctcaccagcgtcgagcagctcaacctgggcggcaaccgcctctacggagagatccccgacgcgctctgcaagctcgccgccgtcccagccggccgcctcgccaacctcacgctgtcgagcaactacttcacgtcggtcggaccggcgtgcttgtcgctgatcaaggacggcgtcctcaacgtcaggaacaactgcattccgggcttcgccaaccagcggcggccggcggagtgcgcgtcgttccacagccagccgaaggcgtgcccggcggcgagcgccacccacgtggcgtgccccgccggagctgccaacgctgcggcggcgccggcggacagggtggtcaaggactactccagctacgtgacgtacgccaccctgcacgagtgagcccggcgccacggcacgggcgcacgacgtgcgtgcatgcatgcagtaggggacagctagaagctagcgtctcggggtggtatttgctcttgtattcttgtgttcgtttgttgtgctcgtgagtcgtcattgtggtttgttttctctgcacgtgtggctagctatggctgtcacgtctagatctcacctcctgtactcttgtgtactgtactatgtgaaaatcattggtgattactaaagtttggtgtgtgccctgccctacatgtttgataaagtttacatcatgtaaagcgtatctttcaaaataacggccatatttagttgcacccaaaatacccccaaccttccaactttccattacatcacatccaaaactttcctatacacataaactcccaacttttttttccaaactataccaactttccccaaactttccccaaacttcaggaactaaacacagtcatggctatttcaacgctatttcatcatcaaacaacattttcgaaatggcgagccacgtcaaattgcggaccacccatctcctcgtcgcgctgctctgcttcgctgcagcaacggccgaaccatcagaagggacgagctcagcatcgtccagccccgcatagccgcaggacttctccagcgaccacgcgtaccacgtgatccagcgcttcaagcggtagtgcggcaccatcgatcacgtacgacccgaagaacgtgacagccacctgatcctgaatcggccatgacatacgcggtgtgcgtcgtcgctggcgataaggacaagaatggtgccagagacgggtagaggcgccggctcggtcgttctccagctacgtgacatgatatgccactccgcacgactgagatgccgcagctagcgatgggactttgcgtcacgccaccacggtggtgcgcttggctatttcgcccgtgttcgttcgtagggctcgtcgcggtgtaccactcgtgctgtcgtacgtgcatgctgggttgttggtgctcgatcggtgtccgttgtacgtggcagtgcgtatcgtgcatgtcagcatgtgcgttttctgttcgttgccgtgttcgcggggggattccgcctgcgaatctcatttggatgtacgctatgcggtagtacggtacgcccttgagtgaccaccaatgaagttgggatgcaccatgtgcccgtgaggtgttgatcgcttttcagttttttcaccatggcgtgccgtttagctagaaatgcaagtgtcggtgccaacgacctgtgcataagacaggctgcatcgagaatggtttttccacttgatgtgtacttcaatcctggatggtagagctttcactatgtgaaaacaggttgaatacaaatttcacaaaactatacatattttaaataagctattgtaaaactatgaataatacatcataaaactatagtttcgtacaaaactatcacggaactccaaatttatggcatagtatcccaaaactacagaagcaccgattttatcctgaaactgcatgttttgtaactctggtagagcattattaatgcttagaatttattctcttaatacaacttagttttgtaataacttcctcaggtagttttgagatacttcgagccaggttgtgttgaactgtccccagaggacatccaaatattcgatttgcaaaatgagtcccatttgctagggccaatgggatgatagagctggcccaaacgttgccaggttgtgttgaactgtccacccatttttttttaacgaatcggcgagccaccaatttcattggagggagactagtgcacggcattccgtccgaacgggataattaaatgacacctccacctccccgagcaagatatggataaggttcaaagatggactcagctagcctaacgtatcaatatgcatggctctcaaaaaaatctgcacgtaggaattaatggttggcccccacgtgcatctagcgcttctccttgagtttgtaggtcagaacatgcatgtgtataggtcagaacatgcatgtgtagtgcattatcaactattttattaccacgctgttctactagtactaactaggatgagacgatttctaatagatatcatatgatacttgcgagatatcaccggtgatacttatcaggaatcagacgattccaatcaggtttcgcgtgatttctaccaggtatcaggtaatacttacgaggtatcacctgataccggttaggtatcaggacatgatacttgaaagatatcaggacctgatatatgtttctatccaaacggtgatacttatcaggtatcagacgattccaatcaggtatcacgcgatttctaccgggtatcatataatacttgcgaggtatcaggacatgatacatatttccgtccaaatggtgatacttatcaggtatcagaaactggtatcatgactacctgatacatacttctgtccaaacggtgatactcatcaggtatcggatgattccaatcaggtaccacgcgatttctaccaagtatcaagtaatacttgagaggtatcacctgataccagttagatatcaagtcatgatacctaaaagatatcaagaactgatacatatttctgtccaaacgggatatggtcctgtacaattcccggagtgagaaaagcacaatttccaaagagacgaacgataaaaaaaatactattaaagtgtcatgttttctcagtgtgaacatgcacccataaatatactgatttgactagctttatcatattgtattgtcaccaactcagatactggtgtgacgtgcctgctcgtgtcacgtgcccacgagcactcatgagggttgcaggcctgcaacacactttggttagctgctcgtgtccacgtgtcgctggaggcatgattgtgcacgaaatcagattgacttatgtccatatcaaggaagtcatgaatacttcattaaactattccgttcggacggtatcccgtacagtagtttttctcatttcattgaatatatagaagggataaaatacaacaaaagctgtacaaccaagaacaccatacaagctcgggacctttggtccgagcacactaaagagttagccagatgccgagactttttgcgcctgccaaaccctaagttttggcctcctcttttatttttgccagcaagccaattgccgagagctctttgtgttggaaagttctacagttttttttattccatatctcccaggtcactagtagtgttagggtgcgcaaagccttcggaactccttttatgtatgtcgtgttctcccaccattcaagcactgtcggaacatgtcgcattcgagaggggtttagctggtcacataccgccactgatttcagtccggttcttatgcctgttttccgtccactcaaaaaaaaattagagaagggcaacctaatctaaaattcgctcacatagatatttgaactcaagattttggtgtgctattcaggtcactgcaatcactaggctacatgccctttcgcaaacctaccaaaaatatttaaaatgcattaatatgaatagaagaaataaatgacagatctaatagtattgcttagttacggaatactgattccaattgccacacagcttagaacatcttagaaaagaataggagtgcatcatgaaacatatcgtgtgaacataagtttttgatgtacacagatatcatctaaaataatctaaaaaagattgttcaagtattttcagtagtattacacctatgtgaaagcctcgtctccaaattcatcatgcaaagtgagaaaaatctatcatatttatactgttaaaactagattttttttaacagctaaagtataataaatttagttgagatttcatatatgtgcactaactattggaattacttacacaaaattttcttcttttttatacatttgttagttattgtatatatgtgtgcaccgaaaacttatgtgtacatgatacatcccattgtacaagtataaggctaaaatatgttaatacatggccataattgttacactactgtcgaacaccaaaatatactaaagttggaaatcccaacaagctatttcacatcttttcccaaagttatgcatttctatatgcgagcacccacattgaaaaaaataaaaataaacacgatacaactatcgagaattatgcattttagaatacaggagtgagtgggcgcgcgcggcgcgcgtttataggagcatatacttttttaagtattcgtataaaggaaaacgaaaaaagaatgacagaacctcttgtgtgattacctgctaaggtgtataggctgggcctgtaacatatataaaccattttttagaagcgtctcctgtacttcgtagtatagttcaaccagtattgacgtatccacgctccatgactgtgacgccgcagctacgtatacgatgggaccgtgcgccccgggctctttggcttcacattgcccgtgttcgtgggctcgtcgcggagtacgagcaccgcccccatgcatgttggattgctggtgctcgtcgtcgtccgttgtgcatgtcgtgtcgctgcgttaattcgtgcatctcaccatgtgcgttagggaccgtatgccgtggttgcttgtgatgcggggggttctcgcctggaaaatctcatttggatgtatcgctcgctacgcagtacgcccttggcatgatcattgatcaataaaagctgagatgcaccatgtgcccgtggcccgtgagtgctgatcgcttttttgaagttgtttttcaccaatgtgtagctagaacataagtgtcggtgccaactaacagtgtgcatcagacagcctgcatctagatttatttcagggaacaatacgccttcatatactgtgggacaatgatttttcggcttgtgatgaacacgcaactatgcaagacatctcaagatcgatgcaagctttttggggcatgtcaaaatagattggtgcagtgccggtcttttccggccataacctgaaatcaggccaacgaatgatcatgcctattggacttgggaaggttcacattgcagtaggaataagttcactttgactcccttaactaggtgacagaatctgattatccatgaaccacgacaccagatatctcgacccccaacttttaaaaccggtgcaatttgactccctcggtggtttttgagggcggttttgctgatgtgacgcctacgtggtagtattgacttggtcttcgtttcattggccttgacgtggcgcttaagtggtataagaattaaaatatatatgtgggacccaattatcattcaccaaaagtatgtgtgggacccactgacatgtggggcccacatattatgctctctcttcttcctcctcctctctctctctcttcccttcggcgagccgcgagcgtgggacaggggccagcagcggcaggagggcaggcgggcgagggccggatcccctttgcgagcttgcgacttcgagacaacggcgggaaagcggagacatcgtgacgtggcggagac

SEQ ID NO: 63888 - DNA, 7153 bp, Oryza sativa
ttacatattttcttaattcccatgtcaactttaaaaatatttatattttaaaacaaaagtactaattaggcacgttccatataatattatgccatgtttagatcccaactttttacttcaaacttccaacgttttcgtcacatcgaacttttctacacacacaaatgtcgtatttagttttaaagtttttcttcaaacttccaacttttccatcacatcaaaactttcctacatacataaacttctattttttccgtcacatcgttccaatttcaaccaaactttcaattttggcgtgaactaaacacagccaaactttcaacttttccattacatcattccaatttcttcaaacttccaattttggcgtggatctaaacacagcatcactcgtgtcgtccaaagtttgtcgaaccgaagaccgcaagttgatgttgatatgttctttctttgctactactccctccgtctcattttaagtgcaattgtagtttttcgtatccaacatttaatcgtctatcttgtttaaaaaaatctatgaattttttaaagaagtcacacataaaatactatttatgttttttatctaataacaataaaattattaatcatacaaatgtttcgaataagacagacgatcaaacgttagatatagaaacctgtaactacactaaaaagggacggagggagtagtatctttcctcatgctctggttggtgtaaaaaaaatgtatccgatccgttacaaaatataaccatttctttgcaacatactcccttcatctaaaaataaacaaatttaatatataattactttatcttaaaataaacaaaactagtacgggatcacatcgagctagtaagtagtagtaatatgtgtcaacgtttgatgtcgtgattccggtatttgcatagtatggggatcgttggtactaggatatgtgcgagactgaggtaaaagagatggggacgaggatttttatacaggttcgggcccctgaattgtcaggtaataaccctacatcctgttggccgaagccagtattgatcttattcaccataatcacaccagtacaatatttggggtagcctatctaactgttgtcgacatggcggtctgaaggtctgactcgtagtcgacgacagagtactcttcctcctcgaatctgtgcccgatgagatcagagacaacgctatgtctctcctgacagtatccggagacaccgtaggggactagccgtgcctatctttgaagttgatatctggcgtcttgccttggcgtatgttggcttgtatgttgatcttgtgtcttgatctattgttccgtgttgtccgtatcccctctcctcctagggggtcttgtatttatacctataggtgtccccttgtccaagtagaactaggaaaaccaatatggatacaatccgagtagtccttgtcgttttcatgtagaattctggttgtctttcttatccggaactcctcctatatctgtaggttgtttccgtataggacatagtatgtggtaggtcctgccgagatttagtcaactactattagatatgtggtatccataacctgacaatataattggttgaaggttcacttagatggtgctgtcgagttgatgatcacagcagccaaacactaagctctttcgccttataagatcgttaacaatagttttagaatgtgttattgtttatataacatttttcacgtgagaaacacctagaaatcttttggctagcttcacaagatagtgggctagacaatctggattcgaagcctcaccccttctaattatttgatattaggtcattttctaatatttgcgtttttttaacattttcacgtcatatctcaagttctcaacaacgaataaacaactcacataaacagatggtttatttagttatctcaaatatattcgtgtggtcaatgatttgattccacagatagttttatatatgacattaagttatccattaatcaacggactgcagtattctttcttttttctgctttctctgtatcttcaaaattcctatatgggcattctctctcaaatactggtgttacatcattgtttattctctaacctgtttgaattccttggattaagttactggctttctctgtatccttaaataaaaaacgaatcatatttgtccggttaactaaagtttttactcttgtcttgatcgttgagctatcaaaatgttaattattcgcccctctgattttaaaaatttgcacatttcacatctcttggttcaacttcaaacagaaatggttttaacaaaaaaagtgatgtcgtcactataccatcaataataaaacatgaacaagataaagaaaatattacagcaatttatataagacacatgttctttggtccaagttgcataaataagggatattttgttacttggtatgttttttttatagataatggaatttgttacttggtacgtaaccacaacaattatggcaaacaggtgcttaacaaaaccgcatcactaacaaatttagttatagttttgcacattgaacagtatcaactcgcaagaggaccgaaactggccgattccttttttttatattaaactggcaaattcctgactttttagtttttaggttttttttccttgaaggagatttaattcttgagaattttagctaaggccagcatatcaaagtacacagtttcaatgggctcacggtgggcctattttattcttcgcgcgggcctacgtggcagcgcgtacggcccaatatgcaaaatgcacattcctccattgaccggcccaacacggacgcagcacttaattaattctcgatcggcctctcacgttctgccctgatcgagtatgtgtacagatataaatctattaatttttagatgaaatatgtatgaatgaattagtgcgtattaactatcagtagaaaattatattaaccagttttgactgttcgtaattaagcaccgcaaaaactactggcctgtctctcaaattgtgattccacttcaaagacttactagttgagcggttgaattaagatcccttctggtatttttcttaagagatggtttaatttgggtatcaattctggacttgcctagtatcgaatgtgaggaaatgacccatttgagtgttgtatcaattgtcaagtgcattatttcgctttcgcttatgccatatattagggtccacctggggtctctagggtctcgagtctccactccccatattgtaatcatgggagaccccatgaagatcccactaaaattttctgtcatacgtttattagaagagggggctataattttgtatagtttgtttagaccctcctgttaatctttcctggatccgcctctgggtatgttgggtatgaaggaacttcaaatgaaaatcaaaggatctgaaacccacttattttttttttacatataggactgcttgaaatggaggaatggacccaagaatcctttggaaaactttcctaggcttctctagtctattatttttctagtaaaaatgaatggaaaagaaaaaggagctcaaatctaagggaaaattttcccatggaaaagaaaaggtaatagatgaggttagcttgacctaaaaagaaatctagctaatatctaataccttgttagtttaagcaaagtctaaaattcttgtattgcaaacatccactatatataaagttttgtgtttttcctaattcttcagttttattacatgtgcatttttatgttttcttttcctacatttttatttctctgttttgttttcctcaatctaaacaaggccttatgtttgcttcgtcctctgaataccacccattttctagagtctatgaacctgggcacctgttaaataaataaaaagtaatatgatatgtattaataaaaacgaaatgcatttatgccagtcaccttaaaatcaagaaaaattcagttgatttaaccaccatttgatcctcgtcaagattatggttcagagtaggcagtgcgagaatgggggcaatactgcaagaattaatggccaagctcatgtggtattttttttaaggggtttgcaggttttaaatgattcatggttgcggttgtgtggtagcttgatttgtgggtgacacaagcggcccaggagacactgagacaacggtgatgtagcgcctagcttggccgtaggctcggttggtgttggagcaaggatggcaagcggtcaagaggtcatagtggatctagcaatgtaaacctccggtcagagatgaccagaggaatctaggtaaggttctgtttgggagatttttttttttttggctgcggtagcttctcttagaaactcgagctctcacaattctcacctagattcttataatcggtagtgaattatataattcagaaaataaactagcagttaaaagttaaaaaatccagcctctccaaattctcaaaagctgactaccagcaaactatttcttagaattttaatctatccaaacagatcctaaaatagcaccatagcactatgacaaagaggaggacataggaggatatagtggtggagacatagagaaagggaggcagggagaaagggcagatagaggaaggcaggaaacattgcgaggcatgcactagcgtgggatgttgagggagggaattgtcgaagagaaatacgcttgattagattatcaacgtgaatcttggtataatctagaccataaaaacatctttacacttataattttagcctgcagataattagccatcgatctccagtgtctagtgaaggatgcatgcatgtgagtccatacattcatttaatgtattatgctagaacgatatctatgtactgcctccgtctcattataagtgcaacataagattccgtgcccaaccttaattgttcgtcttatttgaaaattttttataattagtatttttatttttatgagatgacaaaacattagtagtactttatgcgtgacttatgtttttaaatttttttaaaaaaattttaaataagacggacgatcaaaattaaacacggtaaatcatggttgcacttaaaatgggacagagggagtaataactagatctgtatgggattgatcaacaggttatgggcattacaacatgccatcatatagtccattttactgggctgctggcagtagacaaaaaatgagtcaaagcgctggatcgatcctatagctatcacctcctataaatcaaaattcaactaattaatgagtatatctcttgcatcttcgaaaggtaattataagcatatttgcacgccctcctcatctatttgggttcactgattggtttagttattcaattgtcaggacagagctacaattattttggatacgcacctttcagagaaatgcttatggtcttccagctaacttcacaaggtgatgggctagacgacctgggttcgaagcctcaccacttctaattatttaatattaggttcttccctaatatttatgttttttaatacgcattttttacatacaagcagctagcttgtggtcgatcaatattttacgcacgaaattaaaccatggttatcttttccaccgcatattcagtagtggagattccaacagattataactataagtttatgcaactatcttttatctaaaataattaaaacttgacttctacatctaacatagattttttttaaagcgccgactactgtaaaatatatagtagtagaatagatgttgattcccacacaaaattaaagtaacttctaaaacatactatatattggggatcttacaagcacaacaatagaaaaaaaatatagacacatatatgttcgagcagctgatcacaaccctgtagaattattctggctaatcgagagctatatatatggaccaggttagctcataggtttaacttaattaaacagtttatttacatctaccaatgcatcgtttggtgtgtgataaacaagagacaaccttaatcttctaggggttgtttgtttcactacttcactttaccaagccacgccttactcatgtcacagttgtaagttatgtgtttattttgcagctacaattaggtttgccacgcttttttattctttggatccacgagtcattcatttatctttttaaattaccccacacttgtaaccgtagccacacttttatatcatgtcacactttacctacggttagctgtgacaaaattaattcactaaccaaacagccaatgttttaaaaaaaaaacaaacagacaatctgcgtcaggatgcatgcatgcgatcgatggcttacctttgctcatgatcagacgacgtacgacaagatcgatgcaaaataatgagaaaattatgtggagctagtactgtatatccgttgatgcgatagacgtgatagctgacgcgattgcacgagttagggccactctcctctccctcgtggggttcagctgcaatagtgtgcggataaatgcatgcaccgttgctcgatgcaaaaggatctagtgatctcatattatcccaatccaataggggtgtaaagtttcagtgtgtcacatcagatattatatatggtatcgtatggggtgttcggacactaataaaaaaataattacataatccatcagtaaaccgcgagacgaatttattaagcataattaatcggtaattagtaaatattactgtagcaccacattgtcaaatcatggagcaattaattaagcttaaaagatttgtctcgcaaattagtcgcaatttgtgtaattagttatttttttagcctatatttaatactttatgtaagtgttcacacgttcaatgtgacatggtgaaaaattttagggtgggatctaaacaaggccatatagatgatataactggccgctgtgtatttctgcgaagtattaaagtataaatgtcacaactttatataactatgtaggagtaatatttagtcgtaaatttgattgattgaaattaataaggtacataatccaattagtgataaaatgattccggcagtctaggaatattaggtgatcataattaatctgaagtatcaaagcatgcaccatcccaattagctaggttgaagaattcgtgatgatgatgtagccactagtgtgt

SEQ ID NO: 63889 - DNA, 44858 bp, Oryza sativa
ggccgactgcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatacaaaagagaggccaccaccttcccaaagagacaacaattgatgttaggcacctgcaaaaaacccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcaagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattctcgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggtcgcaggcaccgaagaccgcattcgtcgaggccacagcccgccgccggcaccacagagctgaccacgagccgctgatcggtgcaccgccagccgggaccagctacggtgcacaagctgtcgaggccaaagcctccaccgccggccgtaggggggtgggtgggtgggggagactaggcccgccgccggacgccatcgtaacctccgccaccgtggcctccgccgctagccttcgccaccgctacctctgctgccagtcaccaccgcgtcttccgtgcgcgccgacctcctgcgccggctgccgccagccgccgagtcgccatacgccgccacctccgcctcacattgtcaccgcacgggagcggctcgctctagccagatccggcgtggaggcgtcggatccacccacgaggaagccagatccggccgcggctgcgtcggatgcgctgcctccaccccacgtcatcggactctccttcgcgcgccggcccgccttccacgcacagagacggggcgccatcgagtcttggcctcgccgccgccatcccggctggccgcacggaactctggtagcacactctggtggcggcgaggggagagagaggaggagaaagtggcggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtccctccaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctcctcctcttcccttccccttccacagtggcttggtgctgcgatggttgcggcgacggctcgttgttgcgggacatggcgagctcccccctcccctcccctcccctccccttcctctccctctccctctcccagatctagccggaggggagggggtggcggcgaccacggcggtaacggaaggcaggcggtggtggatctgacaacggggtcggcggcatgagagcaaccgcgacgacgacgaccgtgaccgcggcgacgacgacgacgatgctgcgcgccggccgggagcacggctctagcggcttcttccctcccctccttctccctttcccagaggagaggtggaagcggtggccgtagcggcgacgacaggtgggcggcggcggcggatctgaccgcggcggccataattattagaaccggaccggaccggcggtccggccaggaaaaaccggaaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaggacggtatagatcaaacggctcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatggactttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaggcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcctgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcttaggtccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtccttcttcgccgccggccgccgtagctcgccgtcgtcggtaaggtccaagccgccgccgcctcctctcgtcgccggccgtcgtcggacgtcgattgtcgttgtggtgagtaccgttgggttcgcctcgtcgtcctctacgtgtgcatgccctccaaatccgcagccggccgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgctctcccccccccacatctcccgcgcgcgcgcgcccgcaagtggtgggggatttgaatccctctctctctctctcttcctccccactcccccacatcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccacgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtcgtcgccgccgttttcttccttcgcgccggccgccgtgttcgccggtgaggaatcccctctcctcctccttccttccctccctcccatgagcgccgccgccctccgcgcgtgtgccgtcatcttcggccgccgccgccgccttcgcactggccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcggcgccgcccccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttcccatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagataatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccggctggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgaaccgatgccgagaagcaggagaagtttatgtctggtcttgatgatgaattgaccaaccagttgatctctagagactatgaggactttgagaagcttgtggacaaggctattcgtcaagaggagcagtgtaacaaaatgaaccgtaagaggaaggcagcccagttcaggactccccaggggaagtgtcagaagcctcgttacacgatgggacgtcacggtggaccttccaccatgattatccgacagcaccgtccctaccacccgggtagcttcaataagacccaccatagtgatagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccaaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttggtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagaactcaaagaaaagttctggtgggtcagcatgagaagggaaatagctgaattcgtagcactctgtgacgtctgtcaacgagtaaaggcagaacaccaaaggccagcaggattgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcaaatcaaaatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctatccttcgggcgccgacaggtggggcccacctgtcggtcgtcttcctcctctagccggttggagccgagccccaaccgccggcgccccacctccccacgccgaccgccttttccgtccctctccgcgcccgcacctcgcgcccacgtcgccgctctcccccccccacatatcccgcgcgcgcgcgcccgcaagtggtgggggatttgaatccctctctctctctctcttcctccccactcccccacatcgccggccaaatcggccacctccccgggcacgtccgccccctcccgcacctataaatcgctccccgcgtcttcctctctcgtttttcgcactcgccgcgccctcccgtgcttcctattgtcgccgcgccgctcgccccttgcgccgccgcctaccgccgtctccggccacgcgccgccgccactatagccaccgccgcgccacgcagtcgccgctgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtc

SEQ ID NO: 63890 - DNA, 8008 bp, Oryza sativa
tacgacaaagcccgattgagatagattaatctctatcggccgtaaactaaggcccgtcaccgattactcattttccatctttcatttgttgtgagtgcaaaatatatagcagctgtgtaataattcattttattagtcataatacattttcggatagtaaaagatttcaaatggaaatattgtcaacaacaaagttgtagagcctttcaagatctaatatttttattttggtcattattatatataatttttttcccaacagcttgaaattgatttcgacaatgtgacaaatctaattaacagcatttgtaaatactaaatgatttcaaattgaaatatggtcaacaacaaagttgatcctctcatcacgatctacaacttttattttggtcatttgtaataaaacaaaattagccatattaatgactacatatatcaagtctttgcaataaaacaaaatacttcattcattacaatagataagtacaaatgcatcagtcacaaggttatgccttcggtataatctgaacgagcatatgccacaggctcttggggatcatcgtcaaggtcaatgtgaggtcttacatgaagattatggttgtattcttcttcatcgacgacgttgtcaactcatacaattcggcgctttccatccctcacaatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctagaatgcatctatacggacgccgctgttttgcactgtgcttttgtcatcttgtttgacagtgtaaaatgtgtatccatttatatcgtatccttgccatgtgtctatggtccaagacggtcccatccccaacaactgtactgtctcatttgggacatccgtggacattgtcacacgattcttgaaccattcgttgaaccgagaattatgttctctgttaatccatgcatcagatcgccccaagttctcatctcggattttcgctaagtgctcctcaaagtatgggccaacttctaccatatgttggagcacagcgtaatgagcctgcgcgtacgacgcttgatcgggcctaattcttttccttccgattgtgccaacacctgacaaccttccctcatgacgagacgctggaactccgataggatcggcatcggacatgtaattgacatagaactcaatagcctcctcggtcgtgtaaccttcaatgatgctcccctcgggtttagctctgttacgaacgtacgacttcagaactcccatgtacctttcaaacggccacatttcccttagaaaagccgggccacatagttttgtttgcttcaccagatgaacagggagatgaactattatatcaaagaaagacagtgggaaaaacatctccaggtgacagagggtattcacaatatcggtctgcagcctatctagatcttctggatctataaccttctgtccaattgcattgaagaaggcgcacagacgttggattgtgtgacgcactttcggtggtagaatgcttctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggagttacactttacctgtctctgcatctcgtatgggctggagttcgctgcgaatattcatgtcctgtagatcaaggcgtgcgttcaacccgtcctttgtcttcccgggaatattcaacatcaggccaaccaaactctcacacacattcttttctatatgcatgagatcaatgcaatgacggacatcaagatctttccagtaaggtagccgccaaaatatggatttttttcttccacatacccttctcctttgtcttgttacgttttcttttcttcccaaactcattgcttatgtccttgaccatattgtggacctcatctccggacaaatctttgggagtaggctgaagttctctcttaccattaaaaattttcttctttcttctaaatgtgtgacgtagcgggagccacctccggtgacccatgtataccatctttcgtgatttcttcagccaccggcttcgtgtatgttccttgcaatcggagcatgtcttctttccttttatagtttgtccggaaaaattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggtgggaggttatagttcgcaataagaactggctaagtgctgtgagtactactcatgtcaccgaaaggattcatgccatccgtacaaagacatatcctcatgtttctagggtcggcagcaaagtctttgtgttttcgatctatattcctccattcaatcgaatccgctaggtgtctaagcataccatcattccttctttccgtggcatgccaacgtactaacttcgcttcgttcaggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggacctctaaccccagtggacacagaacctgctttgcttcgtatgtcatctcgggcaatgtgttctcaacaggaagcatagccttcaaaattcctaaaagatctgtgaaattcttgtctgtccatccactacttgccttcagcttcattaggtccaaggtaactgacaacttagtgtgttttgctttgcatccagcatacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatgtcatgctcattttcatcttcctgattatgcgcatcacttctgtctgctgctgctccacttcctgattcttgctctccatgcttcacccaacatgtatagtcctccatgaatccttgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaatttctacaaaaaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtgggggtatttatactgtgcaacaaatatctgtaacggccctaaaacaatcaaccgtgacaggcatacaagtaatctctatcgggccttaataaaaggccgtcaaaaaagagtgtcatctatgacgggcaataaacttatctcaatcaggcctctagttggagcccgtcacagatgaccctcatctgtgacgggcttcttttagggcccgattgagatatggaacccttatctcaatcgggcctcaactatagcccgtaacagataagtgtcatccatgacgggctttagttttatgccgatataccatggctgtgcgaccatatctcaatcgggcgaaacttcggcccgattgagattacttccttgtgacggcccgcaaattctagtcttgttatgggccgtcacagatggaaggatctgtactagtgcctgttgcaacacacgggtattttgcattggattggatcatattaaaagaaagtgctcatataagttaacatacttttgcaaccaatagtgttaaaatattcctatacgtgcaaaagttatattcgacaagcgagttttaaccgctttcttgtgtgtactacaacccatgtaaaatataagttcgcaaccaatggtgtcagaactatcaagcacatatgcacaagagtggtattagaggggtttcaaaagattttgtacatacaatatgattttttggaaaaagtacaattaccttcgaaccataaaactggatattttggaacctatactatttataccggacgaataacttgtgacacccagagcccaaaaatgaccctatactatttaaaccggacattttgcactctaacctatgacaccccggcccgaaaacggtattgggtccatcttattagttggaccacaccttttataacatgtgacacccagggcctaaaaatgatattggatatttagcgcgctatagtgttcacggctgctagcgctgcttctagctagcttgctgagctgcacgcatgggccaagggccaaggcctgctgctgcttttgccctttttttccctccttttcttttctcaattatttgctgggatgttacataactcccccccaccccccatcattgctttgagcagttttgataaaaaaacttacatatgtgacgtcaacttggcaatccagttaggaaaaacaacaataatgaatttgtagggtccacttgtcatctcttttctcctctctccctctttcctctcccctctctctccctccctctccagcggtttgttgggagcaacggcggcgatgatcggctggaggaggcagggttccagatgagggcagcggccagccagggacaaggctaggaatggggaagttggctggtggcggaggcgttctgggcagtggcggaggatttccggggtggcagctagtgcgacggtcgacggcaggaccacgggcgacgatgcaggtgcctggtggaggacgggctcttgatagaggatgaggcagggcggaagtggatgggctctgtgatgtccatcttctcctgctgacgttctctagctacgcttatgccaccgtcgctatggacgccaagcttgccgcgctcttcccaacaaatcggccacatcacagtggaaagaggcggcggcggcagtgaaagagggatggatccagcttgctcggcgataaggagggggaggggaggaagggagcggtcgagcgcccttcgacgatggtgttgttgtgccggtggctggtggcgaaggcgttttgggcaacggctgaggatttctagggcagcagctaatacggtggccagcggcaggaccacgggagaagcaacaggtgcctggtggcggtgcaagtatatctagctgtagcttgtagacaaaggatgaggagagagcagcttacatgtggggcccactagcttcatataggagggatgatgaggtggaggctgacatgtggggccggtgccacgtgtgcggccacatggactaaatccgctccggattgtgctaggggggttatccatcagatctaaatagttcagggtttaaactaaatgtccggttttgtgctttaaggggtaattcggtcggccgcgatagttcaggaggtaattcaaactttttcctaaatttttcttgtatgcggaaaaaatgacattagaggagtttcaaccatttccttaatgtacgtaactcactaattattaatttcaaatttcaaagtcagattaacagaatgttaaattgagtatgatatgatacaactccatatttataaatttaaaaatttaaattattatatctctgaaaaaaattataaataagtcaatgatgcctcccttagtatgttttatttcgctaaattttacgcataatacctaatttcacaaaggatagctataccgcctaacactcagactctgctcacccatcggcttccaccattgctgcagagtgtgtgcgtcctcgtccttgctagtgctcttccacagcctcgccgatggtagaaggtgcggttgctccttctccattccgaacatggaaaagaacatgtcgcggtacgacaacgtcattgctgacgtagcgactgcacggaagcgctcctgcacctgctgccgttgctcgaagtagtcgatgtaacccttgcaaatgacatccctctcgtgcacgtatagttccggtgcccatggtgatagccgcttgaagaggttctccatgcgctccttgtggggattcaagaccttgcccaaccctgccttcacgaaatagctcacggcatatatgtccctctttgccttttgtgccttctctatcggtagcagcacatcgatcgctggagtcggtgacacttgtggcggattgaaaaggaaggtcgggaggttgtagccttgctccaccatcatggcacgccccacattcagcgcaagggaagcaccaagcgagtgtcccgcgagccaaacaatgcagctacctgcagtgccatgggcacaggcgcctcccatgcccttgtctatggtagcaacaagctttttaaccgcggtgtttgctaggcgggatcgcttggactctttgagggtgttcaccatgatcttggcgtcgaggtacagatcaatgagcgccttggggtgtgacatcatggtgccacgaaaggcgaccacatagtgagcagacagaggatgagcgggctcgccaagaggtggcacatgctcgtatattgcgccaataatggtcatcatgatcggagtcatctcgaataacatcgaggaggttaaacccgagagttctcccaccacgggtggcgcaagcgcattggtgtgcaccctgcgcctagtactgtcattctctatgatgtagacacctttgacaaggcaggcagcgacgcaacggcggtgctcctccttgcccctgcgagtacatatgcatggtcgatatacacatcaatttatatagaatcaattgtactttgcaccggataaaatgtatcttgtttcacttttgacgggtttagtgcatacttttactttgcatcagagagtatagtaaaataaattttagttttactagtttgtgttatataactggaaaatcttgtaaaatcacgagtgaaacttacaatattttttttgaatttataccacttttcacaaagtttcatcgtatttgatgatttatatcctggtgcaaagtaaaacttatttgaaggtaatctggtgtaaactgaaagtatatgctaaatttgatgtaaagtgaaactaggtgcgctttatctggtgcatgcaaagtaaaatttacacacctatatatgttttatgtttcacgatgatatccactattattgttttgctatcagcatttttacaaataaaagtgatctatgtggtagtcccttggtttaatattatatatgtagttttgactttttcctaagtcaactttttataggtttaactttaacagaaaaaaatcaaaacatctatgtaatataaatagttcatcagataagaaaagctaagaagtctaggttgct

SEQ ID NO: 63891 - DNA, 8195 bp, Oryza sativa
  unsure (1)..(8195): unsure at all n locations
aaataatcgtgtgagccaaaacacggcaagtataatgcagtttaaaatcaaaatcaacaagatttgtaacgccacaaaatcatgtatagcgcagataaaagcctgaattgaaatggacaattatatacccaatttggaggggcttctacaaatgcaagtaaacaacatacggacgccaaataagtcaaactgaaaatgctggtgagtactgttttttaataatttgaacaacctaatcgatgagtttgaaaagaaaaagggacagtcctgccaataacatgatttccatcatcacaaaatatttgttcagtgcattatagaataaaataggataggtggctaacgccaaactgaaaaatgctggtgtttagttgtgttctgctgctcttttatataatatgagcaacctaatcaaataagttaaaaagaaaaaaaaggactgtcctgccaattctatgatttccatcacaatctacggaaagatgatgtttgtttcttttgtgattgggagttggaatagaagtttgttagtgatgttgaatacatgttagaacaaaattagtaacctgcaaattgagctaaacatgctgacaaatcttatttgcagtagtggagtgctgagaaacagaaaagagcagacatgttcaagttggtcatctcatattgcacatcagaattgctagacaggtagtagagcaggacagactgataagagaaatactgtgatacatttcatacttatcctaaagacagatacggtgcatgcacaaaatgcaactgagtatctttggctgactttggcttttattacaattattacattgcatggttgttcaacgtatgacagatagatgaataaagattattgaaactatatggaagacatatatagtggttcaacctgtttcagatagatggatgaagactaaacatacaaagcaatacatatatatggaaatggttggtgagtacaaatgctatacaatgtacagttacttgttgctaataatggaaatatggagagtactaaatctagattaatatcattgattgaataaattttacttttgctaataataggaacagggagagtaattaataccttgattgaaaattttttgtttggccggataaacataacaagaccatatagacacctccatccaaatcaaatcatatccgagggattaccaagaacagtcaaaactgagcatatataattatatatgaatatacaccaaacaattatatctaaatcgtgagtttctcatggattatcacgaataaacatattatcagggaatatctcatggatcaccgcgaacaaacgcattatcatggaagatctcacggatcaccacgaataaacacacaatcaggtaaaatctcatggatcaccatgaacaaaaaaaacatcatcaggtaaaatcaaagcacacatctcttgggttaccacgaactacacacacatcaggtgacgatggacgagcaatcaccacgaattatcaatcgtctcagcaaacgatcaaaatagttatagggttttagagagggtcaagaacctagggctgggtttgcgtagtatatttaaagaaagaaaatgaatgtaaattcgttgttttagatttgttttttgtttaataattttgggtttattatatattcgagtagtaacgagtaggcgtggtatatttatagaaggaaaatgagtagaagttcgtatgattggaaatggaagatagttttggaagcctctagaatccatatgtgatatttttttctctagatttttcctcacatatgattattagatattttttctctactataaatttatgatttttcttcaaagtaagaggcaccatgtgggccaattgaaagctagtaaaagagccagctgtagatgattagattgtcttataactggtcgatgaaccccctacgctcctcctaccttcattttaggcaatctactgctccctccgggttgataatattagtcgtttcggacaagggtaaagtcaaactttaaaatctttgactaccaaataatttgtaaaaatattttatctttataaaaatattgggggagnanaaacccaactttaaaatgtgggattagtcttaaaaagtacttcaacaaaatcatatatttattggatntatatnatatatatatatatatatatatatatatatataatgaaaatagttatcaaagctactttttggagaccttgctcttgtccaaaatgacaagtattatgatattatcaacctaaagggagtagaaaataagcgcgctagttggtgcgctcgatttatatcccatttatattatctttgtgttattaattagcacattgttcattaaaaaattatagaaatcaatttaatttccttgaaactcatacaaaaatcgtcaaattataataacagatcatattgttgagaaaatcgtcaaattttctcctttttttcaatccatactattaatttctttctttgtttttctaaaattataattaaattgtttactaatgataaaattggttttgttatcttttttaaaaaatatatgaagtgtttcagatttttgttttgttaggggccacaatgttcatcatttctttttatgacataacaatgctaagttaggtttaaatcataaacattgtatacgtgtttatattgatggctaattagtgataggtgagatatacgttgatgatgagttgcatgtgatgatttcgccgattttagaagaaaaagaagtcaattttaattcctgaactatttcaccatagcagttaacctcctaaattgtttttttttctcattttacaaacccgaactatcgaaaacatctcactttactctcctaacactatttctcttttttttatttctctatattgtaagtcatattttgcactctaatttggtataatatagatgcatttacaacataagtctcaacattgcttttaatttttttctcaccgtttatgtaggctaaaagtacataggactgatttaaacatcaaaatttaatgttcaagcaaacaaccacattttgaaaaatatttttgaactttgataatattctaatgtatgactctaacaaatttcagcttaaagtaagaaaactaaaaaatattgttaaggagtaaagtgaaccatcgttaacagtttaggaggtaacatgagcttaaaaaaatagattttttaatagtgtccattgatttagttcgaagaagtaaaatagttttttttcattttcagatatgctaactcaatttttcaaagatgctgagatatgtacgaaagtgagtagttgtatatgcaattatgcattcaacatttttttttgcaaatatactatacaatactaatgtactacctcagaacttatacatgtagagcatgtggactccattgacatataggcgtttgttgcttgcctgatcgatccttccagcatagccttttatctgcacggaaggactagcctgccacaaccatgttcttccctcgtactcttagaacgcacaactgctcaactcttggtattttttttttcttttggtgctcttcggccggatatatctgccgtgtgagagaggacacgtggacagatcactgctggcagaagcagccagcattagggcagtcccaatccatggtgtccataagtaatatctatgatgccatgtcaataagacttcacagtagaaactacactctacaacccatggtttcttaaagtgggtcattaataaatacatcatctctcttctctaccaatcatatttattcttcatctattatgaagatactattctctcccaatgtaaaacttgatagtgtctaatgcataggttctcgtgttgaagctgtgtcttacatgagacccagtttcttcctctcttcactctctctcttatttaatatagtgccacataaggtaaaagtcctacatggcaatgtagttaatactatagacaccatcctaggtggagagttgtgactgcccttagaaataaacactaaaaatgagcgtgttggcatgcttgctaagttagtttatagcccgcgtgtatttccctttagaaatcatatattcaaaaggattattgaaagtccttttttctatttttatgtttgtaaacaattaaagtagaatggtaaaatcatcctgattagtagtattatcatgctgaacaaatattgagaaatgacaaaatatgatatatattagtaaaaaaatcatgttttattaatattcaacacaattctcatatatatgtaagtcattgagtttgtattagtaggaaatacatatctaaaataaatgtgtcttcgactaccaatttcttcatactagttttatttagaaataatggatgacgatatggtaaaaacacttatcttgatttcatatatcaagatatattaatatgcatagctcaactggttagattctctacctatacgagttcaagttctaaacttagcatagatacttgcatttacggctatttgtttttttaatggtaggaaacccatgagtcttcatcaatcccaagatatgcctgacggctcagcatttggaggtgctcgtaatgattgggtttgtatgtgtgagtttacaagtgtgagtatacacggtatatgaacgtctatatctatactatatttcacaataaaaataatatagcacacgattggtgttacttaccgatgttccaaaataaatgaattcctagcataaaaaagtaaaatttgaggagaaaaaaaaccgaaatgctccaaattaattggaaagtagttgtaaacttatcggttcacaagaaaatttcacttctattctttccattatatagaaattcaggtattttcctcgtttgaagtgaaccttatctgaagatttttaattgtcctaacgcaaatccttgctgccactttttttttcatttgatttaactatttatttattttattcccttgaaacacatgatattaacatgaagtgactttccctcattccgagtaacatgtagtaaattacatttgttagtaaaatattattatggaaaggctaaaatcctattatttttatccttttctttttattcatactattttcttgtaaactggctctgtatatgcgcagcagcgcaggtacatagcggagaaaagccgtgcggcaccaggcccaagctcgcatggccttgcatctgcgcccttgcgagatgccaagcccaccctgcaagcacatgcaggtaaacgtttttccgatctctcgagaagtggcacgtggcaatttttttggagggatataaccaaatttataggaagctacgtggcccaatgagaagccagatccctgaccctgttttggtattaaagatttcctttgtgccttggttctgatccatgttagggtccggttctaatttttatgtttccaaaaccagaccgcggcacaagatatatagggtccaatccgttgtccggatgggaacaggtaagcgagtgaaacaataatcaacggatgccactagaaccatttaagtaggatgtgagagttcttctatttcttataaaatcttagctcatgttggagcctttgcagtttgcatgagctatatatggattgttcagaaattacatggcaagtccacatgaagaatatttttgggtgaagtgtacaagcggtttctaaacttgtgtcgatgtatcatctagattcttaaactttaaaaatacatttttaggttcttgaactttttatgggtgtcatataggtccaaatgcggactccaactcgcttcatgagctgacgtggtatgccacgtttgcgtttacgtgttagaaagatgccatgtcagtgcttacatgtggatctacatgttagtcatatagaaaaaataaattttaaaaagagacgagggagagaggggagaaaaaaaatatgtttttaattaaaaataaataaataaataaagatgggagaaaaaaaatgttcttatatttttctgtatgtaactgacatatgagttccactgacatatagggaccatcatatgaatatattttaagtgcttaaagaattatacgatgtatagaaactttatatatatatatatatatatatatatatatatatatatatatatatatataggatgactattttgtactcccgggagtacatactccctctcccatattggatcatccaataggatctgtagggacctcttgagccgtatgaaagagaaaaaaaaagttaaattcctatttttcagctgaacagtgaatttgccaagttgaaaaatatttaaattcaaaaaatatccacgcatgaaggcatttgatcgactccatctacaaatttgaaatagtagtatatgtgcatatactattttatttttttaatccagtatataccgattcatggttggtggactatataccatttttcttggaaatcagtatgtactgatccctgattggaagtatatacttgtttttccaggaaccggtatatactgatcccaatttgaaagagtatatactttttttattgaagaaccagtatatagaatgctagatggagaagtgtgtacttcttaattttaggattcagggtatactaatgctggttgaggagcacttattttacagtgtcaattagaaatttatggaacaggtaaatctcaactcatatactattttttccatttttaagtgcatgctatattcctcttgtggagtaccatatcagtatatactattttaatttttaagttattatcagtatatactgttttaatttttaagttattaagtttgttagacgtatatactgtttttctagttataagtagtatagatggtataccccttttagtttttagcagcatatactattttttcaagttattaagttttttagtttttagcagtatatactattttttaagttattaaggttgtagcagtatatactttttaagttagtaagtagtatatacttttttaagttatttagtggcagtatatatatacaagatgttttgttgtttttacactgtagcagcaaacacactactgcagctgcgtgcacgttcgatgatccatacgtatctgagttttcacaaaatacgaaaaggcaagatgtatttccaaaagaagaacaatctgactgacgcaaattaaagaagaactagtctgaatgacatgagaatatgaagaaaaagaagtgcttaaatgagctgttataatttagactcagattgaagcgtatgctgattaaaaataatgtaccaacgagaatcacaaagatctgtttcctgagaaatattccggattctcaatctactgctacagaaagattgactatcaacaaggcaacgacaatttctgaacaaagccattttctcattgcgccgtggtgttactctccgccgtccaccacctgcatgcaacaaataaattgagggcttagtcattgaactggttaattcattggaaataatgcatctatgaccccatctaccatcctaaaacataaataaacacgaacaatggaagaaaacgctcgatcagcaagaagaaaactcaaaataggaaggattacacagttgtctgggaatagatacgatcaatggatcaacacctcacctgggaaaatattgccgaacgccggcacgggcctctgctgacatctcgacaccgttgacgcacggccatgcgcacaggattgccgatagatgggctgttgtcgtcctccggcagacgcccgcggccgcgcacggtccatcgcctggacaggcatgctattgccgccactggtgaacgccggagcctcctgagtcgttgatggatcgcgccgccgtcgcctccccgatccaccgatttgctaataagcatcacccctgggaaagcgatattaatgcgagcagttcgggatggatccgattagtgcggcttgattaagtattacgagaaaacaaattttcgaaaaaaaacaaaacgggtttggaatctagacccgtcagcgggttcaatcggctggttaaggatggacggtggatgagagcaggtgtacgtacacctgggagtatagaagcattttcctatatatatatatatatatatatatatatatatatatatatatatat

SEQ ID NO: 63892 - DNA, 1854 bp, Oryza sativa
atttcgaaggagtatttggagggattatgaatttatgataatacaaggaactcaaaggatggaaggtcacttatattttttttattcgaggttatgtttggatcatgaatgaatttgaataattttgaatcgacggagaactaaggatttcaaaggaggatttgatttcgaactccaatagtatgtttgggaagggttctcggggattaatgttcattacaaggatcggtttaattgagatctctggcattagatactaaatacacgcaaagaaccaatttttttcgaacaaaggattttattaaaatagttttttaatggttacacggaaattgggatgttgcaattttttaaaccatcaccttcctaaaaaagcaaatatgatacgatatcctgattactcacgggtgaaatgttacaataatatctgtacgcttgcggatttatctgtgatcgtaataaatacaaacaataaatctcgcagtctgcctcggtgagtctgcctcggtgagctagagcaaacgtttgttaatgggaagaacaactaaacaaacattgattagcccttttccgaactccgcaagatgcatgaatcatgacgcgaaaaatcgacggctcactgacgaatccaaaaatatcctgcggctgcgaaatagcaatgttatatatgtttatgttatttttcagcgagcaagattagcaattgccaaaggctagccaatattacaattttaattttttttctagaaaaaacacatcaatgacgggttacaaatatacgctaccatgggtaagcctccctggtgatggattgcaactcaagtacatcgccgataagcatccgtgatcactactacaaaaatgattttcgcaagcaaagccagtgaagattttcgctggcagtgcgatccaagtgcgaaaatcgattttcacaggtggacccttaagagaaccgtttgcaaaaattaattttatcaggtgtacccataagaggaccaccagcaaaaaaaaaatgccaaaaaaattaatcaacatccagaccgccagcaaaaagatttttttttgtcaaaaaattaatcaacatccagagctacaatttcaaatccaatccaatccaaattcaatcaattcaaatccacatcagatccatactcaaacccacctctagagaacaccacatcaatttttcactccatttcaacaagcaaacgtcaatacatgcagcagatgaaaccgtcgaccatcgccctgccaattgttaccgtcaccctgccgattgttatcgtcgtagcgctgccgtgctggtagttgtcagtggagtgggagagggaggacttagctggatttgcgccctaggtcaccgcccgccaccgaatcaaccacctacgcctcgagatgggaggacttagctggatttgcgccctagatcaccgccttccaccggatcaaccgcctgcgccccgagctccaccgcccacgcccgaacccgccacccgtgcccgaaactactgccgacggctggatctgtgggccgtgcccggagcaaccgccacgcacaacccgagccgccacccatgccccaaggtgtcgccggccgaatccatggcctacaaccgagccgccgcatgtgccccgagctgcgtcgcaggatccgtcgccacgctccaagctgctgccggccggatccatcgctcgtgcggccgcgcctcgagctccgccgccggccaaatcctgttagataatgtagtgtgcgtgtgtaatcttatcatgtaatcctgagttggtttggtgcggctgaggaggagtagttagctgtaactaatcattagttgttgtatcttatctagattacat

SEQ ID NO: 63893 - DNA, 4206 bp, Oryza sativa
taatattcttttgagtgggatttctcgttctgattatgatcgtgttgcacatcttgaaactgctcgtgagatttggaatgctttgaaaaactttcatcaaggaacaaataatattaaagagcttcgttgagatctttttaaaaaggagtacattaaatttgagatgaaatctggagaggctttggatgactatctttctagatttaataaaattttgagtaatcttagatctgttgattcttcttatgatgctaattatccacaatctaagatttctcgtcactttttgaatggtctcgacatgtctatttgggatatgaaagttacatctattcaggagtctgttaacatgtctactttgactttggattcactttatactaaattgaaaacacatgagatgaatattctttctcgcaaagttgattctaaatcgagtgctttggtttcttcttcttcttctttggttgttgatgtttcttcatctatgccttcttttcttgctgcttttaatgccacatccgatgatcaactcgaacaaatcgaggaggaggatttggctttggtcgctaacagaattgctcgagctatgaataatgccaggaacaggaaaagaggtggtccaaatcgttgctttgaatgtgattcaattgatcatcttcgttcgcattgtcctaagcttgggagaggcaaaagagaagacaaagatggtgagaagaccaataacaacaagcccaacaactacaacaagtcaaagggttctaaccaagggaggaagatggagaatcttaggaaggcttttcaacaagtttgcgccgctttcgagccactaagtgatgtagatggtgaaagtggagatgatgataatggaaagaatgtctctgatgtttgcttcatggcacgtggtgaatctgacacagagtaagaagacaatgaggtgagtgcttttgaggaagctattaatattttgagtgcaaaaagtaaatagtgtgagaagatgtataaaaaacaggaatttatcattgaatctcttaaatatgaaattaatagattaaaatctcttattccaaatgatgatgattgtgaaaattgtgaggttttaatgaatgatatttcaaaaattagagatgttaatgctgcacatgatttgaaaaatagatcttctcttgcttgtagttttgctttgcatacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttaaataaaatgaaactaaaagatgctttaggacgtgttgagtatatggaagatgttgtaaaaaacaatgaagtgctttctttccccaaatgtcgtaaaagcaaaggtgtaatggtagattgtgaaaattgtgctaatttggaaaaagaggtttcttatttgaaaaattccttgctaagattttctgatggcaaaaagaatctcaatatgattttggatcaattaaaggttagcacaaataaccgtggtttaggttttgatccttatgctcataactctagacatcctcctgttgtgttaggtgttggtgctagaggtggtgagattttgattagacatgatactaataaaactgtgtttaaatctgctggtatcatgtctaccatgaatgcatcttcttcaaaatccgatgttgtgcatgcaaaacctcttgtttctgcttgtgttgctaagacttctagttctagcaatgtgtctacacaacgtgagaaatatacttgttctttttgtggaaaagatggacatattgttggtttttgtttcagattagctcataaacagaaaaaggagagagagattgcttttgcaaaatcaaattggcaaaaatctggttttccctcgaggaaaccggtcagaccgcagtgggtcccgcggtcagaccggcgaccggtcagaccggctgaacagcctcggtcagaccggacaccggtcagaccggcggtacagaggcggtcagaccggcccccggtcagaccggccactgtacttcggtcagaccggcctcggaggaatttttctgaaaattctaaaattgattttgcacgtggatatatgcctattggatcttctggtcgtgtgtctcagtactggattcctaaatttttattatctaaccccagtactgaggcttcgacttctgctgttgtgtaggctttggtggcaaggaaggagaacgtgtggatcgtggattctggttgttcgcggcacatgaccggtgataaaaattggttctcctccctcaaaaaggcatccaagactgaatcaattgtctttgctgatgcttctactagtgccgttgtcgctataggtttggttaaggtaaatgaaaaatttgaattgaagaatgtagctttggttaaggatttaaaatacaatttgctttcagtttcacaaattgttgatgaaaattctgaggttcactttaagaaaactggaagtaaagtttttgattcttgtggtgattctgtgctgaatatttctcgctatggaagagcgtttaaagctgattttgaaaattctgtttcacctgtgacaacatgtttggttgctaagtttgataaagatgtgatgttttggcattgtagacttggacatgttggttttgatcatctcactaggttaagtggtttggatcttgttcgtggtttgcctaaacttaagaaagatcttgatttggtttgtacaccgtgtcgtcatgctaagatggtttctcttcacatgctcctattgtttctgtgatgacggatgcaccgggacagctattacatatggacactgttggtccagctagagtgtaatctgttggaggaaagtggtatgtgttggttattgttgacgatttttctcgatactcttgggttttctttatggcaactaaggacgaagcttttcaacactttcgtggtttgtttcttcgattggagcttgaatttcctggttctttgaaaagaattcgaagtgataatggtggagagtttaaaaatgcttcatttgaacaattttgcaacgaaagaggtcttgaacatgaattttcttctcctcgtgttcctcaacaaaacggtgttgtcgaaaggaaaaatcgtgttttggttgagatggctagaacgatgttggatgaatacaaaactcctagaaaattttgggctgaggcgattaacactgcttgctatatttcaaatcgagttttcttgcgttctaaacttggaaaaacttcttatgaactttgatttggttatcaacccaaagtttcacatttgcgtgtttttggttgcaaatgctttgtcttgaaatctggaaatttggataagtttgaggcacgttctaccgatggattgtttcttggttaccccgcacatactcgtggctatcgtgtacttattttagggactaacaaaattgttgagacttgcgaagtttcctttgatgaggctagtcctggtactagacccgatattgcaggtacactgtcacaggttcagggggaggatggtcgtatttttgaagacgagagcgactacgacgacgacacgaggtcggctcggccggtcagaccaggcaccaggccggtcagaccgccggcacacctccggtcagaccggcccatgaggagcggtcagaccggccaggtttgtcgggttcgggtactgttgatgtagatcgagatggtcctccagagaattcaacttcgaccagtactggaacaaaacgtggatcaacttcagaagttgctgctcctttgtacattcaacgacgacatccgccggaacaaattattggtaatataggtgagcggactacaaggtctaaggtaacgactcatgatgtttgtgcaaattctgcatttgttgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaagttgagggtttggattttg

SEQ ID NO: 63894 - DNA, 6668 bp, Oryza sativa
taataaaagagaaagagaccgaaggcacaaaggtgcataaaaagaaaaataaaagccgcacaaaaaagaaaataaagaaaaacaataacaacaaaagttttctcctcgagtggcgaaaaaactgtagatccgaacggaaaaaaaatatgattcatataaaagtcaaaaaaaaaagtggtgacaaaaaaaacgctagattcgatttcttaaaaaactgaaaaaaagtataattcctataaaagtgaaaaaaaatctgaaaaaatatttaaaaaagtttgtccgatacccttagaaagtagcaaaaaaattgttcgtaaaaaataaaaagctggttcgtataaaataaaaaatgcaagagagaaaaatttggaaagggcgaaacaaaatctgatttctaaccagtatatatctcttctctatctctaatctaactatttaaaaagagaaaatacgtgagaaaataaaaacggtcaaaataacgcgtgaggcaaaagtcagaaaaaaagcgcaaaaaaacacgctaaaaaggttttccatcgttaataaaaaaaatacgcgcgagaaaaattatttccatcgtcggtaaaatatttttaaaaaaacatgcgaggaaaaaactatcgacaaaacgcgccatttctaaaaaaatggttttaaaaaaccttgcaagaaaaaaacaccgtctattaaaaaataaatcgctctgaaaaaagtgtaaaaaaaaagctaaattgatggacgcttgagtcagataggatccatcgatttttttgctatctactacatggctttatttcgtcatatattctcctgtattggaaaaaaacaaaaaagaaccttcgaaaaaaacaagcaaaaaacgtgcgagaaaacaagaaaaaaacacacgagaaaagaaaaacaaaaaggagaaaaatatggttttcttcgccagtaaaaaaaacaaaaaacatggttggaaaaaacgaaacgcgccatttctgaaaaatggtttgagaaaatcgcgcaagaaaaaaaaacactgtttataaaaaaacaagcggctcgttaaaatagaatcattgtcattgacatgattatgcatgaaaaacgtatattattattagaatttttttacccattgcaacgcacggacatttttgtagttcaattctatatctatctatctatacctatattaattgggcttttttttaggctctcatgttaaccagaaatatccgaccgttaattaaatagattgtgctataactaccgtagatcataaaacataacctacggtttgtgaatccgtgggcccgattaaaggccacacgatagaacagatgcatctaaaaatatgaggatctcaaattctatctgcaaaacgagatagtgataatatcgagctcgacaaagctacgtactggaaatgctccaggatgccctttttctctgaactccaagttgtctttcatcctgttctagaactatatatttggtctttcagtgctgtcatggttatcaataagacatatcttctatcctacgccttataaaaaatacgaatacgctgtacctttatatatacggtatgttcccatatgtgataagggaatctacaagatattatggaaaatattcttctaggctgggtgattaacagtcttactcggagaggattgagtttattctatatagtgcaaggttcgttgtctccgagttttatttggagactaaggcaatccacggtataaaaggcataccccataggggttcaaaggattgaatcatagcaccaacatacccaccatagtttacgaagccggaggacacgaagcccactcgccgggagaactcgtcgaaccatctcgacaaggatctcgccggtaacgccgaattcatctattctctgtgtattctgtggtttctacatatcaatctcatataaactggattagggccattaccttacgagggacctgaaccagtataatctttgtctccttcttccccggtccattgctcgggtatgctacaaatacttcttgaagttgtaggatgcgggtcatcgatcttcctatcggttcagaggttatgcgctagcttgggaaagaaaaagtaagatttgtttatcatatcatgatcggaacttagatgtaactcttcttgagtactcctatcacgtggtcatgccttgaacacagtaaataaattaataagctttcgaataatagctacactagtctctccaatatgttttgatgtcatattcttataccaacttacgttgtgtttagttccaaaataatttttgaaacttccaacttttccatcacatcaaaacttttctatgcacataaacttttaacttttccatcacatcattccaatttcaaccaaactttcaattttgatgtaaactaaacacagccttaccttaatatcatatttatccgatctacggtacccgtcgacaaagtacataattgaaaaaggaaaaaaaatatcaatcaatcttgattcctgacgccatcatctaatgtttccatgcgtccaggtacatgttacgaagaaggcaaggagatactccctccgtaaaaaaaaaaaaaaagacaaaccctggttttccgtgcccaacgtttgaccgtccgtcttatttaaaaaaattatgaaaaaaactaaaaagacaagtcatacataaaatattaatcatgttttatcatctaagtaacaccaatgaaaatccgaattataaaaaaatttcatataagacggatagtcaaagttagacacggaaactcgtgtttgccctttttttttttttttggacggagggagcatgtacttagcgacaactgatgttggatcgtcttaatcattgaaggatttattaagcagtagaaccatgtgaaccgcagcgtctgcatgacaacttctatggctttattcaggatcaaacttgctaagaagattcatctgtggttgccatatatatctaaatctgcaatttattacaaaggaaatctgtataatttatatgatttattcgagaaatcctcaattcttatgttgatgcattttctgtcaaacttgcatgttctatgtgacctattcaagacatctttaatttttttactgataagttgtgttgcagatctttttccgactgaaagatctctgttttatcataaatgccctgttctgattgtaatcaggttaatttagcaaaaattcaatgctcacttaaaaattgagtttaattatttaatattagttttcaaaatcaaagagcatatattgatctatattttcatgaatacaaattagaaactaacaagttattatactttccatatgtcttgcctgtatatatccatatactgtatgtaggttcacgtcaaaaacatatactgtctgcaggtcaaagctaattttgttgtgattttcatcgtcatgccatttttttcacataaacattaactaggtcgaaaataaaacaaacgcatcacaattcggatattacctttttatttttatcaataatggtatatgtcaatgtgatatatttcaagttatttacagggagaaatgatatgtcaaggtcagagtaactagaatttgcgataccatggatcccaacagtaatcaacttattagccttgacacgatacttatggatgaagaggtcacataatattttttttccaaaaactgtgctgatgtcctatttatataagatttatcacttatattatttactgctgggcacaatgatgcatggtgctttaaaaattttcaagttcagaccattaatatcataggatcaaaagaataaattgaaactccaacaggagaacaaatatgagtactgactaacttctaattttaaattattaattaactaatgtaaatgttaaaattgacactcaaaatcaaaccgattacaactcaatacttattgattgttctatttaaaaaaactaactaattatcaattttaaaaatattacagtaatactccaccataaatattaacaagtacaactatatacttatatttgttccaaaatttgcaaattattacactaagaaaacagatagcagcacaagaaatattacctaggatgtatactatataatgttgtaaaagctaatttttatttttggaactatgaattttaaaattagtgttataataatggtttcaatattttgaaattttatagccaacgtattgttaaaatttgatatttataagctatatctccgtactgactagcactatgagtgagcccctacatttaaaaaagaatgggccaccgattagaatcattttcataaaattcatgttatattgagaattcattttaaataaaacatctgatatgagataccattgactccttagaattagattttataaaattcacaattaataagtgtaaagttgtatatatttggacttacttagaagtttattaattaaatattgaaatgatgatggcaaattgtaactaacatgaactatttacctttccaaatgaaattggaattcataaatatggagtcatacaaatctagcttggactctcaatttatctctccatcaattcaatttaattcttatatttattccatgccgctataaactaccaacatatttgacatgcacttctttatgtaatacaaataataataacccgtgcaacccacgggttgacgactagtttagtttaacacttagtaacactactcgttcgagatgacttcaattgctgtgttccggctaataatgaaatgcaaaaaacttctgttttgtttctactagtagtagctagcttggaaagcgatcgagttcaccgcacatatccattaagtatatatcttcgcataaacagaggaagcttctatctatatgattaaatttgaaagaattccattctatttgggacaccgtattgttgaactgatgaagatttcttgatactatgtgtgggtcccaaaaattggttatgtccaggtttacattctcgatacattttgacccaaactcccaaagtcttgagatcctgacatttcaagctgacacgaaacgggatctcaaagatatattttaatgaattttcaaaaatagaaatcaaatttgacttaaaaggtactgaaaaaaaattatatagatgctatgacatctgtagtacgaagtagcataagaaattttcaaaaaccgttcatattgaccatatcttccacactttacttcatattcctataatttttcctccattttcaaaatttcttagtatcatttgttctgaatttttcacacgttcctacatatctattatatattttatatactaaaaatgaaacattacataaagactcctaagctgttacatggaagttctacaaacacttctaaccagataagagcactctaataaatttaaaaacactactaaaaaactattttttaccaacattggctttcgttttcctaggcgaaccaaaaggataccctcttataaccatttgcgaaaatagcttaagaacttctagatttagctccgcttacaaaaatcaatttttacaagcggatctcgtgaaaatacctttattaatttcacaggcaaatctcataagggtctacctatgaaaatcggttcacagtactaacaattgatcaacaccctcagatccggcctccctctcctcctcctctactcaaatttcttctcctccttccctcctcctctccctccctctcctacggatatgataccggtgaatattcaaagccggacggggaaggtcagcggcagccacagtagttggcccgcgtggccctcccctccctcccagatccgaccgcaggtaggggtggaaaaaaagcttgggctcgtgagctcagcttgtgcttggctcgagctcgcttagctcggctcggctcgaatgccaaacgagcaaagcccaagcctcatttttagctcgttccagaaataagcggagcccaagctggcttgcgagccgcttatttggcttgtgagcctaggccatcatgcacttatatggatgattttattttctagtggagttattgtttgtcaatatgcaatttatcatctagattttgatgaattggacatataaagttaatttaattttgcatgtcgaagatttgttcttacttttcttaatgattacaaattatatacaaagaggtgctccaacggaaggctcgcaagccagctcgatctggctcgagccaagaaatgagatgagctgagctcatgttttagcttgtttccctaaccgagccgagccaagccaagccaagcctagcttcttgcgagccattgcaagctaagttgagccaggcttggctcggctcgtttccacccctaaccgcaggggagggcagcggcagcgcgactgctcccctccatccctccctcccaaatccgaccgagggggaagggcgctggcagcggtggaggcggcacggcctccctcccagattcggcggagggagggcactggcaacggcaaaggcctccctccctccctcccagatctagtgaagaggggaggccagtagcggtggaggcggcgcgacccatcccctccctccctccctcccagatccggcgaagaggggaggctggtagcagtggaggcagcgcgac

SEQ ID NO: 63895 - DNA, 16446 bp, Oryza sativa
  unsure (1)..(16446): unsure at all n locations
agaccggccaacgagacaatgttgttgttgctgttattttcatcggtgtgcatgacattgacctctccttgtccaccagctgactattacttgatgaggacatagatgccccttgaattcggctgcacgcggagtttgctcatgcagtcaattctcctcccttgtgttcttcttgcttagcacaccacgagcttagcatgcttgccacccatgtcattgtcggacgtagaacatttcctttatagtacggcaaatggttgcttcgatgaatgtagcccaatcttcaaatcttttagcttggcctcttcggctatctcttatccttttgtccatcatatcatcgtatactttctcacgttgacggcttgcctccctagcctcaattgcaaccaggaagtaaacccatgtgtgacaagcattacgtcgctgacgtcagttctttgatgacgaaaatgatccttgcatagaaggacgttgaacaagagtgatagatgatacagtgttagaaggaaccatggttggatggacatgataattacaggaagcagtatcactcgactagacagtcggagagaatattcgagtcaaattatatggagattttgaaaaatccccatccaattctgatgtaccaacataatgatcgacaaaaggcacagattacaacatccttcccacccctattacaccaaattatgtggaggcttcatgatcgtcgtcctcaggatgtgtacattcagtaaacgcctgggctagatattggccgctaattgtggtgggagggatatgtgtaatcatggaatcataaccctcagatgcatctggtaaactgaagctttctcttggctgacggatctcccttgtcacttgaagaaatgcctttggaagacttccgcttcctactgctctcaggttgcgtgagggcatggttatctaccaaattttcacatgctggtgtgttgttaaccaaaataggttgtgacgaagagcctagagtaggatctacagaaaaaatgttctcctgctggaaccaaaaaaaaatacataagacggatggactaagtcactaagggtaaaaaaaaattatacaatatattacagtacgaaaggagggtacccggtgtggttgagctatactccgtatagctagtctccatgttcaagaagtcatataatattttcctccaggggccaccagcttcctctgctgcaaccttgccaaatgtgatgttggcatggtcattgggagatatgcgcaagatccatacgatgatagtggcctagaagaactcatgcaagacgaagatgccttggaaaaatcggtaaagaattttctggaatgttttaagagtaaaaagtttagatgaatgcttaaattatgtgttgcttttgtgccggattggtggttatgaatgatggcctaacatagcacttagacttttggtattgtgtaattatggtagtacatgagatcatgtggttataattagtagcctgaccaagtatgtgaaagtaggtaaacttttggtattgtatatggaagcatgtgtaattatggtattacatgagtgcttatgaatggtatcctgcagaattattgtaaaatatgatggtttattgtgctcaatgaaattaatattgttcctaacattacgaacaatatgacgatgatggatgcaatgcttatcttacattgccatatatatataatctgaagtttagctagaaactcaaacatgataaactttccacatgacatgatttactcctaatactgatattacattgtcatatatacaacctgaaatctggccaaaatatgaaaccatgataaatttcccacattacatatttcaaaagctgaaaccatcataaaacttcccacattacatggtttgttgcatttacttgctcaacactgatcttaacttatcacatatacatcctgacatttaaccaaaagctgaaaccatgatattgctttcccatattgcatgatttactgcacttggttggctaatgctgttgttaccttatcatatagctcaaaatcacaactaagggtattggggagaatgtctagacgctctagactctctttacccatatgagggatcttgtatccatttcctccatcagctttcataacctctaacaagcaagattgcaatgttaggaacaccctatttagcttgttgtcatcataggcctgaaattcctgctcaacattatctattaggtcatccatattcttggatatccttctatatgttaatgattgtagagacgcaaaaaaacccaagatctagcgcattcatatctggggaatgaggaggcttatgcatgagtcggatgtcaaaccctgtttgggaaactgcataggcaaattgaggatcatccactaggacatgagagggagcattatcctgctgaatccatatagtgttgtgtgcttcttctggagaccaacttgctataatagctggtaggactttagcaatcagaaatgaccttacggtatctcgatcaaccttgattgtcttgttgactagagtcccccttggtctattatgacttgtcctttgcgctggttcctaagtagcacaataatcaagttagattaacaattaattttcagatcaaatcacaaagtaaaaatgcatatataaagaggttatggtacctttctggtgaaaggccacaagcctatcttgccgtcaaaagtgcagataccttcttcattgtatctgggcctagcaactgctgccaagaacatcactgtatcgatagaatttttgttttggacaggtcggtatggatcatcctcccaatggaccatgtaaatggttcttgtccttttagttgtattgaactatttttcatctatgtgcacaatgtttcgcatatcaatgaacttgggttgatttggcaaagtatgccaatctaacatggaaagacaccaccgcagccttgattatttattctcttccttcaacaatggctttagtgtatttgagtgacgtcttagcagcccttctttcaacatcctatgcagtgtgctctttggtatacctgaggctgatgcaaataaccgtaaagtgcctctttgttgcaagggaacattagcaacatctgttaggttgatttctttctttttgcgaccacaattcttttttttcctagaaattacatcaattggtattccctgggcacggcattgcttcactcttcgccaaatagcttgcactctagcccttttcacattaaacattgctgcaacttcagttgtagcattttttctcatttttctcaggattccattgttagtttttccagtcaatgctgcatatatctgttgcctttgaattttggtcagatttttgttttgatgttcatcttcctcatctgaatcaaccaactcctcttgttcgaaaacaacatccacatcacccgcatacacgccgtactcttgcatgtctacaacagcaattataaggttagtcatatgtaccaattcagaattgtaatattttattgtcattgatcaacatgcttgcaaaattatggcataactttttaggttcaccacatggttttatttgtaatatgatttaaccgtacatatcacatctaagagggacagagacattgacacaatttagtttatgtgctttcttttagattactgtggtagtgtaccgattgacatgacaattgtatgtaaatacaagatatcaatgcatttattggtaaatctcattattctttgtgatttactatgtgctgaaatgtctaatttataatcctgaattgttattgcaactaatacaaccaaatgacacggttggactattgtaggtagttggcatgatataatattactaacttctaattaaaaacatgatttcagataaataatattattctacaacctttgggtaaaaccacattttatctttttttttgtaaatctgatagtcatgtcggttaaagggcttacctagatggtattgtaggtcttcctcattggcatcaaagttgagatcaaaaggaaaggcattatggttgtgacctccatttacttgcagaacttgatccatggcatcagcatcgtctacaataacaaatatcatgtgagtaccatgtacaaaaacaatactttttgccatgcagattattctatattgatccatggttccatatttgatgtcctgttgaattatgtgtccttttatatgacaaaggtttaattggtcaaagacatatccatctcagtagtagttatactgatggaagtgctcatgattatttttccccaaatgtgttacacatttcttatcaaatcttccgattgtgattttatcttattttgctggtatactgatatttgggtcatacatgaatgagttgtttgtttctgtacaaactttcgtgctgaagtttagagctctgtgtacaacattggaggtacaacctaactttcttttatagtactagctgaaattatgacattagaaaggaatatatataaattgtttgcttattattccagttcatgattttacacatagatgaaaacagtgctcatgctttctgaattctcatgtttattcctactttatattaagatgatgttgcttgagctacagacaatttaggtcaataccagtactataaaggaaactatccatgcagaatctagcatatctagaatctagtataacctctgatattatggaagggaatgaatttcattatgctcaactcttgacagaattgagttggtaaatatcaaagaaaaaaaatcaagtcctaattgttttctcaaacttatcaaagaccaattttgttccaagaagatagcaattgcatcaatgcacatgttatagatcatttttacagagaaatggcaaagattttagagtgatttatgcaagccatatctacaaagatcaattgttttctattcatgtttacaaggttacctagatgtatttctccttggtggtcagatgcatacaagttgagatcaaaaggaagcacatggttggcacctccctggaaatcacctccaggaagctcatggttggcacctccctggagatcacctccaacctggtcatcctcctgatcagccactgcttcattgaggttaggtacagcatgttcatctccatcatctaatgctatatttagatctaaagccatggatgtgtttttgcagagatatgaagggataaagtgggaaggaaagttgtgtttttgcagagttatgaagtgataaagtgggagggaaacttctgatttgaaacttgtagggtttgttgtggtggggtgtgctaaatttgtattacatcccgccaatgaagtggcacttaattcttcattcaaattatttggcaccttggcgccctatgtctgcctgtgtgtttgagtatggagtactactcctgttttattaatgtgtggcagtagtaatactttatttgtacctaatgattgggtgtactagtactgagggtagtttagccttttgctctttgtcctaaaactaccttgggcttccaggaatcccttctttctgggacggagggagtacttgtatgatacaaaaatctcgacgggaaagcccatgggcaataatgactctgtccaccgccagattttttctatgctcaagaggcactccaccacatacattaccatgaatgagttgattaaaaactcaagtgaatggctcaacaaatttcttatacaaccagagccaatgcaccatacaactctcgacatgggtcttgttaggaatgagaggtagaaccaattctgccgagcataaaaggatgcatccaataggtgcaaggaaccccaaatctctctccattgtacaaactcgctgctggtggatatggagtgacttgatcaagtctgaactgctaagccacccgatctgggtgatagggttcagcgaggcataggtcaacatgcttaataggaagcaaaccacactgaacagataagcaaaacatgcttatttaaaggttggtttgtagggataccaatggatgttggcatctttgcataaaaatttgaaggcttcgtcaggactgaaacgcttgggggttctaaacattgtgttcaccatcatggatttccgagaaccatgaataaaagaaggggcatgtggcttattcactttatcaccaaagatacttttcaaataaactcccatccaaccaataataaaatgaacaggccaacacctcttataagaaggaccaataggatttgtgctgagcaacctcaatagcataatgaacatagagcaggttgagttaaagcatatcggcgcccaccgccacctcccatcgggagcctgccgccagccacggaagccctccgtctcccctccagccagatctggcagatgatgaggacatcaacaccatcgatacatccacgtctctgcaagtacgacttgatggtcctattacccgcgctcgtgcacgtcaactcaactatcaggtgagttctttcttgagtttatgttcctcttctttataccccggagacgcgtgcactcttcttttactcagtaacgatggagaggatccaaaggggagaggattcgcgcggggtggattcggactacaggacaacgccaacttctgacggccgccacgacttcatgcgaactccgatttgagcgtgcaagtacttcatggaaagcttatcaagtctactttcaaatggatctagccatatgtccatatctgttctggagcggccacaattatcgttttactcccgactattttctgtccatagtgttgcgtcacctcttttggcccaatgggctgtgtatcaggttgggcccattaggggcgcatcctagggttggagcacgaccctgtagtcattcttcccctcttcttatacctctaatcaccgccaagaacgctcggtttttgatgatagagttagctacttgctacctgctcgcagcgcgcgtgttggctaaaccgcccgtctgcctgtaatcagaaccccgccatattgtgtttttcatagtgaagctttcatcttcatctagcaattcagtgcttgttctacttgttcttgcttgttcttcgattgcttgcaggatgagtgccctcgtggccgggttgacacacaccacaaattcgcagcaaccattagagacggtatatcggttgctaaggcgcagcgtctttggacggttgtagtcgtgccatgaacgtcatcttcatccaatcgagttatcccacacctctcatcgaaagatcgggcacaaaccctagcgggttcacatcagcagaggggagggtgccaccacccgtgaggagctcgccgccggctgcaggaacccgccgcgtcccctcccgccaaatctggcggaggagagcctaccgccgcccacaggagcccgccaccggctgcaggagcctgccgcctcccctcctgccggatctggcagagaggagggcgtggccaccaccgccgccagtgccgcctccgctaggcaatcaccgcaagagtaaggggagggggagagacgcgagagaggggaggcagagagacgagagaagagagagcgttggatgggtgggtagggcgctgagcggagtagagataaggacgacgttagatggatgggtggggcattgggcagagtagagatatggacacagttgatcagctcaccggctcagctttgtttagtataggcgccacttttttaaaaaaaaaaacagtacctataatatactataggtaccggttattttaaaaaaccggcacctattagtataagtgtcggtttttcctctattaccggcacctatagtgttcaaaggtgccggttctatatttttccatgacagggaggtgggaaaaggcccataggctgttccctatgaggtatgttgtagtagcgatttgagcctaccgaattgagatttgaatcatggatttgagtatccaaaagatttcaaatgaaaaagctataacctataaaattgtagatctcattgagagttatagttttcatatatttttttcccgaacagtgtccatatgaaaaaactaagttaaattataagatggcaattttttattgtgacgaatttattgatcgtggcaacagaaaatagtgaaaaataacttacgacaaccatgtacttaacaaatttccacaaaaattaaaactatgacgatagaacatgtattttttgcaacaataatatttctttgtgatagtttatttcctattgcaactaaaatatcaaataaaacaacaattataaatcattgcaagaatatacagttatttgccgcagaaaagttatcattgcaatagtacaatatcttacaatgaattatttttagttgtaataattgatacttcgacgactttggttatcggagataagacccgatcagagcatgttctctcttagatcgggttcttatttaccgtagaataaaatatgataaaaaccacgtaattaacttcaaaattaagcactaaaatttaaaatttaacttataagcaaaactctaaccgaaaatgatggggatgaacgtgttttagtgcccgcctgctctctgtgattaaaagagaagtgggcttgctacccagcgcagctttgtcgttggcaccgtagcccgtgggtctacctacattcacctaacagggctcagcccatgcgatgcaactgaacgtacggtacgtactgattcctgaatattgtaggagtaggagcctaggaggcctcgttcgatgtgttcgaatgattctattttctgttaacacgttactaaatgatgtattcgatgtgaaaattttttttatataaattcctttaaaatatcaaacaaatctattatttagatttataattgttaaaactcaattgatcatgtgctaattgatttttcattttccgttttctggctacatcttcatcttcgtagagaaacgaagaacaccactccactcgttgatatacgataggatggtattttgtgtaatttcggcttatggtggaattataatgcccaaacaacgcgctccatttctccatttctttttagccgatcgctgcacctgacagctagcagggggcatgatgtaagatggacgaacggacggacggacggacgggtgaaactgatggaccctgtattaaccctgtgtagtagtatccctcgtcacgtagcttcccagggatccagcaggagacgtctacacatcccgtcaccatcgccatcctctccgtcacataaaatactcctcctactagtactcctactcagcgcacgtacggtgtatagagaggaggaggaggagagggcatatggtgacagggagggcatggggccatgggcagtagcatggagaagtgacggttggaatcgacgggcggatggacgcatgcatgcaaaagccgggcaagggaatcatgccgtgccagccgagctgccgcagggggagaggccccctccccggtagacttttttaactcctccgcctaccaaatgctacaactccattctcctatggagtagtactaccctcaacagccggcaggttcatgtcatccatgatacatccatagaccatacaaaacccatccaccggataaacgtgccctctcttttgtttccaaggatctctcttgtcaattcgtcgatcttcgccgattcaatcattaacacatgcgccgcggccttggtttagggcccaattcgaacagcaggattgaaaaaacagggaactgaaaaaaaaaacacaggattctgacagtaatacaggtgtaaatataatgtagatggttgcaaaacacataaaaacacataaaataattgtttatatggaccgcatgaaaaatgaaaaacgcaggatcaaatgagagagaattaaaaaaaaattccaagagatagaaactcttgctaagttaggacttgggtgttatgacaagctaacgccactctagcctgggttggaaacccatgtcccccgcacagaaaacggaacacggttcattagcacgtaattaattaagtattaactatttgttttcaaaaatggttcaatatgattttttaagcaactttcgtatataatttttttaaaaaaaacacaccgtttagcaatttaaaaagcacgtgcgcggaaaacgggatggaggagttgggaaccgggggcaacaaacaaagccaaattgtggccacaagcaggtgaatatcatgcataggttgtgtttagatccaaagtttggatccaaacttcagtctttttctatcacatcaacctgtcacacacataacttttcagtcacatcatctccaattttaactaaaatctaaactttgcgctgaactaaacacagccatatttgttctaaacttttttttaaaaaaaaaaacaggaatacgcattgcttattccatttgatcgcatttttttcctaacttgaggagcattggcgtttatatgtggtgactatattggacgttggtttatcgtcatttcatggcggcgaaaaatgacaagaattatgttgatctggaccggtctacatattaagggcttatttggttgtatatgccattatagcattaacaaatttttatttttttaatgatctacgcaaatattgttggcaatggtaagatctggccatttgtaaaactttgggggtgacgttggagcttgttcgctttgttgccaatctcaacattttggtaccgtttttataagtacatggaaagttttggagctataccaaattttggtaggatggtgttaggctgtgtttagttccacatcaaaattagaagtttgaagaaattggaacgatgtgacggaaaagttgaaaatttatgtgtatagtaaaattcgatgtgacaaaaaagttaaaagtttaaagaaaaagttgaaatctaaatagggtcttagtataccaaattttggtatggttaaaagtgacggtaagaacatacgcttgatattttgttgttagccaaattttgtttgtgagattggctaggcttaaatttatagagccagtatagcgacaccaaatactaattggtagtcatttttttccgaacaatatgtactcctaactgatagctttttcgcattattaatttgcatagttgagttgaaccataaatatatcgtcagggaaagtattgatttctttttaagaaaaagacaatttttatagaaagtactcctgaaattataaaacgttagctaggccataactgaacaggtggtcggcctggaccaagttttgaaacagctattttcttgcacagaaatgcacaaaggtgtaagtactataagtacctactagtatattgtatttcccgtccacatgtgtccccgtaggggctcccaagacaagaattgatacatttctctaaatattaagctattaagcggtatgttcgatgcaaaagtgttttaaaccaaagtttctttagaaaagcatattaatttattttttacttttataataattaatctcaattaatcatatgctaatggacatatggcacaagtgcacaacgagtcccagccaagcactgggtttcgagctcagccaaagggccaactgaatgacttacgaactatcaacgctttaacaccatcggtaacagggtggtggatagtatatgttcattgtatgccaattaatcttagccgtgcactttggcgatagcaagattttttttattttattttgcacaagattgttgtttcgaacgttgctacattttctggcaagattatctattctttgatttgtattgtagagaactattaatacttccaaagagatgccgatcgaataatttgacaacgtcacttttgttattcaagccaaatgaatgacaatggctgtgtttagatttgaagtttggatccaaactttagtcatttttcatcacatcagcatgtcatacatacacaacttttcagtcacatcatctttaaaatttaaactttgcgtgttaggcagttagtaggatgaacaaattggatttggatcctgaatagctagcgtgctgtcatgaatatccctagatcttctgcgatgaaatctatcttacagttgcaactccctacagttgcaataatgaatcttcacattattaacaaactggtataaaaagaaatgcagcacgaaaatatacctaaagatggtggtttggagctgaaacaaccatgcatctgtctcatagattgtgaacagatacgctccgatacacatacattaattagaccggttatattggttcgtacattactaaatctataaaaattgtgtaatcactgatcagtcacctcaggggaaatcctgctactgcagtgagatgacacaacgatcacaacatgctagccatagtccagagttcactctactttaaccatacacctactaggaacttaaaacctgagctaagaacagatcagaggctaattaatacagtactactagtagtaattaatgagctagtaagtagtaattagcatacactttgaagggcatacttgccggccccatgcgcgtcatgacgtcgatctgcggctagaagccccatgcaaaggcgccgtcgagctggccggggccaacggccatctgcggcggcgcgcggccgacggcgccctcgaccttgacgtccatgccggactgccagtggaaggccccgccgccgctgagcggctgcgacgacacgcccgcctgcatgccgccggagaggaacagcggcagctgcaggttctcctgcagcgagcggaggctcgggaagaaggccggcggcggcggcggcggctcgacggccagcggggccgggttgtactgcccggtgccgaacgaggcatccatgtgggctgtggtggagaagcagggcacgagctcaaggccggtgaccaagttggcggtggcggtggcgctgccggcgccgccgcccccgccgtagttgctgctgtcggcgccgtcaacggctggcgccgcggcggcggcgaacagcgaggcctcagccagcggcgcgcgcagcgccgacgaggcggaggtgccgcccccgccgccgacggaggcggaggtggagtccgagaagcacgaggtgtcgccgccgccgccacttatgccgaggcggcccttgcggacgacggggaacacgccgggcttggtgaagatcctggctatcacccactcatcctgcacgacacatcaacacagagaaattaagaatcaaggttgtgtagcaacacgaatttaactgtgtatatatatcatgaactaaaaaaagggtagtacaaggttgtgtagcagcagtacagtactacgatttcgcgtgcacgttgcacaaggcgaactttgttcctctttggtttactcgctcaaatgacaaacgcagatgtatgcccaaggcatctatttttgctaaatgcaaattgcaaatacgtaaggagtacagtatgcatttacaccttgtgctctcatgtatccacgcattcatgcgttggattgcatataagcttccatgaggccaaaaaaagattcgtatcctgctaagctgcagcctctgatctttcactgcgctaagctgaccgattaccatatctacgtacagtatgcagcaatctgcgtcgcagcacccctgcgctgctacaggaagtagcatagcagcgcagggagggagctcgctgctgatgacttcacaccagaaaagcaagctcagagctagcgattgtgccctagacccctcgtgacttattcctaccatatgttgcacacatcatccgcagcaagaacaacaacagaaagtttccaaaggatgaagtgaacaacacaatgggcaaaaggtgaagaaaataaatggggaaagtgctgacccgggtggaggaggagagcaagtggtaggcgtaggtgccgtcgaggcggtactcgtgcatgacccactgggtcttctggcccttgggggcgcggccgcggtagaagacgagggtcttcttcatgccgacgagggcgccggtgcgggcgctgcggatctcgcggtccttgccggtggccttccagtagccggcgcccgtggcgcggttggtgcggagtcccgtggggtacttgcggtcgcggaggctgtagaagtaccactccttctcccccatcttggccttctccggcagctcccacggctcgcacttgttcaggtcgatctccgcgatggcgcgcccgttgaagctcccgtccaccaccttccgcagcaggtagtaggtgatcagctcctcgtccgtcgggtggaaccggaaccccggcggcagctcgccgtccagccgcccgcccccgcccccgccaccgcccagccccagcacgctgcaccgctccatccagctgctgcaacaagtaactaccagtcaagcacacaggagaagaaacaaacaaacaaagtactactactccataatcaaacaaacgccattaatgagcagcagcgatggatcgagctgcacaagagccaaaggaatggattgaaaggagcagcggtacgaacgctcgactaattcccccacctgtcgagagaggcgacgatcgatggctgcctcgctcttcttgaggggatcagaggatcggtccgtgttttatactagtancgccggtggtgctgaagnagnagaaggaaggtgggtgccgaggagtaaatgtgtgggattcgacgaatcgggggggagggggggggtgtctgtctgtcagcgacagtggggactggggcccggctcggtgggtggcgagaagagaaaaaaaaagtaagagtggagtgtggacgtgggggaactcagatgagacgagtggagatgatcaggcagtgcagagctgatcgctgatcgatcgattgcttcctgcaatccatcatgcccccccttctcatgcgtctccctcgcaggccgccgcacttggcacgacgtggctctggcccacgggatcctttgcgcatgcatggatggtaatggtactatgggcctgttcactcggtgaaataaaaatttttaggtgttacattgtacgtttgatcggatgtcagaaagggtttttgacacgaatgaaaaactaatttcataactcgcctggaaaccgaaagacgaattttttaagcctaattaagccgtcattagtacatgtgggttactgtagcacttatgactaatcatggactaattaggctcaaaagatttatctcgctatttacatgtaaactgtgtaattagtttttctttttatctatatttaatgttctatacatgtgtccaaagatttaatgtgatgattttacgaaaagtttttaggaactaaacaaagtccctctgtagggacttattttttggagagaggggctaaagttcctctctcctaaacacccctaaacagggcctatagtaatacaactcacatttttttgggctgtgattgagcttttcaatctaacaaatttcatccgtgtagttttaactccatcatcatctttcagtctacccgacatataaacgtgtgtataatgtaaagcaaaaggcttaggtggtgtttagatccagagacttaactttattctctgtatttagatactaatttagaatattaaatataaactacttacaaaactaattacataaatgaaagctaattcacaagacaaatttttaaaggcaaattaatccataattagagaatatttactgtagcatcatataggttaatcatgaattaattaggctcaatagattcgtctcgtgaattagtccaagattatggatgggttttattaatagtctacatttaatatttataattagtgtccaagcatccgatgtgatagggaagttttagttccatctaaggctgtgtttagttcctgaaattgggaagaagtttagaaaaagttggtagtttgaaaaaaagttgagagtttatgtgtgtaggaaagttttagatctgatgtgatgtgatggaaagttgagagttgaagagaagtttgatgtgaactaagacatgcctaaacagggtctactccgtactcagtaaaaggtgcaacttcaaagcagatctgctgcattgctgcaacccaaaatattcacgtacgtggccaaattttaccaagaaaaacaagcaaaacttaagcactagttaaaaaaatgccataatcaaaccaaacctccagacaaccaccaccctggcacaataaaaaaatggtatgttctttttatggagtagcacccatgcgaaaatatatttatttttaggttacaacttttttttcgctctgaagagaaaaaaatgaaacatgttcaatgctaatctaaatagctgaaaaagctgatggatatactagcgaaacgcatactgttatatgcaattc

SEQ ID NO: 63896 - DNA, 89412 bp, Oryza sativa
tgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttatttgctaacaatgagtcaagttggagatagcttggtctcggaatatggtttctttgtttgtttcatgtgtaggtgactcgatgcctcgggagagtatttacggtgatggaccgggagtcggcttggtggtaagacgatgtccgtggtggtcagatatcatgcgggatactaaggctagagttgatgcacgtggttggtgaagattccatatgacatacgatggaggtattgagtgcgtatgggatgcggagttaaatttggaaggagtctaaatttggtacgattggttatataaagtttctttcttgtactagagggttttctaaggtgtttaggactcttagtatgagtttggttcgtggctttaggctgcctacctcatgtataaatagagggggagcgtgaggcttcccggtatcgcttttgtatagcttttgagagctagtttagttagggtttcgagtttagtcaagatttttgtaaggagtgctgttggtgcactttgtaaacacagagagaagcaataaagttgtcatctactttgattgttcttcgatttgtgtttcacagggttttggcggtctaaccggcgatatactggcggtcagaccggcggcgctagggcggtcagaccggcggcgcaggcaggcagcggcaggtgatctcggcggttcgactggagttcgatctcggtcagaccggcgtgttccaggcgcttagaccggtacaactacttcggtcataccgcgatccatcgatttcgagggtaacttttatttccgctaaaagtttttggtttttgggtataccaaccattcacccccctttggttggcttagttcttgttattcgatcatacacgggtcgccccatgccacccaatggtaacgtccgcccctgataagagctgagccgaacctatagccaacgagcagagacggccatcccttgagctgtggttgtggtggagcgaggcggccggggccaatcctatttgatacctcgggctgccttcccctcttctttttcttgtttatccctgaacaagatgcaaatgaagcaacacattcaagctatttctttggcattcttttcgagttctgtaacattaatggatattgtaagcaagaagattttatgttgagaatggaaggtattggaaaagaagctattgagaataggctagttgaaagtgatcaggatagcgagccataagttactacaacacagagtatcacgtcgtggcctgagttgacgtcttaagagagtggttgacccaacgagacatactatcgccgtccgaaaatactcatcgtattaagtttttattgcaatgtttgaccattcgactcattcaaaagattatgaaattattatttatttttttttcacttgctttattatcaaaagtattttaagcatgacttatctttttttatatttgcactaattttttaaattagacgaatggttaaacattataagcaacaagttaaaacgacatctaatttaggagggatggatgtagtaaattcaagcaagtagaatcctgaacatgcatgggcatgagtggatgacatggagactgagaagtgtccaatttcctgagttcaaggacaactatgtagacagggataccctactagttgtttgctaaggctgtgtttagatctggggggtgtaaagttttgatgcatcacatcggatatatggacacacatttgaagtattaaatatagtctataacaacacaaattacagaatccgtctgtaaaccatgagatgaatttattaataagcctaaaaatctatcattagcaaatatttactgtagcatcacgttgtcaaatcattgcacaattaggcttaaaagattcatctcacaatttaaacgtaatctgtgcagtcagttattttttcgtctatatttaatactccatacatgtgtcgaaatattcgatgtgacagggcgtaaaattttacaggggatctgaacagggccttaaacaattgttttttagataagtatattttttacacggcctctttatcgaaccggatatttgcagccatttaagttaggaacttagtctctcaaacaacctaatttgaaattcgctcatatggagatttaaacttatgaccttgaggtgctatacaaatcactgaaatcactaggctacatggggtgcttaaacaattgttgctcatgatatcttactttgtgaattttgatgactacaagcagcttgtgcaagaattggattgatttggttacaccacacattactcgaccagccaaaggtcaatccagccgaagctgcgcatgctttaatatcaattcaactagtcaaattcaacgcacaaaaaaactgaatggataaaggtggaacgaccaaagttgaaagaaagcttcattaaagagtatttgcaggtttatgttacaaattgtatgagttgagctgtacacatccataagtttcagtgagtgaaattgatttttttataaaaactaacaagtagtactacttaaaaagaaaacattattcatcgaggcatgaaaaacaatgccatcgatctcatgtttattttttctttccatgtcttatgctaaggctgagttagaggagaggaaaagagggaattgagaagatacgtaaaacgagatatgcaattagcgtatgattaattgagtattaactactttaaattttaaaacagattaatatgatttttttaagtagttcaggaaacatacatgcggaaaacaaggtgttttctctctcaaatctcccagtaacgaaagcagccgtgtagttatcgacatctgtaggccatctaccctatatgttggatacgtccaaccaagtcttccgtgaaagattatgtcatctttgatgacactgaagctcagtcttccggtagcttttcttttttttttcctcttctgtgcaggggggttcagggcctaacaattcgtgtgtgttttggctctgtatattctccatgaatatagaggctggatttgatggcgatataaatatagcaaatctgttgattttttctcattaaatcatgagatgcaaggtagcgggctgctacagattgtcgtctcgacagtgacataatattgattatcagatggatgcgtggtatgagaggcgatgggatggtcgtaccaagcattgcagctcaataagaggtggaggtaacacggggttgttctccggatatctattcgtagcagcacaagtcaacacgaattactagatttgtctaactcttctcccccagagactttggtactcatgtcttgttgcagccgcggcttgagagccatctctaccatcaagcgtctaagcttgatccgagtaatatcatcggtatataggagtaccttccatgacaccaccgattcccatacataaatttaaaatctgtaccatacaaactagtgggagaagagtggttatgtactccagtcaaccaacaagtgtatgctatatatcgttatttgtccttatatagactgaagagggtgggacaggaaaaccacccaaaacatgtttaactgaaagtatagaggacaataatgcatggtgtctgagacttattggcttcagtcggattagagagagttctttattttgtcatgtcaaggaataactaaaacagagtacaatggattggtggaatataaatgtagttctatttcctttcatattggtttttactcccaagtagtttcccctctctactccaaatcttcgagtcatccacagacacaaagtcacaaacaatgtgcaataaccagtccttgatcaaatcctctgatttatgccttcctaaatcttaagcagattaccttgtgcatgtaagtcccgaaattagatgatttttcaagcacattcttatcaataatttcgtaaaaggtgttgatgactcatttgaccttgtttcgtatgctaagtatcaatctgaccctactttttttaatttacttatttgactccactttttgaaattaaagatgaaagctgaccttattccgttaaaacgagttaacattgttaaccaaggggcaagtagtccttttgcccttgcttatttaaccatattatataaaaacatccatatattccaaccttttgacataattgtaacgaatttgacatatctttcacatttgacacaagtttgatagatttggcttcaatttgataaatttgaatcatattgaaaaatttggcggagtgcaccaattttgacacaagtttggtacactgattttgctcttgtggtggtgagaaagcatagccaacaaattagaagaggaagccgagaacaacaccaccataatcttctccccacgctcgtcctactcgtccctccgtgccaccgccgctctctccctctgtgtgcctgcggagccgctgcctccatccatccacccgcctgcgctagcaccaccgccccctcctccctcagcatgtcggagccaacgccaccccctccctctacgcaccggcgctggctctaccgttcatgccgagagagacgagagagcgataagggtcaggcagggtggtacgagatggataagattgaaggagggtattttggttagtttgaataataaatagatttattttctttttcctaaatgaaaccctatcagtatattgcaaatatagtcaaacggtaggttcaattgtgaaaagcagggttaaatcagcaacctagaaaaaaataagatccgattggtagttagccttcgaaatagggtcaaataagtaattattcgtttcctaaaagtgatgaactactcgtagtagaatatttcttctactggtaatataactcacaaatgaacggttaccatagtagtgataatatgggtagaacgataactaccggcagatacccatgtaaaagtactccaattggaattatttgtagcaaatattacgaccatttttctgtagcactaaatattgaactagtctgaaaatggttgtgactttttaattaatttccaaacaatcctaccacaattggactccattgaagctacaattaagttttttgttcttcacatttccgaaagaatgatcaggttatctgatttgaccattaattccctatggagatatacattccaatatcaatatgcttttgttctagagtttgacaatcactacacaatgggggtcttggttctattaacatatatactcctacatctatgtgccagttacataccttgtgatgtataataagcccattaattgatgcaaaatgcatgcaattcggccgtggtaagagaagtcgtattatttctacagaaaagcaagcagagggcaggagtgattctttattaagacgactgaatttttccttctgccacgtggtaatgcaattcatttcattttattgtatttgttaacattattggtgacttcaataatatcgatctccagtatgtattaattaagaccaataatatatatatagtaagtggagttcaattctaaaaactctgaaaaaacaataacaaaataagtatgtgctcttgtgtacctctcgttgctcaatacaatgaaataattatataaaactatggaaaataatgacaaaagttgggctgtgtttagatccaaaatttggatccaaacttcagtcattttccatcacatcaacctgtcatacacacacaatttttcagtcacatcatctctaattttaaccaaaatccaaactttacactgaactaaacacagcctcgaagagagaaggttacgatggttgcagtgaatctccaattccactacctacctaatggtaaattttgcaggttagcccttcaattttatcatattaaaaaacagtgaaatctaaatgaaggtgataatataccctatagaaaaatatggataacacatttaatgaaaatttggtactaccaacactttggtagatatttctattgatttaggaagttctggaatcaatccaaacaacacataagtagtatttagactaccaacaatttggtagtgtaagatttggcactaaattaaaagagcccataatgtattttaattctgagatctatggattgaattgagaaatgcatgtccgtagaggggaatgacattataatccatgctactactttttttctctagatttacaaagtgaacttcccatattgtttcctcatttagtgtacagagtaacaagatttactaaaactgtttgtgttccatacaatttgatctactgttcagaataagaaccaacaacatacccatgtaaaaaaaagagtcataacacaatataaatatttcaatagaaaacataagtaatcgaatttgatacatcattagcaggacataaatatgttattagttttgctgaacgtgcctatgcaaccagcttgccagctactagctagttgagcatacagtatactcccatgcctgatgatcaccgtgatactctttagtgcagcaattcgcatagtctcacctcagcatacatgcccagataacgccattaatatatatagatctgtcaaacttgctgctaacccaagtaattggcagcaaaagcattagtcccggttacccttaaccatcatcgcttcaaccttttgcttgagggaataagtgaataacaaccccactgcaaatggtgcaagcgttgtacgttcttcccatgacaccacccatttccatgtaaaactaaactcgcaagacaaacctaggtttaacaaggtcaggcatgagaagagtgtacaacgatcactgtttgtattactcagctgatcttcccctttgaactgtgcgtgtcaaatctctctctctatatatgtaacaatgacaaaacatatagatacattgtgttataaatagttacagagacttaatagcagagtgaaaagctaatagcagggtgataagcaagctggctgtcagtggggacagctatgtgtatctattgttcaagacaattaaggggatgtttaaatcagggtctaaagttttagcgtgtcacatcgggtattatatagggtgtcatatggggtgtttggatactaataaaaaacttaattacagaatccgttagtaaaccgcgagacgaattattaagtctaattaatccgtcattagcaaatgtttactgtagcaccatattgtcaaatcatagagcaattaggcttaaaagattcgtctcgcaaattagttgtaatctgtgtaattagttattgtgttagcctatatttaatactttatgcatgtgtttaaacgttcgatatgacatggtgaaaaatttttgggtgggatcttaacagggcgcgcgtaagttagattggttcatgattggctgtaacttttaggacgctataatcttgttcgtattggtttattacaccagattaaatcactctgctcgtatcaaccactgaagtagaacttcgtactgtgctatctgttctcatatcactactgatctttgctgggtggtgcaaatagtcccggttcgaatagaaaaatagactaaacatcatttttagctctggttaaaaagccaacgaaactttttgatctttagtcttagttggtgttaacaaccggaactaaacatcatttttagtctcggtttgaaaatttgtcaggccgtgtcaggtcccattatttttagtcctggttagtcaacactttagtcccagttgtttataccaaccgagaagaaagattgaaaagaaaactaaagatcaatactttagtcccggttgtttgtaccaaatgggacaaaagattgaaaagaaaactgacagccgcacgccaccccctccctcgtccttatctccttgcacgcacaagcgaaactccctccctctctctcgctcccgccctccccctccctccttatctcctctccctgtgtgctccctccacctccctcgcaggtgactccctcgatccgccccctccacctctccctcaatcccccctcctcctctccctctcacctcccccgccccctcttcctctccctccaatccctccgcctcccttgctgacggcgctcgccccctcctgtccgactcacctccctcttgcggtggatttggcggcggtgacagcgtctccggtggcggtcgcaggtggatccggctggatccgggccacggcaggtactagcagccacatcaagcagatggtggctcgcggtggggagaagaagaagaagaagaagaagaagaggaggagtggcggagagcgtggagaggatgaggcaaagggggcggccggctgtagtggtggcggagcagatgctgctgctcatggatttgtgattgtattcatgaggcgattgtgttcacgaggcaattgtgttcatggattttgattttttttttcatgattgcgttcatgagatctcatgggtgatgtttatgattaatatgttcttggattggatgaattgatgatggtatgtgaatctgtgatctgtaatgtatttgttttttgagaatttgtgatgtgaatccatgattttatatgtgaatattttatttggggaaatcaatatgcaagccagcaaaaaaaacaaaaaaaaaaccctttagtcccggttgataatactaaccggaattaaatatggtagcgtcagtcacgtggcgctaccatctttagtcccagattcggggtctcagaatttctccagtagtgtgtcgatatcaaccgaatcaaatttttattagttggaaatgtgaagaagctggtaaatctcgtatatattaaatcacattaatgtgggtagcgtctaagcgatgtcaatattaacaacaaaaatagtacggaagacaggtactgcctttgtttcctgaattggccattccaaatttggacctgtacactatgatttgtatttttttcttatggaacaaacaaatatattcaaataccgattctagaaaagatcattatgaaatctaattccaaggcacaagtctgaagattgatggcatcgttcaatggtaaacttatattctcattttgttattcccaggcacaaatcccagagaataatacctttgagaaaacatgtatatgtactaaatccagccaacaaaatggaaatggacgctctggggtgaaccagtgaagcctgtgcttatcttgtccttgatggcacccatttctattaaatagccccacattggttgtggaagggtaaggaatattatatgtaagtgggagacctcttcacctaattggttagcttttgagatgtgaaaggccctttacgcgcaattcgtactattctataattgctacacagtgcttgcacaggaagcacgttagacactaatagaaaaaatgtttttgcacagtcaaaaatagtttttccaggcgggtgtaaggaccgccggcctgcttgcgaaaataatttttgcaggcgacatctccattttcacagctggtagattcactcgcctgtgaaaaaatcacagcgaataaaaaaaaagggtgccgccgccggcctcccctccggtcgacggctctccaccttcatccgctggccactgccacagccgctggtatcatcatcgcgcatcgccgcctctgctccgtccgccggcttccccgcaggcgtcgtcatcatcgtgtcggcgccgtcgtcgcgcgtcgccgcctctcctcctccatccgctggcttcccacaggtggagctgtcgtcgtcacgcatcgccgggagagggaggagtcgagccgccgcctctcctcctcgttggcacaaagaaaagcataagaaattgttcttttatccatgaatcatgtgatccatgccgacaaggctgccacatatctctactattataaaaattgaagatgtttttaccgattactttgatacgttatccatgtatgaatcgatttttaagtttgttcgctttcggatatacaaaaggagttgtacaagaaatccctttaaaaaaactcgcatgctaacttgacactatcggacttctaattgaagttcatgattttctaaaaaatatatatatccaagtgaattcccacaatgaatttcaccttagctaaatcgtataataacaataataagattaaaataacattcacccattgcaacacacggttatttttatagtttgtaaaaaataaaataaatccagtactgttcaacacggacagacaggtgtctcggcagtggttaattgcttctagcaatctagcttgatgatcaaatgaatgtttgctactccatcaagaaatcaatgcagttgtagtgcagcgatagcgcgtggaggcggctactaagtgagatcacagaggcagcacaaggtgattttccagatttaattaggaaataacaccggtataccacccagtagaggtttcaagcatccctgctcacttagtgcaatatccccatgatattctttccatgacaccacccaatcccaacttagggtgtatgcttccattaagggatgtgcgtggaattggactgtgataagagaagtcgtattccaagagaaagcacgcatggggtgttgaattgtggcagagggcaggagtgtttctttattatgactgaattttctcttctcctatggtgtaatgcaattcattccactttattgcgccttcgaatacaactatatacctccagtgtgtattaattaatgttaacattggtatgtggagttccgtccttacaactcaagcatatgtgctctcatacctcaaaatataattaaatagaaaatattgtcaaccaattaataggttgtagaatcgaatacaataaccaaacgtacaagagggggtgaatagtagcaacacgaaaaacaaaaactttttacagagctaaaaatttaccctccaacctaatgaagcccttggcgtagctggtctgactgtcgtgtacacaccagcctgaccgcaacttcaccgcctgcccgaccggtgtctggatggttgaaccactgcctccctgtactgccttctagctgtcgctggttagaccgcccaatgaactccggtcaaaccgttgggatccctaaaaacgcgtatcgacaaaactcttgaaagtacatcaactttattttatcaatatgtatttacaaagtgcacctaaagtactccactcaagtggttgtcacatgatctaggatgggatgctcccacctggcaatggtacacctattatacggtcaagcaagacagcaaatgcacagtgtagaacagtgcagtacgcatagacgcaagtagcgacgtacgtgggtgtcgcgataagtactacggccaaatggagcaaatactggagctataactagcatatccacagtgtgggtctagaaatacctctacaagaggagtaggaagaagatgcggtctaacatgcatgtgtcgaccatgaggaaggactatttttgaaacataggcccaatttgatcatatgcctaattttgtgtagtatatgtgttatcttggaaatggactggagagctataatattttgagataagtttgaaaatttttgaaatacttaagagaaatgaaatattgcctttgaaataaataaaaaaatattatattactggttacaataaataaataaataaataaatagttaaaaaaaatgttagagcaattatgttgaaataggtaaacaaaaatcaaaataacttgaaaataagactggtcaaagttacctgtgacgggtgagagtaatggcgccgtcacaggtgacctcacctgtgacatgccctactttccggctgatcacatatgacaatacctatgacaggccggtgagcagggcccatcataggtgatgtcacttgtgatggcgccaacactcccgtccgtcacaggtgactttgaccgggataagtagggttggaccgtttcccatccctctcagatccagatctctcactcactcactcactcaacactcgtcaatagccacctactccatgccaagcacctcccttgctttctcgacgtcaaccgttgtcctcccgccatcatcaaattccaccgagcagcacctccctgccctcgacctctccatatccatgacaccgggctccacctccccgcccttgactgccggcttccattgacagcctccaccgcactgtcttcctacaccgccaagtgatgcctccctgacgtcgatcatcaaccgcctccggcctcccactctcctcgaagaccacctgcctccacctcctctgcctccacaacagccgccgccttcacgctgccctcgacaccggctgccttcacgcccacctggaagacagccaaccactgcctcctctgtttccacaacggctgccgcctcccccacaccagtcgccacctcctcagctcccccacccctcgcatgtttctctttcttttaaatttagattgttcccattttttgtgatttaggttgtctataaataatttgcattgtttagaatgattttgagtcacaaatgtttagaaatagtttgatttaggttgtttagaagttttatgacttaggttgtttagaaagtttgtgacttaagttgtttattataaattatttaggttgtttagaattattttgatttaggaagtttagaaatattttgatttaggttgtttagagatttgtagacgtaggttgtttagaaatgacttaggttcaattgtcattaaactttgaacaacttaccatcaaaattgattactacgtcttacatgtacttattatttactacattgtattgttcaattgttttctaacttttttgaaatggttggttgtcgttatttttcaaaaggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctaaaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgagctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatccctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggtcgacaggtggggaggaagccggcgtggtgaggccggagaggaggaggaagtcagcggccgacgacgggcgatgcggcggcgatggtggcggcaatgttggacaagggacaggcgcagcttctccagcgcatgcgaggcgcaggacgagcggcccacggttgtcacagcaaggaggggaacccggtgccgtgggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattggcccttatataagccaaggatgcctggatttttcattttagatcttttttaaaaaatattttataaatagacccctacaaaaatttattcttggaatggatccttttcgcgccaacgacattgacgccgtcaccgtggtccaacaaagacgttggtggcgttccccggcctatcctctatataaaagctaaatcacttatatgaaggggaagtgaaccatttaaaaaaaggatctatttttaataagaaatatttatatgtaggtcctcacaataaataacattggcaccgatgacctatttataaatattattttacaaataagtctttttttcaaaaaatatttacaaataggctatcggcgccaatgacattggtgcactactacaggagatgtcataggtgtcggtttctaaagttaagggattaaaagtggacttattcctatttttttcctctcttggccagaccagcttttttccctttcagcccatttaaatttttcacccttcacaactgtgccgccaagatgagcacttccaattgtttcttgtcgtgctctgtcagcttctgtcccgaatgtaacagggtggcgcacgagttaactgtgttgggttgtaaaattgttggtgtccagggatattgctggttcctttaacttaataaaaataggtttcccataaaatagaatgatcagcatcctcccttctcctccgaaccacactgtccctgcacagccgagccggccatggcgccccgcccgaggcttgctcctgcacacgaccgcactctaggatcgcagccgcaaccacctaccgcgcacacgcgccgcaccaaggtgaccaaccgttcgacggcggtgaaagctaatcacgagccacacacacaagcatccgaagagtaatgacttaattatctaccaatgcttataagcgaaaatgctggacctttggtgactggcacaaatcgcagagaatgataccgttcacgaaccgtgcaatgtccaaccaacatgatcgaaatggtcatatccatctatcccatacttgtcatttccgtgatgacacccattcctaagtgaagaacacacacgatgctgtcacggcaagtactgttttggttactgctatgtaacatcagttaggatcgacctgctcgtttctcttagcttgtgtgttgttagaatgcagaagtgtgcaaattaacggagaaacagggtgaagaaagctagagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatccaacaagaacagaaaggtcacttattagacccacccggtcaacacattcaagatattacttccttcgttttaaattattggttattcagttttgtcctaaatcaaaggtttgtttcattaatcattaatttctaaaattaatatagtttaatatgattcagtgtttgacgtatgacagaactgggacagaggatgcagtaattattctggttgggccatgcaaaattgcaaattagctaggaccaatcgaaaggtgattccacatatgagttggtgcatagcatgctcgcgctagcacatttgacgcaaattaccaggtggaatcctatttcgtcccatattgttctttctttcccatgtgtatcctctaaatccctcgttttatccaaatattgttgaaaaggtgaaatatacccccacaaaaaaaaaagaaaaggtgaaatatgatgttctcttcaaacaacaactcatttttacctacctacctaagtagatcatgctagtttgatattggatgatatctctttcctttttctttctaacaattccagtgtagattacctcttcatgactgaagcaacaattggggtgatttggagcaaatcttatgttggttttccattagaacgaaagtgtatcacaattggcataacactgccaaaaaaaaataagaaaggttaccagttttgccatccccatggaccgtattccggtccaacatctagtcaagagttttacgtatacactctagtcaattgaacaagacaatcactagaatccaatggagaaaatccccgtgtacccctaaaaattttcccaatctttttatatttctgaattttgcttattcccttttaaaccgcaaattttagtttggatatcttcctaacctttctattagttgaccattattaaactcttatgaagaagtctaatttacccctatggtatggaaaataaataaatttatagagtatagaaatttgttgtatgagactttattgagtttgtaaaatgcgaggtagtatttatgaaaaaaaatatttttaaatatgaaataaaaattaatatttatcttctaattattaaaaattttgttcgtagcttatttattggttagtagaacaacatgttttctatatatagatatacgctacacaaatgatttttcataactaaataactaatattaatttttatgtcatatatacaaataaattttatgataaataatacctcgcataataaactcacagatataatagtctcaaataatacatttctatcttccaatactatacttcataattttatatgtttcttcgtaccaaagggcaaaatagactttttttttataggaatacaacagtcgacccacgattagctaacgaaaagtgtatgaaaaggatccaaactaaaattcatagatatacaagagaatgagcaaaattcagagacatggtaggaattacgtagagaaagtttaaagggtacgtacgcagagaattttctcaaagcaatgtgtatgctctcttagccggcgaacagaatcccggcgtcctcaatctctcttcaactcccaaactgaaaaactcaacaatgcctctgaacttgaagacaagtgcattggcgctgcaacaccttcagcagtttttctgggttatattcatccccttttatttggaaacaacgctagtaaatcggccgtagtggccatcatgcacgcgacacgatccgcaccgacgtgcgccatcccacacgtcagatcgtgccgtgcgagactcggactccacaacagactccacgattttgacgtgaactcacacacctaaagtcttacacacgacgtagctgctagccagctggcccacaagcaaaacaaagaaaagaacgacaaactacccgatgaggaacagtgaaaaatagaaaatgcctaaaaagacaacgccacagacggcgagattgacaacatgctctagatcctattcctagtgtgacatctcaaatgaactttgctgcgagagctataacataggtcatcagagggaagtgagaggcatatgtggtgatggagttagttgtaaatttatctcctttgaacttacgttagaggtaggtacgatagacaaagtagtaatgcaatggcggtgcaacatatccgcgaggaggcagcagcccaatgagatggagatggaggtaggctgctagcacatagcatagggagacttttaagagctatgtgaacggcaacaccagtcgaccacagtacaggttccatccgtattcttacaggtatctcttccttattttggtcagcatgctcagcatatacgactccatatcatgatattctttccacgacaccacctattccaagtaaagaaatgcactatactaatataacaactgagaatagagtgacttcacattcctatcagacatgaagtgtatgcttagacattagtccttatataggctaaaggaggtagcatgaggaaacaaacccaaacatgttaacataaattatgttgcgccagaatttgtgatgtgtgagcagggttttcaattttgaaattgtatttttgcctgggaggaccaaaatttcggaaattttgtggctgaaattatttgaaattttgacttattttgaatgaatttgaataaaatttgaccaaattcacaaaaatttgcaaaacaccgaaatttcgggcgagatgtgagcctttgcttgcttcagttattggcctacggtaacataactcttatattagtcacttactccctccgtcctaagaaaaacaatctctagctttaaacctggacatgcccatatacatgttcatagctaggaactgacttttttaggacgaagcatgtaaggaagaagtaaacatttggcctttttttatctcataccatcttaattgaagccctagttgaactggcttttttttttaatctcatacggtcataccatctttcaacatttggccgacattgaaaaaacaatcaggattcttcatacggccaaaagagtgatcagcttatttgttttcaatcatatctagtatggttgttcctttccaatattaatatgcttttgttcaacagtattgagtaaaaatcctcctgcctatcttaagaaaaaagagttttgcaatgcatactccagtcaatttctattcatcgagacacaatcacgagcaagtagcgtgtatgctctagatctcaaatggttcctgttgtcgaattcggatcaactctttggtggggctgtattaatttggtccgctgctatataatgtgcgatacattatcttcaacttgctccctaactgatgatatgatatgagaaattaatggtataatctgctccatatagtgaagtacgtacacccaagacctgtgtgtctgtgctatatatgtgttttggtatcatcagcaattcagctttagtggctagtacccgcaaaactcacaagtttgtgaatctcacatggcctagacgaatgcagagttgtgtgtaccaccagatcaaagactacaatcagaacactgctgagagatcttgtcttggcattcttcctggttcctttcattcctaagaaaacaaatatgcttcaaggagttccagtggtgcacaaacaagcaaaggtagactactctggtatagcggcccgccggaaggagatagagcatatacatgaacctaagagagaattgttttatctctctagtctgtaccaatttgcattaagttagtacaagcgttcaaggctactcgattttaatgtgtacatcccaaactgatcctatacaaatcgcgagtgaaaagccagacaatctgaaggaagtgagaggcaggtaggtgaggtaagaaatcaatgctactccctccgtttcataatgtgtctaattcattaacatctatacgaatattagcaatgctagaaaaatcttagattattatacgaatggagtaggactttgtgataccagttcccagctcaagaacaagcaaggaagcaacctagctgaaacataattctgggtattgcaataatttgatcaaaataggaatctgccgaacaaaagaaggtatcaaatgattttgttcaacttaatcttcattttctgatcgttgtagtagtctcttcttgagatatccaacgaagcttgcacgttttgaagatttgggaggcttgactccccactgaagcattccacttcataccatcatgacacgccaagtcccaccagatctacacacaattttcctggtgcctcttattcataacaaattgtatccatgtaaatgtaaatcattttttacaacacaggaaaggacaaaaaaaaaccgagtgttccatgatgtcgaagatatagaaatttgtacatgtgtctggttatataaatttggaagtcagttaaagatatatactactacaaagctttgtacatgtgtctggttatataaatttggaagtcggttaaagatatatactactacaaagcataagtaggggaaaggaataagttttccacgtgttttatatgaacacacaccaaattgtgaagaggaggtgcacatttacttaaatatggtatttacatgagataaaagggtttagatgggatttggatataacattcaccatcttatttaaaagggcgtcagttagtgtataaatacactaagtatgcgatagatgactaggaacacagttgttacatactccatccgtttcagattacaagtagctttaagttttttctcggtcaaaccttttcaaatttgaccaaatttataaaaactatagcaacattttcaatacaaaacaatcatattatcaaattatattaatgttagatttaatgaaactaatttggtgttttagatattgctaaatttttaaacttggtcaaacctaaagaaatttgacttggaattttgtactacctccttttttaatagatggcgccgttgattttttctcacatatttgaccattcatcttattcaaaaattttatgcaaatgtataagatataaatcacacttaaagtactatgagtgataaaacaactcataacaaaataaattataattacgtaaattttttgaataagacgaatggtcaaacatgtgagaaaaagtcaacggcgtcatctattaaaaaatagaggtagtaaattttaggtttattaattaataaaaaatatttatgtagcgtataaatatatttatattatatagaaaacatgttttagtactatgcacaaaataagctacatatatgtattttaaaaattaaaaataaatattatttttatgtcctatctaaaaataaactttgtcacaaataatatcttgcgttataaaatgataaatataaaagtatcatacaacaaatttccatactctataagtttatttggttttcataccatagggcaaattggacttttacacaagaatttaacggtcaactaacagaaaggatatggaagatatccaatccaaatatacaagagaataagcaaatttgactaggaatcctatatattttaggaactgccaccatctctatcgaggatggcccccaccgtcaaccttgtcgtcggaacccaccgcctcctcgtcggagcccacccgtgtcaaacttcactgacacctacatgtcgaccacaccaagacgtgctcctgctgcccggacttcgtcacccaacaaatctgttccaacctatcttagattgaccacctatcaatctagtcgttagccaaagccgacgaatcaccatgttgccttcatagttgctgaatgaccagagcgccacgtttggccatctctttattgaatgcaactcgccaaaaggcccgacccacccccgccggtgtgtttgattccaccgaccgagaatggcaatcacctccagcttcaaccaagcccgagtgtttggcctcatgtcaccttgttgaaagtagctttctagaaagttcgagtcaccagcccaaagtgtctgaatccatctattggatcgcaatttgcttctgccaccatcaacccgagcactgcatctggtcatctccttgttgaaaacatccatcgaacggttcaaaccaccgcctgaaatgttatatccaccgatcaaatttcgtttatcaccaccatgctccaccttgcgtgcacattcgtcccttcacatcctgtgtaatcgttgtagcgtggagcacctcccacgtacctctaccatggatttcccataagctctcatacaacttgttctaaagccggcccccaaatcacaattggaaactaaacatgaaagaaacgccatagaagagccaaatttgatgatgacaccgatgaatgatatttgttaacaaagttcaaccgaagcctatatccttgtggcactgattatgggtgctccatcgattcaggcatccaacattattacaatgtattagagttacaacgagcctcagccgaacgtcggcagccactccctctcgcctatggtaagtcacgatgcggttgcaacatatctacccctttatttaagagataggctagaatagagtccgacgcttactctattcctaacacctagtacaactctatgtcctaaactgtaaccgacatattcgacacaaactctaacaccattcaaccatgattggcctccattgaagccacaattaggcttagttttttaacactgccaaataataataagtttaccagtcaccagccagaagcactacaacatatcctcaccaccttcatgcccggcagccggcgacggtgctagctccgatccaacaccggataccagcatcatcaccacacacacagctccatcccaaccccctggtgcgctagagcaggctgagatgcatatgcctccttcttgcccagtcatacaccaagatccacaccatcaggttgaagtgtacaacaccatggatcatctgcgtgccggcacttccaacccacgacgacctcagcagccgtcggtttaactgaggattcaactttgcaggacgggccctgcacgagcatgaacgggatgagacggcgagttgagcgcgcccagttgacgtggtgggcagcatcatggtgatggcgaaggtgaagtagtacaattgacaaagcgaaaatgctgaggagggtggcctctgcaggccacagtgaaaatgttgcctggtgtgtaaagaagaggaataataacagacgctgaatgatgagcctttggagcctggaaggaacaagcaaattgtagggaaataaggcacgtatatatgcaaagaaattggatgagtcaatccatgcaaacaacgcgtgtcgctgtaaacaccggccagcaacgcaagcagatagctatcaaagacaccaaacagaaggaagtaacacaaaaacgagcaagaaaagacgaacaattaataaaggaatcagacgatgagattattggcagcggcattagacgacaccaacagagaacgcagcaacaagcaggcatcgatttgccaacatccttcgttcggacgaccataaaataaacagaaactaccactggtagaacggtacgtcagtaaatcaagaggagagggaaaaaattctagaaaaaagcagggaaaacggaaccccatgggacttagggagttttatgatgcgcgcgaggaggcagtggcccaatccgtcagataaaggcagggctgcaggctgctcgcactagaagactttacggagttccaggagcagtagcaccagttgaccacagaaatacagaatatgtttcatccgtagtctcctggggatctctaccctatttaggtcaccatgctcagtctgttttagcatgataatttttccatcttggttcctgttatggcattcagattaacgctttgctccagctgaattaggttggttgctatattatgggtgatacattattcttcaacttgctccctaactgatgttatgagaaatggtataatctgctccatatagtaaagtacactgagacttaaatcttctattccttcatcttcttcgactcaccatcatcgattgcatctctaattgacggtcctccacctggtgcatgcgtccccctctgtgtcgtcccttgactctcctctattaatttgttaagctttttggttatcataagcaaatcgatattatcagcagctagtactccaatcacagtttgtgaatctcacatggcctagacgaatgcatagctgtgtgtgtaccaccagaccaatcactacaaagtgaccactgcgataacctacttgtctcggccctcttcctggttcctctctcattcctaaggaagaaacaaatgcttgcagtggtgcccaaattaacaagcagagatagagtattctaatctgaaggggtaggagtatactccctccgtttcaaaatgttgacaccgttgactttttagcacatatttgaccattcgtcttatttaaaaaaatttgtgaaaaatgtaaaactatatgtgtacatgaaagtatatttaacaatgaatcaaatgatataaaaataataaataattacttaaattttttgaataagacgaatgatcaaacatgtactaaaaagtcaagtgtcaaacattttgaaaacggagggagtatatatgaacccaacagatcgagaattgtttgctctctctagtttgtatattcgtaccaatacacattaagcagtgttgaatgtgtaatttcagctgtggccccccaaagtgtttcaattgttagagcatctccagcagggacctcaaattcagcccctattcaatttttgagagttaagatcaaaaaactagatccagcagggaccctactagagccccaaaagtgaggaggccctcgaatcctcccccaaggccccagtcctgggggctccggagcacgcccccatcgtcattttttttggcgcggataataattttgcttcgcgcattttcttgttattcctgcacggctgcgacgacggatcttctccggcgagcaccgacgaattcccagcacctccgtcaagactgcccccgaaaggtaagacttttccatacctttcttgcccgtcgatctcaaggccttcggcggcggtccatgcgcatgcccggccgccgatctcccgccatctgcctggccacacgccggccgtcgcgtgccctccaaggctgcccgcacacacgtcacccacctgcacgctgtctgcccccacgctggcctcctgcccccattgacttttctagagaaactctaagtaggtcatgtgctgcgggggttcagtggtagagtactgatcaattttctgaataactctgttcttgacacaaatggacatgtggtggtagatggttctggtggagactgacttgtttttaataatttttttggagaattgtagtggactttgtcgtcaaggaaaatctaaattctcaactagtaatggttgtgtttagttcacactaaaattgaaagtttagttaaaattggaacgatgtgacggaaaagttagaagtttatgtgtgtagcgattgcaatggcttggagaataagtctgctggagtttgttagcagatgcgggagatgcggcgatcaggatctgaatgaccgcatcagtagcgtccgtgtgcgtgagtttagcgcaggtgtgtgtagctgaattcagagatttgcggatcgtgggatggcacgattttgcctcggattcgtttatttgtatcgagtataagtaggagtcttagctcagttttttcatttgtaagttctttatttagttgaatgaaaaaccaccagaaaattgccccacatttgatcgttctcgcggagaattctgaaatttctcagttttttcctctgctctgaatttcctttgttcttcgttactgttttagtctgttgccgtgccggacatctgcagtttgcacgcaatgtgttcgatcagaggttatcgccaacaaacagcatagagagaagttaaaggctacttcatccttatgggtatactttggactgaagaaaacaactatccgatgcaaacagcgattcagcgagtgaaaagccagacaatctgaagtaagtgagagacgggtggtgacgtcgtgtaataagttgtggattaatcttccctgaagttgagaggtaggtgaggtaacaaattattgctagaactttgtgttgccatcccaagttcccaactcaaaaaactagcaaggaagcaacataaatctatccctatactaattgggcactttctacgaactctcacgttaactataaagatctaaccattagattagattgacggtaatatcaggaccgtagatttaaactgtaaacatggacttttaaagtccaagcaatctagcgttagaaattggtccaccatccaatctctttaactgctttaaaggcccaaaacccatatatgtgcacgtattaatctcagccaccacattagggtattcacctacatcgatggctgccacggtattggcggacatcgctcccgacaagacggcggcaacttcgacctccttcatcgtgcacccgaggtttggccgcaattgcatgcaggcaaagctccatatcgatgtcgaccgaatgcatttgtccttgcggggtctcagctcatctattaagaattgatctaaactgatcctacagctacgattgctgatttacgtacacaagtaagattttgttcgaactttctccaattctagctgttcatctgcatgctcttcatctggctatgccaacatatgacctaataaatttcaggtgcattgagatgttataattcacccaaacaaacaagttcgattgcacccaaagagatcgatccgtggtcgtctcatctgctctttatgaaggtacgtaatttgtcaatttggatattctatgccaagttttgcttgcacctaggaaacatccatcgtaggcgttgcatctgtaaaccatgcatgaagataattcatgcatggttgatttgtatggtctcttatatgtatatatattcgaactttgttgttctatagctttctgcacattcaaactaattaatccatgcgtgctgcttcgttgtatccgctcattgttatttaagttgatgccatatatatatatataatttccaaagacaaataacacaacttatttgtctctcgacatgatataaatatatattctttctcacaaacagggatgatacaaatattttcttgagagttcaagacaagtacaattttatattaataattagacaattaaaattgtaacttcaagtttgacaagcagcagccataaaaatatttttgcttgacagtccaagacgagaacaattttaaatttaataattttgattagcaaactttaactaggactctttttatctaatccactataactccctattctaattatgacagagttctaaacatcttcgactatcaatatcaatgtagcatttattagtttaatcatcataaaatcgtacccattgattatgttggttttatattaaataaaacaggccatatgctctttacatttatagattttctaaaaaaaatgaaattaataatatggagctgtaccaattaaaccttggactacgtactatttagcattgctattaataatttatgaaattcaaaataaaaaatagcagattgtaacaggtagggattgattttatctaatcccactacaatgtgaaaataaattcaaacttaataactatatatcgatttatgaccatgctcaactgtcaatttagcacttattaatttaattatttaattcaaaactaacaagttattttaattctaatctactatattttaaaaataaacaacacatctgtagcataaaactgttcatattattgtaacaatatataattatacccgtgcaacgcacgggttgacgtctagtaatatgtaattctgggtattgcaattatttgcataaaaacagaagctgctcaagaaaagaaggtatcaaatcaatttgttcagcataatcttcaatttcagatcgttgtactagtctcttcgttcttgagttatccatcgatgcttgcaggttttgaagatctgggaggcttgactccccactgtagctttccacttctcaccgtcatgagacgtccagtcctatcagatctacactcagttttcctgctgcctcctattcataacaaatgaatatcaatataaattgtttttgagaacacaaaaaaggacaagtacaccgagtgttccatgatgtccaagagatatatgtttggttatataaattttttagtcgatcaaagatatatgtacaactacaaagcataggtaggggagagcaataagtagcaacatattttatatcaacatcatcaccaaatcgtgaagaggaggtgcatatttactatacgggatttgcattagataaaagggtttacatgggatttggttataacattcaccctcttctttaaaagagcgacactttggggaccgcagatattacatgaaacaactaccaatgcaattataaggcattggtatataaaagaaaacattagttcagggtggtcaataactcgtgttcacacgtattttttgaaccgtcgtctaaaagtaagggcatgtagaaatcaggatttttctcaagcagattccatgaccacccgtaaaaatcaattttcatgaatggccggtaaaaatgaattaccagattttgactttcgtaggcacaaaaggtaccaaaaacatattttaggcatctatacatggcagcgaaacataaatcacaagtcacatgattttacctatgagcttttcatgattgttggaaggatatgctatttgtttctcacttcaccattctaaacttggaatatacattttgcacgttgaataacttcaaatggaaatgtcatcagatgtaaacttgtagatcgcgttgagttatacacttttgacatagaacatgtctctatataaggtcatttggaaaactcaaaacttaattttcagtcactaatccataaaaaaagttgattcaataataattagtgaaaaaaaatgaaaactaataaacaaccatttctgtcagatggattaatgcgtgcaatatatatatatcgtcaacattgtcgaacaagcattatgcaaatactacctccgtcccataaaaattgcatttctagctaatttaggacaaaatagtaggattggaaaattaccacaataaccttatttaatgaacccactgtatgcacacattccatatatacaaatgattaaaaggaagtttgagagaattaacccatataattagcatacttaataaaattacaagcattagcagctcaaattatgtgagatggaatgaaacttatatagatgaatcaattggttaggccccacatggctagaaatataattttgtggaacaaagccttggagctagaaatgcaatttttatgggacggagggagtatatgcatattacacacaatattttacactgaaggaaatacaagtccatttattccaaatcccagaaaatatataagcaaaagtaggtggaaaaaaaacaagccaacagacacctcgatcgattaattatctgtttgtttatttacttacctgcagttatttatttatgtagcatcctatgaatagatgagcgagagaaacacacaccaatcgatttatctttgaacggtaaataaatttgtcagccatgggagacctaaagctacccaagagctgatgtctccctccatggctgtcctatctccaaatatcaccgcgatgatgacgcgcaccaccgcgccgacgatgttccgatctcgctccgacggaatgccatggagaggaccaccttcaccgatcatctcctcgctgatcgccagcatgatctgccctccacatttcatgtcccgagctgcctgccatctcctccgtgcgatctgcttgatgcaggacacgtgcagggacacggcctcgccgccgccgtcgacgacgtcggagttgtagtagcaccattgctcctggcggcggaggcggcggcagcagtgatccgggccctcctcctcctgtctgctgcataggctgcacttgctgaacgccgcgatgtcgaaggcgaccccgtcgatagtgatcttggctagtccctgttgagaatagtcccacgttacttatttatggggttgagccaacttaaaagtgagggaatctctcacctctttaactagcttttgaggcgtagcaagactttctttcggttggtccaacgtctcccggttttggaccgggagttcctgcaggctcgcacagcatgggtggaggtcgaggttggcgcctgagcagtggtagacgagaccgaacacatggtcgccgcaggtgtcgcaccacctgccgccgctttcgcctctgccaccaccggtggcggcggggtgcggtttctccggtcgtccttgcggtggcttggcgagaagctcgaacgtgcggccgaagagatggtggtagagcgtgctcggcgcatgggcacagaacttgtgcatgttgaggtcctcgcaggtgaggcagtggtacctcggcccgtctccgggctccttgcaggcgtcgcacttgaacggcgcttcgccggtggtggtcaccattctaagcttgtgctccgggtggctggggtgggtgatcgtcttcatctccggcaccataccgttgtttgttccattctggttctcgaactcctccgcatcaccgttactttccccactgtaactagcgcattcaatgatcccgatcagtaaattttttttattatttgggacaaaactcgatcaaactttaaatatcctgacaaccatttcttttttgttagaactacttgatagtatttatagttttgtacaaggacacaaagtctccaagaaacaacactcaagaaataaccttaataacacttttctactatactttctccgcccatttttaagtgcagttgtggttttttttttccaatgtttaaccatccatcttatttgatattttttatgattagtatttttattgctattagataataaagcatcactagtactttaagcgtgtcttattttttttcaattttttcataatttttcaaataagacggacgagcaaacgttggacacagaaatcaacaactacatttaaaatagaacgaagggagtaatattcgtataaatatgaacaaatatataagtttattgaagtacttttcaagattaatctatacatatggtctccatatctgtatgagaaatatttcatagtcaaatattttaaattttgactttagttttatccaaaacgataagtattatcgtttcggagcaactaatttataaaataataagtttttgacatctatccgttatattattaggacgctcttctaccgcattcattctagaagctagaaatttctagaaaaagaaaaaaatcttaacagttagataacggtacatatagttgtataaaaatacaattatatctacagaaatataattcaagagttatatatgaaatctaagcctattgaaatagaagttaagagtggtatatgacattcaaaccttatagaaatagaagctaagcattgtatatataaaatctaaatatatttctacatacaatgttaccaatagaatataaaatttcagaattgtatactaaatctcactctatacgtgaattatctaggggaatcccctagctcgttatgataatttccttatgacataataattgctggtagtttttcatgtacggcgttgtactttccaatcataaattaataatttctatcatttaacacttttttcagcgtaatacatatcgttttatatttttttaaaaaagaaataactgaattatttgcacgtggcttttttattgaaataactgcataaatgtaatactatggaagttctcgctgtagcaacaaatttagctatatgatttccatgtgcctcaaacatatgttctgaacaatgattatggtcgaaaatcactgcaatgattctaaaacgaaacttatttatcaggagggaataaattcatatatacacacctgctattatcttgtgcagatgcaccttcaccacaatcatttgtcggcgtcccgtcctccattagaatctcatacaaattagtcagagtctcgtgtgagtgtgacatcaactccttcaagcacgacaggtgcacgtcgacgagctcgtcgccgccgctgcggcggaagcggcaggtccagaacccgtgacggtacccatcctcgccggacatgcagacgccgcaccgtcggcggggagccgccctgcggcagagcttgacggcggcggcgccgcgagctgccgccactggcagcctcagcctcgcgcagcgcgggtggaggttcaggccgacgaggccgtgcccatcggcgcagtggtaggcgaagccgtcgccgcgcaggaggtcgccgcacgcgtcgcacgccggcctccagccgccgccgccacggtcgtcggcggcgagccatggcggcggcggcggaggccgctcgaggaggcggaagtgccggcccgggagcagcgggtgctctagggtgagcggcgcggtggcgcagcacgtgtagagggtgaggtcgcagggctcgcacctgtacctgcggcggccggcggcgagctccttgcagccgccgcaccggaaaggccagtgaccgtcggtgacgttgtcggccagcctcagcttgtgagggtgaaacgggtgagtgatctccgccaccggaggatcacccaaatccggcgtgcgtaacatgtggttgtcgttttctgttgaaatcagcaaattcaagatcattaattcattattgagcaagccatgcaaatttgagtcactagaaaacctatcggtatagccgatttgatcggtgctcaccgaaatttccgaaattttgaataaagtatagttgaatttgaacaaataataccaaaattcacggaaaaatttaaaatttaaaaatttcggccgaaataatatcgttccggaatttccaaccctgcactcgatctcgttagtgatacacatatatactcgcttcaattctgaacatttgaaagtttaggacaagatttgataaaaacatttaaaacttcgaccgttaatgaatttataaatatttacttgaagagatttgctccggttcaataaaaagtaactcgagttaccggtattttacggtactaaatcgttttcgatcgttggatctagctgggcaggatgggcgttgttagatccaacgatcgcaaacgatttagtatgagtacctcgagatactttttgtttgaccagagcaaatctcttacttaaaactaaaaagtataaatatggtatgagcatatttgactccaaaagtattatatattatcagttgtcaaagttctagaaaactaatttaatcctaaaaattaatgtaaactattgtcccatgttgaattaattatattccaataaaatttatgtccatgcggttatatgatgaccaattcaaaaaattttggattgtattatatgatgatcaatttagaaaggaggatgtatatagtaagtgaggattcttaaaagtagttatgttcaaattaaggatcgatggatacctctggatcgaccgagtcagcctcggagaagatcggcgtgaaggtttatatcctactcctgcccgtaccacaagaaggccaacgtacaagctgcagatcgaaggaatatgagagagatagactgagactggatcttctatttatacaccaattcaccagccggcatgattcctgtttcaaactaaactatatgcgcactcagaatctttcactaattgtatatatgcaaatatatacgtatacgtgcagtgtcctagtccgagaagtctctcttaacaataactggtagatatttatatttatctacacatctacgtcctgaacagcttgctctacttcttccggaaaaaaaattctggacagctaattatgcttataaattattactcgtttttattcattcaaacttataacggaattagtcttccctttcacttcattgaaaaacaaaatttacaacaaagtgtcctggatttcataaaattaaacgacatgtcgatcaatactcacacgcacactagaaaagaattggctataactctttgagcaaaagctgagattctattctattatctaaaaaagacacactagaaagaaatttaactttcagaatattcagcctgcccatatctgtaatagcgcgcacctctttgcaaaacaaatcaacaaaaaaattctctaattatttatataaaaactattatatcgctgtttctcaattttttatctcaaacaatgatatatggaagttttccaaaaaattgaaaaacctctcacaaatagctaaggtaatattagacaaccatacaacctacttgagtttgtgagatataaaattgagaaatataagataaaaagatataaacacgagcaatggtatttattaattttatatctcattaacgaacatgagtttgttcgtataactttgttcggttgtttattatttaaatatcacctatgtgtgtaattgttttgagttttcaccatatatttgccctagataaacaattagcaagttaattgttaattagcccatccattcgcaaaggctactgatgttgtcatttgtataacaaaatacatatctatttaagtttttccaattatatgcaactagttaatatttttacttcccatatttttttattaaaatggcagttgcattttctaattattaaatgattgtttttacatatggaaattatattcagttataaataaatctactttgtctaaattaataattctaaagttgtatttgttatagttataaaattctaaattaataattacatagtgtttttccttctaaattatatatagaatcaattccgagctagtcacataactgaaatattagggaaaatatgtggtggaaaccacttatgtagtggaaatttgaaaactgccactggatcgaaaaatagacgctggaaattcatccacgtcactatgagtaaaaaatttactcactgtaaaatttttactcatgagcaaatccgtgagtaaatttttacttgtgatgaaacgtacgaatcttgtatgtctatttttcaatcaatggtactttctaagttttcatttcatatgtgattcccaccacatattttcccgaaatattacgccagcactacctagataattttctttgactaatttagttaaaacgacatgcgcaaagttagcatagttgagcggattaggtttatggtggtggaaacttttgtcgactcaggttgagtccgcgactaagaacatgtacaggttcttatatttatgactaatattctttcggtaacatgcgatataacagttaaccatgaggcacatatatatagtgagttcgccaatctcaatatatgctgaccttatctctcatctcagaagtcagaagtactcataggaaaaaacgtatacctgtggacgtttatatagttgagtgtgaatgagaccctaggtgcctatgattgcaatgcaatatatatgttccccaataaataaataaataaaaataacacgtatctgttagtgagatacttgaatgacttggcactctagctagctagttataggtttagtgaatcgcagaaattatatacagcagattccgtttgacatggattatatacaatagaatctgtttcacatgggtacgttaaatatcagagattctgtgggacatggattactatatatatctaccagatattcacttcgccaagcaacccattacgtataataaccttcttctggacgtggatcgtgtttctctaaccctttctaacctgatatatattaacaaataaccaatttgaagtttccatttgtttctatatatatagggaatttggaaatattagttgctggtaataaactgcagagaactaattacgatgccaaggaactgcaggtacatcagatccgtttaattatttgctgtcaagtctcaataaaaaccagtgaacaaagttacttcgagaaaaaaaattagagtatatatgtttgctatattgtcacagctttttttttttaccggcaaaaaaagtagtgacgaactgttgattatgaatagcattgccttcactggtagagaaagcgtttgtagttccggttcgtaacccccctttaatccctgtttccaaaccgggactaccaatccgagactaaagatcgctatctttagtcccgggtgaaataactgggactaaaaatcgatctttagtcccgattggtaacaccggcgtcccggttggtaacaccaaccgggagtaaacaaccgggactaaagatcgagctgaccttttttttttcatgtccctgttgctgcatggtttatatatatgcatatatatgtttcaatacatatatatgcacatataatatatgcatatatatatattatattatatttatatatgtttcaatacatatgtacatatgcaaatgcatatgtatatatatatatatatatatatgaccaaaatatatatttacattatagaaaatgtgtacacatgcatatagaaacatagtcatgtattaattacaatccattatatgtcctagctagctacgatttcgacgtagtagtagtcgctagctcagaagctaaggacctatgaattgtgtttccgtcgtagtagaattcacccttgggatcaaggatttgtttattgatgaatcccatgagttgttcttgaaccgccgcgataaattccttgtgtgtgatcaggttatccctcatacgaataaactatatgaatgtatgaaatttattagtaattaaacaacaaatcgatacataatgaaattttaaatttatttgtacgtacatcgagctctcttgtggtgatgatttggtctgcaaggcagtggcaatactcgcacacgtagtagccgcacaagttagttccctgcttttgctttgcgcactataaataaatgacaaacgacgagagatctaattaatgtacacttgtatgtatttgaatcagagaaatataaatgtagagcatatgtactcacaggaaatttgaacttccgcctaagtctttctctccatttgccgcggaccaaatgatagaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacgttacaggcttccaggtcgaagagtaaaagcacccagtggaatctgcaatgtgcgtgggatgcattacatatgaaacacttagcaagttcatacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgccgttaggccctttgaatctccattctacaacgataaaagggagtatatattatatatagtctacttatatacaaggacctaattacttaaaggagacgtagtaagaaatctaactgaatgatatacttacaaaatccagcaactcataatagagacgtcgagggcgtccagctggtatagttcgtagattcccttgaaattgatccagagaatgtcatctccttgcaagaagtccgtgtccctgatccttgctccaatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgtctcctagcaattgatccgtagttagcccggtgtcattaataaattcttgtattccaaaatcttcaccagtcaccaacggctcgatctcctggtttggttgctctccaagctgagggactggtttggactttccagaagatgctttcttgagcgttcgctcatagtccgatagctttatggcctccttggcaggtgcagacatacccctgaagaagttcctaacactcgggtctataggaatcttcttttctggacttcgaggcttgaattgtctgttgacttctgatgccacgtaagcttcaagctcctcttgcgtgcaatcgtaccccgggtccttgttcttggcggtgtcaactttcgccttctttattgcccttgtgggggcaggcggtggagcttgggttgcccttgacttggaaggtgccggaagaggagcctaaggaggagtcggtgcaggagcctgaagaggagtcagtgcaggagcctaaggaggagtcggtgcaggagcctgaggtggagacggtgctggagcatgaggaggagacggtgctggagcctgaggaggagacggcggagccagaggagatggtgcacgagacgccgcttgtcgcccagggaggatgatgtatcgcttgcgccatagaataatggtgtggcttgtgtctcgtagatgcgtctcaccatctcctccagggtaatccagctcgaggtcctcgtacgcgtcttcgaccaactcaacttcgaccttggagtatcctgctgcaatcggcctacagtggtaagtacctgaagggtccgttgggatggccatgcccgacgccaccttcatgtggtgagtggttatttattagtaatcaacatatataagcaacaactagcggaatggccaaatctaaaatctataaactatgggcttacctttattgataagttcttgaaaggaatatgcagctcacatggtgtccgctgagtgatgtcatcaacggggcaggtggattcgtcctgcgtttgcatggcgtccatgctctatgatcctacctgcccctttgaggcgcagctgctacggtttcctgacgggctcaccattgcaggaggaatggtcggctggggatcatgggaccgatgtgcggccatgcattcatcaaccttccttgccacctcctcttgcatgctgagctcgtagctcgataccctgaactctagatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggtgagtgacagctcgtccttctctctgttcggtcggaacgtgccctaagaagaggcttccactgtgtctgttagtcgacgcgcagcctcgcgtatctgatcgccgaagaccagggagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctccgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtagaccgtactaacaggcacgttatcccgcgcaacccaaccgctgtgacgtacatagttcttggcggcttctgccggggcactaggtcggccgtcttcgtccacttccgttatgatgtgccgaccctcaagcttcttcgtggcacctcgttgcccgcgtcccctcttctgtccaacggagggttgacttccactagcctcctcctcctggttcccctccacatccctttccacgtgcccctcctggttcccctccgcatccctctcaacgctcccttcctcgttcaaatactggtttggatccttgttcccctcttcttcgttccagttctggctgcttccctccgcgattgtatcgtacaatatctgttcctcattgcgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatactaagtctaattacatgcatgataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattaaatccaatagtcttaattgcattacaaatataacaatcatatatataattacgtcacttgcctgcgcgaattccttcgagggctagctaccactccggcttgagggacgacttcgacaacgtcttttctgcaggatacaaaaagatgtattaggataaacgcgaagtaacatatattgcatttgacgttcacgtttcgttcacgatcgttcacgttcgcgttctcgttaaggtcacgtttcattcacctacgttcgttcacgtacgttcgttcgttcacgttcattcacctacctatattgcatttcacgttcacgttcgttcacgttcatgtttcgttcacgttctcgttcacgttcgtttgttctttcacgttcaattctcgttcacgttcgttcgctcgttcgcgttctcgttcacgttcgttcggacgttcacgttctcgttcacgttcgttcgtggcggcggggcggcgcggcggcggcgtggcgccgcgcgcggcatcgacgtggcgcggcggcggcgtgcggcgcgcggcgcggtggcggcgtggcgcgcagcccggtggcggcgttgcgcggcggcggcatcgtggcgtctcgtacgtctcgtgtcgtgccgccgcggcgtcgtggcgcggcgtcgtgtcgtgacgacgtcggcgtcggcgtcggcaaccgagagggagagagagagagatcgagatcggagagagatagcgatgagagggaggcggcggcggctctcaccccagagatgcggcgcggcggtggaggaggcggaggcggcggcgacgacgacgagcgcgagacgacggcgagatatggggatgccctaggcagtggcggtgaaggagaagtcgagagagatcgatcgggcaaaaacttctaagtgttggtggagaagacgagggcgcgcatcaggaatatatatacccatagatctttagtcccggttgatgagaacaatctttactcccggttgttctcatcaaccgggactaaagatattttcccgctatttccaaattctttttaaacccggttaggattaagaaccgggactactgataagcgcactgaatattattttccattacatatgtgctcctaaaatagaaaataatgctttaaaattattaatgacaattacttcgaaaaattattgttgtctgtaatgaattaagtggataaaacgtaataagcaaatatatgatttaaaattaataaaaattctaataatcatatatacttagcatatgaatgatattaaattggtaaaaactctaattaacatatgtatatacatacggcatgatttaaaattaataaaaattgtaataatcatatatacttagcatatgaatgatattaaattaattgttaaaaactctaattaacatatgtaaatgccacatgcatgatgtaaaaattttgaaaattcgaatagtcatatataattagcatatgaatgatagtaaattaattgttaaaaactctaattaacatatgtaaatgctacatgcatgatttaaaacttttaaaaattcgaatagtcatatataattagcatatgaatgatagtaaattaattgttaaaaactctaattaacatatgtaaatgccacatgcatgatttaaaacttttaaaaattgtaagtatcgcatataactagcatatacatgattaaaacctctaataatcgtgcataattaacatatgccatacatcaattgatttatatggataatcaatacatccaaaatagtttacatcgtgtacacaataattacggcaatacatcggcggtgacagttgaccgcacgtactttttcctcactattgttccctccttgtgatcgctgcgtgagtaaggggtgtcttcatttgataggaggatgctagggtcaatcatcaccgtgaaagggggttgcccatccaactgatcgtaatcctcgtcagtcttgtcctcagctccgacgatttttcttttgactaggagaaccacatgacgcttaggctcgtcaggccctctgcccttctttcctttgctagacatatccttcacgtaaaagacttgcgttacatcattggcaaggacaaaaggttcgtccgagtatccaactttgtcaaggtcaaccgttgtcatcccactgtcatcaatcattacgcctccaccagtcaacctaaccgattggcaccggaacagagggaccttgagaggaccatagtcaagttcccatatgtcctcgatggcaccgtaatacgtgccagttgttccatcgtgtcccatggcatcgacacgaacagcgctgctttgattcgtgctcttcatgtcttgggctctcgtgtagaatgtgtacccattgatctcatatccctggaatgtcgcgatcgaccaggacggtcccctcgccaggaaggtaagttgttggttgatcgactcgttacccacgagatgttgtagtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaaggtcttcgataaattctacgcaaaattcgatgacctcctctgtttcataacccttggcgatgcttgcctctggacgagcacggttacgaacatacttcttcagaacgcccatgtacctctcgaaaggaaacatgttgtgtaggtacacaggcccgagaatactgatctctttgacaaggtgacaaagcaaatgcgtcattatattgaaaaatgaaggtagaaatatcaactcaaaactgacgagacattgcaccacatcattctaaagggcttctaatctatccggatcaatgaccttctacgaaattgcgttcatgaatgcacatagctttgttattgttgcccggacattgtctggaaggataccccttattacaactggtagcagttgtatcatcaacacgtgacagtcatgagactttaggtttgtgaacatcttttccttcgtggagtatccagacggcacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgtctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggatagtttgctaagtgcaggccaatcgttgatggttacgaacagcagcgctcgtaggttaaacacctcctgtttgtcctcgtcccacacggggacaccttcctttttccacaacagtttaagatcttcgaccagtggtcttaggtacacatcgatgtcgttaccaggttgcttggggccttgaataataatcggcatcattatgtacttcctattcatgcatagccaggggggaggttgtatatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcctgtcctattgacgctcttcaacatgccatcgcatcattctagcattccccttgttcctgaacaaacgccttagccgtggtattatagggaaataccacatcaccttagtaggaattctcttctttgttagctgcccgtcaacttctcctggatcgtctcgtctaatcttgtatcgtagtgctttgcaaacagggcatgcttctaggttctcatactcctcaccgcgatataggatacaatcattcggacatatgtgaatcttctgaacttccagtcctagcgggcagactatcttcttagcctcgtacattgtctcgagcaatttgtttccctctggaagaatgttcttgacgagtttcaataaatcgccaaatgtcttgtcactaaccccattttttgccttccattgcaagaactccagagtggtatccaactttttgtgcccctactcgcaacctgggtacaacgacgttctgtggtcctctaacatcttgtccaatttatgggcccccttttcactttcgcagtcctccttggcgtcctgcaacatctgaccgagatcatccgcaacgtcgttaccatcagcatccctttcctcctcgcctgtttgatttccttcaaatccaacgtactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatacttcttctgattcttagacttattgcatggacaacgaataaaacccctttgcccgttagcttcggccactctcaaaaaatagtgcacgccgtcaatgaactctttggaccgccggtcagcgtacatccattgccgagtgtacatccattgccgatccatctacatgagtcaaaaaaaatcatacacaaataattattcttacaataatgacagtcatacaataattataagataattacaaactctttccacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttctttctcaactattttataaaaccttctttagcaaatcaactaaatttctatatattctttcttccccacacaaattttctctctcatcaacttacaactaaattttggagacaaaaaagtgtgcaaaacatagctgcaaatgtaatatgacaaaaaaaaaacactggaggatgaagttgcaaaccttttaggcacctccgatttgtatgtaatcaccaaaataaattcactagaaattttggcgtgacctcccctcttttttgaagaaattttgaaacttgctcgggcagctggaggagaaagaagacatatatataggggtgggactttagtcccggttggtgttaccaaccggggctaaagatccccgagctctttagtcccggttggtaagttacgatctttagtctcggttggtgttactaaccgggactaaagatcccggggggcctgacaggccctgacagcatttgaaccgggactaaagatcaagttttagtcccggttaaaaagggtaacgggcatatttgatctttagacccggcatatttgatcaaccgggactaaagatcatctttagccctggtttttattgtatccgggactattgtggaattcggccgaccgacgaaagatggtttctccaccagtgcttttagataaatatgtggtcatcctgcagatatttacatgttttttaatgtaaatgaatattattgtcatctcatatttactgagcttgaactttcatctcttgttaatttgatatatataacaatgcatggacaaactcatgcagttcacttgaacttttagagaaatgaatggattactgtgcagcccgtcaattatattggtttttgtttatttgtaattttggctcttataaatatcgtatactaaaaaataaattccgtgaatgttaatggacttgcactggctcttattatattcatacataatgatgaaatgcactttacattgatggagtaatagaattacatattctggcacataatgataatttcactggaaaaatatgtaactattgatgtgccagatgtaaccgagtggaataattaacgcagcacaactatacacaaattttataaaaatatcaagaaacatcaactggtatatagaaactttttatgtagaataatgtttcctagctctacaattatcgaacaacagagaaaagtaattatattgagataaactaaaataccaagcctaatatgtcttcagttacctactagcaaacttacataagaactttttgtatcagagaagggtatttttttacccagcctctatatcgccaatcgaatatatgcagccttttaaattggaaacttagccctttaaaaccacttggctacatacccttttgcaagcacataattgattgcttatgattaggaagctacaagaattatatttgaaacagattcccttgtggtggttagcaaacaatttgataggtcaatccatactacattgaatcaagatttgaagttcaaattagttggttaatttccaagagatgaagttttgttgggtacgtcgaacggcgaacacggtacagcacacatgctagccattagcgaaggtgtgtagcgaaggagagtatttcttctcgtgttgctttacaacctgtgtttatatgttcctgcaggctttattttacctttccttgataatgattgtaagcaagattatatgtagtggaataaatctccattaatttttaccaaaaaaaaacaagtgcaaacctcgttctacgatatttttctctttttccttttgagaactctgattctttcttgacttgtcgaaccatacaatgtatataagaccagaaaaaagaaccaatatctacaacctacagtagatcactatcatcgtaccctggcaaagagaaaaaaaaagtcactgtctacacatattatttctttagtttttgaagtaatttcatttgtcaactcaaatttactgaccacttcaaaattccacaccttgtaagttgttatacataataacgactctaggtcgtttatctattttggccctttaattagttatatatcccatattatgctcaaagtttgtccgcaaatgttaatggaataatattgattttgcagtcgtcatgaataaatggacattggatgcaggaatctatcgggatatcgtcattgcgtgcacttcgaggcaaaacccttgtagattccctctatatatagctttaataattctttctatgatgtatggtttttattattaaccttttacgtggtcaattatctaaaagaactgttaagtgttcaatgtacatatactattgtgagtattgtcagttcaattgcagttgacacggaataattacatgataattaccatgcatgcaaattaattgaattataggctaatggaattgttccggccggtgggtattctagcacatggataactcaagcagatgaaatatattgatgtgttatacccactggaataattaacgcggcacaaaatgtaactagcctctctgctatgacaaactactgagtttaagaaaaaaaaaaagaggaagaaaaaagagaaagaccggtctactggaaacttgccttagttaatttgggccgttgtttcacacattcgttttctttccgttttcctagtgaagactgggctgtgactgtgagcgatatacttcgacaggtcggactaagttcacattaggtcctcaatttgtcttccagccatttcatgcttgaaccaaaaaaccagatataacccgtcctccaacttacaaaccggtgtaaacaagatcgcttagcagtattatctccagttttagctaattacgtgtctcctatgacttggtcttcgtcccacgtgatattgacataacatttacacaacaatttgatcccaaaaatagaaaggacactacttaaaaaggaattttccgtgagatcaaaaatggttttcacgtgcgggtgggccaactgcacgcacccaagtgtctacaaaaattgctatttttgcgtatgggtgggccaaccgcatgcacccaagtgtctacaaaaatcgctatttttgcgtacttaactctgacgcgatctctttttctctacctctccatatcttcttcgccgtcgtcctccctctcctcttgatccccctcctcccctccctctctgcgaagccgatgacagctgcgatgaaaacgacggcgggcggcggcgccctcccgtccgctgggagggaaggcggcacgcagcggcgcacgagggggaggcggcagacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcattctattccttgtctctcttgtccgagtactgctgccatggcatgggtgttgctgccatcattcgatgtacgatgttcgatttgtaaatttgtggatgattttgttgatgattatgttcatttgatctgtgatatgtcaatttgatgtggggatttaatttgatttaggaatgtcaggagcaacttgacgtgggatgcaagcagcaaataagaataaaaaaagaaaaaaaagtattgttaacaccaaccgaaattaaagataatagtaccaagtggttggtgctaccatctttaatcccggttagtgttatcaaccgaaactaaagatatttcaaccgagactaaggatacccagctttagtcctgaattggatgtctgggttgcatacccaaaactaaaggggttaccaatcagaactaaagatgggttccccactagtgaaaataggtatggtcagtgaaagcaaaaattcaacagtgacatgttacacaaaagagcacccaaatacactaaaaacacatatatttatgtaaaagcaatctggtataaatagaatggttccatgttatttaattaccttggatttatcctaaatatttggtgtattcctgccaccaaaaagtgtgttaccgtacaacaaagtgtgcatggtatgaatatgatgcatattgatgcctaatctaacaataaggaaatgtgaatcctccgtgtcactactacaaaacactagtaggtactagctcatttaaccgtttccacattggataaaaaatatataaaaccagcacatttaagcagctataggtgccgatatggcattaataatataggtgacactttttagaaaaccggtacctatatttatatgatatggcattaataatataggtgacactttttagaaaaccggtacctatatttatattataggtgccgattctttaaaagattgacaactttatgaaactaagctgagctgtcacgggtgagactccttttaaccccaccaaccttatcgtctctcgcactctcccatcgcccccatcccctcctctctcggcctgtcgctgccgcccatccactccagctcacttctgcgtgcatcgtcgccgccgtcccaatcctcacaaccttcaccactgcaccgcccatcatcctctcttcccacttcctccacctttcctgcaactgtggcaactcccatccactctcaccgcatccccctactaactacttaagcttaacatgcaaagatgtcacatcattattcactaacaagatgccacatcatcatccactaattaacaagatgtcacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattcccgcagcaatgcgcagggtttcacctagtatttatattataggtgccgattctttaaaagattgacaactttatgaaactgagctgagctgtcacgggtgagactccttttaaccccaccaaccttatcgtctctcgcactctcccatcgcccccatcccctcctctctcggcctgttgctgccgcccatccactccagctcacttctgcgtgcatcgtcgccgccgtcccaatcctcacaaccttcaccactagcaccgcccatcatcctctcttcccacttcctccacctttcctgcagctgtggcaactcccatccactctcaccgcatccaatggatcggcggcgatgacctcagtgtggagatggtgacgacgcacgcatgcatggagatcacgctgctctcgccggtgggaggtgattgggggtggggtcaccggggatgacgcataggcgatcgtgataaacgggaagatggcaaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtgttgctttgttactgatgggaaataataattgaatatttctatctgtgatgtgaatggagattattgatgctaaatcaatatagagttcttgatctgtacatattgtgtatggggattaaaggcggcttgaagaaggtagttggatgcatcggttcattgagccgatgcttctagtctgtctctgttttttttaattgtgggaagtacaaaaggtgttggttctaccaccagcaccaaataaccattggtcattggtactagtagataaatggtgccagttgcaaaaccgatttttttgtcaggtttgcaacccgacaccttttcggtactatgtattagtgtgtgccaatcagtcacaactacacaactatgattcatacttgagtcataagatatttgggcagaacacaataagttaaacaacgatatatttaaccagttctcagtagcaaccgcatgcaaatatatacacacacacatatacacatgcacacgcattattttacacccaaggatatacaagtccatgccaattggaggaaatcaacaaaagcacaaattaactagaaaaaaaaaaactagaacaaaacaatccaatgcacaccgattaagttcttgttttagtttagctctgaatgctaaataaatctgcaagcccctggagggataaagccaccctagcgttgtctcccttgttggcagtcgggtctccgaaaatcaccgatatgatgatgcgcacgacacccccgacaacaatgcggtcttgttccgacgaaatgctcttgagggggccctccttcatcatgagctccttgctcgccagcatgatctggcctccgtgtttcttctcgcggcccgcctgccatctcttcccggcgaggtgcttgacgcaggccacgtgcaggtacacgccctcgccgttgatgttggtgtggtagcaccacagctcacggtccggccctttctccttcttgcacaggctgcacttcctgggtgcccggacatcgaagtcgtggccgtcaagggtgatgggcccctgcaggctcgcgcagcacgggtggaggttcaggttggtgccggagcagtggtagacgaagccgcgcacggagcagtgatagacaaactttacaaacttcaattgtaccaaatttagactccttctaaattcgactccgcatcctatacgcacacaatatctccatcatatgccatatagaatcttcaccaaccacatgcattgatgtttagcctaagcacgccgtatgatatcctgatcattcggacgtcatcttctcccaagttgactcctgattcatcatcggcaacattctctcgaggcattaagatcacctacacatgcatcaaccaagaaaccatattctgagcacaagctatctccaacttgactcattgttagtaaacaacagtattacatacgcatagtatccatctagaagtcataaacataaattatccacggatatccaacaaaacaacccgaaaccaaaactgacacataaattatccactgatatccaacaaaataacccgaaaccgaaactgacacagagtaagccgatcagaccgcgggctggccggtctgaccgcacacatagctccgatctgaccggcagcacctgcctggtctgaccggttatcacctgtcagcaatatctcttgttcacctgcaaattcaatcatctccaaaaccactccaataatcctcaaatattaaaaccaataatctcatatgtcaattgttcatcacagaataagaatcaaacaaactttgatttaatctcccccttgatgagcacattggcaaactcatcaaaaatgttttagtgtttggaaaaataaaaacaaaagtggtaaaaagcatcggagtactcaaaaatccagaagaaaacttctttcgttttcctttacctgaaaaacatgcacttgtatctcttctccccttttgataatgatttcatcaagcatagtaattatgtttattaatattcaagagcttagcattatatatatatatatatatatatatatatatagcacatcatatcatgtgttgcaataaaaagaaaatgaacccatccaatatataacaagcatataccaaagtataatcatgaaccaaagattttacaattaagttcaaatcaccaatcaaaattcatgatttcatacaatttataatgcaacatgtttacaagcacataggttgaaaaataaaccctatacatatatacctattacatttatcactctttatcaaattatttaatcagtactcagtagcaaactgcatgccaatatatatacacacacgaattattttacaccgaaggaaataaaagtccttgccaattccaggaaataaacaaaagtacaaacaaaacaagccaatgcacaccgataggtcttttgttcttttcaaggagagtgatcacacaccagtttagctctgaatgctaaataaatctgccagcccctggagggataaagcgaccctagcgttgtctcccttgtgcagtcgggtctccaaatatcactgagatgatgatgcgcatgacgccaccaacaataatgcggtctttttccgatgaaatgctcttgaggggaccctccatcatgagctcctcgcttgccagcatgatctgccctccatatttcttttcacggcctgcctgccatctccttccggcgaagtgcttgatgcaagctacgtggagatacacaccctcgccattgatgttggagtgatagcaccacagatcgcgttctgggcccttttcctgcatgcaaaggcagcacttccttggtgccccgatgtcgaaggcaagcccgtcgaggatgatcggcccgtgcaggctggcgcagcacgggtggaggtcgaggttggcgccgaagcagtggtagatgaacccgcgcacgggatcgccgcaggcgtcacagaccctgcggcccgagggaggcagaggcttgggacaaaacctgaatatgcggcctttgtacatagggtgctgtagaatggccggcagaggttggagcagaacgtgtgcatgtcaaagttgcaggcgtcgcagcggtatctgggagcgtatcctggctccaagcagccgtcacagcggaacggcatgtcacaagtcgtggtcaccaggcgaagcttgtgctgcgggtggtcgtggtgggtgatcatctctggctctgccacaggttcctcctccggtgctataaaacatgtgtgatgcagttagcactatatgccagtgtatatattcgtaaccaaagcatatatatctcgtagttaattaatccagttaagtatttatcttacgttaatcctagcttgtttatctatttggattatgcggagcaagttgtttgcgtttaaatctaactctatcctaatttcatcactaatatattaatgccattacctcgtgagagataataattgatatttcacccatccgttttcatagccaaaacccattgtcaaagttggataccttctcttctctcccaaaagggatgaaaacttttaaagctaactctaccgtaatgtgatcctcatatattaatgccattacctcatgagacaccctttgagatataacatttcaacaatcagcttgcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattccccccttggtcttggtgaaaaaaaactgccttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaacacatcaattttttttttttactgtgaagcatccctttcttattatgcttaaaattttctagtatagaattttaaataaattttgcgggttcaattttcgttttattttactattcatttaaaatgtccatttcattcactctaacaatttgattgggtcacttaaacccctaaacaatttttagctcatgttacaactgaaactattaactatggttcattatactgcttaatactcttttttccagattcatagtactaagttgtgtctaatacagtactatgtcactatattttgagatggggggtacattttttatcttttttttattttttacaagtcttattttaagctaaaattttttaaagccatagatggcatcattatctaagttccataatattttcaatttttttcatgattgtttgcttgaacatttaaattttgatgtttaagttagttttaggtgcttccaaccttgtaaacaatgatgaaagttctaaagaaaatgctgaggtaagacgtaatgcatctatcagtcctatcaaattcaatgcaaaataccatttatatatataggtcgagagaatctacaaagtaccactgagttcaacacacttcaacaataagccaccgaatttgttgatatccataatatgccatcgcattatccttaacctctatgatttgccatcgtcgcgccgtttgtattgttaattttcttagttatgaccaaaataccctttgaatcatctaaccctagcatggcccagggccccttttttcccagcatcgcatctcccagcgccgcatcaccacccttcccagtgccgccacagcgccacgcctcgccaacgtcgccatccctagcgccgacccgaccttcgggacccagtgccaccatccgtagcacaagtcagcggtggtctagccaccatcgtcacatccgacgggagacggcgcccctgttggagggctgctggtggtgctgccatcgtcatcagcgttgccgtcgcaaacaaggggacacgacgtcgacgcccctgctggagctactgctggtgccgccgccgtcgtcagtgccggcattgcatgcaaggggacatggtggccctggccctgttggagagctactactgtcgtcagtgcaatccctcaaccgctcctcaacagtcacggcaaatcaaagctctaccccctcctgtagccttggagatatttgttcataatcaaaatacttaaaatatgtgctcataattatttataatcatgctgcttaaataaagatatttttcatatgtttagtaccgttgtatgttctctttatagttattataactctcggtaccttgcacggtatggtctcagtgctgctgatcttcactaagggcatacttgtcttttctccaacgcaaactaacaggctgtagatggcgatggtaaatcgtagaggttaaggaaaaggcgatggcatattattgatatcaacaaagtcagtggcatattgttgaagtgtatcgaactcagtggtactgagtagattctcttatcatctatagtgaaatgttttcaatagttttatgatgtaaaatgactgaaaaatagtttacggggttaaatcctccggctaaatagttcgagggagtaaaatgatttttttcttattaattgcaaacttgtacatatatagtttttagtgaagtggtatactcaagagaacgtgatgaggaacatcacctgaccaattcataaagtataggtgttacaagtagaattggattttctctactaagaacaagaagtcaaaatttgagttttgaatctatagtacatacttcatgaaaactcaagaataattatgatattgcatatgtcattatatcactagaaaatacttgtatgtccaatgagttgtgttctaagtgtcattgagtaatagatgagttgttttgagtagcatcctagttgtcaattaggatgtcatcaggttgtcatatagttgtatcgagttgtagatggctttgtagcctttaaatagaggcaatggcctctagtttggaacttacttttgcttaccaccttatcaatagaactagatgttcctattacagaacatggattagatcttctttggagctttggactaagctcttgttgtccgtggattcgggctgccttagggcattatctactacttcctccgtttcaaaatgtaagactttctagcattgaccacattcacatagatattaaatatgtctagattcattaacatctatatgaatgtgggcaatgctagaatgtcttacaatatgaaacggagggagtaccacattaaagtcgttcctacaacattttgtgctatatctacatatcagcacaccgaagaagttcctccgataattgtgctacatcaacgtataatttccatccctaaactcttaaactattcggttagtctagttgccatccctcatctttgaaaccaggtaaactatgtcctcaaactatcaaaaccgaacacctttaatccctcgagctggtttgaggttattttgagtccacatggcaactaaggtgatacaattgatgacaaggacttcgtatgaaaggatcaaattttgatttggatttcgtatgaaatctcaatatccaaccaagtggatttcttggatcgagtcttttgttttgggtggaaatgtatcaatagaagtgaatgatgacatcagacatttcctccaaacaaaaaagggccttcgacaaggtgatcctctttcgccaatgttttttaatattgtagctaatatgctggtcactctaatcaattgagccaaagtagatggacaaatttgtggagtagtccctcatctagtggatgatggcatttccattctacaatacgctgacgataccattcgttttatgaagcatgaccttgagaaggctcgtaacatgaagcttttgctttgtgcttttgagcatctctcaggtctcaagattaacttccataagagtgaattgttctattttggtgatgctcgaaccatggaagaccaatataccaaactctttggttgttcttctggcgaattcccgttatgctactttcctattcattataggaaactaagaaataatgattggaaatgggtagaagaacgctatgagaagagacttggtagctggaaagggaaactactttccacgggaagacgtttaacattgataaactcagtgcttagtagtcttcccctgtatatgatgtttttcttcgcaatatcgagaggtgtactcaagaaactttattgttttcgctctagattctattggcagtgtgatgatcaaaagaaaaagtgtcatttgatgaagtggagtattatgtgccgacccaaagaacaaaggggatttaggaattcatgatttatatatgaaaaacattgcccttcctagcaagtggttatttaagctactcacgatggatggtgtatggcaacaattgattcgtaacaagtacttgggctcaaaacctatgtcacaagtcgagtggaaagctagggactcatacttctaggccagccttatgaaggtcaagcgtgattttctacgttttggcaaattcattatgagagaagcaccactgtgagaacaatacccttgcctatacaataaacaggatactatagcaaatgtgctacaaaactaccctccgaatgtatcttggcgaagggatcttattgagccaaaattagtggcatggaataaccatgttccacgaatggcaaatctagcgcttactcaggaccgagataagttccactagaatttaatccagaatggagagttttcagttaagtcacattatcttgccttggtacattcagatgtgcccaacataaataaagtaatttggaaagtaaaaataccacttaaagtcatgatcttcctaaggtatttacgtcgtgggatagttttgacaagggctaacctggccaagcgcaattggcaaggaagtaagaattgttccttttgtcacacagatgagacaatattacatttgttttatgaatgcagatttgcccgttttgtgtggtgcactatacaagtggctacagggcttttcccgcctcgtggtgtatccaatatgtctggtaattggctacggggaattaggaaagaccttaagtcgcttatcctgttaagggtaaccactatttgttggtcattatggttttgcgggaatgatatgacatctcttctcctttataggttattttttaaactatccacttccttcgtacatgggctatccttcagaagcctgattcacaagatttggttgcagcggcatgtcaacgcttggagtaggtggtcagggagtgttttactcaaggacatggatggcggtctaggctgaagattggtgctccctagattttactactttccttcacttgttacaaactcttttgtgggtgtgtgtgtgttttggctatgtgcatcctagttatgcagaggccgggagttttttttagtatggttctatcagcttgatgtaatcgactgagattaataaaagcttcctttaccaaaaaaaatgatgacatggatgaaacagctaacagttacctctcttctctaactattcctttccctcactcccaaaattccccattgtgagctcaccagcagcgatgggcacacaatccaacatgcatgtgagagtagtactggtgtggcgactcctgcgccctgtcttcttccagcagctgctgaagtggcaccatggctgcctgccaatttgctagtatacaccatcggaatctgtcttcaactgtcccattggtgagactgctgcccacctttcccgctgctatgatcagttcagttcaattttgactcaatattttgtttgctttgcagctacactagatatctattttcatcttattcttcttctgggtctgacattcactttacaagtttgcatcacctttctatgcacgttagcaaaatactggaattctcactgaaagcagtacgtgctggcatacatggccaataaggatgatgaggccaccaagtagatattcagccgattcctgctcagttgtctttcatgttaatcgtggctgctccttcataaaaagaaaaagctctggtgcaggcaccaggatggattgcacgtaggtgtatgctgtggttggccactttgctgacaccagcggagaggctacagacctgcaactgaactcatcattttccaggacctcatgccggctctgacgaatagtggctatgactcatgaacctttttaccaacacccaaatatgaaagggaagggagaaaagatgataagggccctaatgtggggctagctctatgatgtggaggacggctgggcgcgcaaagtcgatgacatgtcacacccaaaaccagccaagggacataacttgtctagtttgcatagttgagggaatagttttacctggtttataaattgagcgacgaaaactagaccaacaagataattgagagacaataactaggctttttcctacacgaaataatagtttcaatctaattatatgctagactcaaacttgtttatacatactaggtattatgatctttctttattctgctttcaaaatgcacatgtcaaattgtcaactgtatgataagagaactgcaaaggccacaatcaacataacagaacaactaagcaaacccacattgagtttgtcttggcgatctttactctaaagccagataaagttatccaaacagacgtcagaataaatattcttgagcagatgggtggtccaagtcagattggagtggtgatccgaggcagtttgttatgtaatctgatggataagttgggtagctgggtaatcgtaggtcgaccaattttagagttatatacaaacactagaaccccatcaaggtacaaaatggctgttacaggcaaaactatggtattgtagtttgagtagaatagtaattcttagcatgtggattcttgttattggagtataactatatggccaaccgatgtaaccctcaggcctcaatatatcatcaaataaattcttaagaggccggagtcaccttacttggctccgagggacatagacataacaaatatcgaatctcatcaacaatggcctgctctcttgcattatcgacttttaagtatttctaaggccctgtttgcttcagcttaagattattgtaatctagattattaaattagattattctaacctagattataataagctaacatagaataagctgcgagttgtttgtttctctgaattattagagacatctaagggtagtgggtctttagccactcaataatctagaaaaagctcctctactcctctagaggagattattggattatactaatctggcttatagattataacaatctagcataataatctacttgtttgtttcagcttactcctaataatccagattataataatcctaagctgaatcaaacagggcctaagtcaattccagggatctatgtgttctgaatttcttgtcagctggtgtcacccaaattacaacaatcccatctaaaaaagaaaaatgtttatgagtcaatagatgaacgcatgtttggctgagttcaaatttttgtgagggtgaaatttttgtttagattaagttgtttcaatgtcaaattttaagtgataattgttcttgagttgaactaatgttggttcatggtaaattgaaaataaacctgtgggagtgcaaagtaattactagagtattagggttaagaaataaagtgaacaacccgcagcggtggaaagtggctgcgatgagcgtggaccattagctctggaattgaccaactgtgcaatagcagttgtatttgatggtggccgttctttagtaatgaaatcaactatatattacctggtatcggtttctttcttccggagttcctcccgtccatgctctagaacattacatacttcatccttgtgctgaaactcctctgtaatttcatcttgtctcagtggcgtacgatcaccatcctccgcactgaaacaggtgtaataatagtcgtatactaactggacgaagtagaacaaaaatttggatggttttttgtgatcgctagttatgaactgatacctgctgacaactaattggtcggatgtatcttcgcctaaaacctctgttggcgtccactgtgattcacccattaggatctcatacagtttagttagggtttcatgtgattttgatgccaagtcttttaaacacgccatatgcacgttaatgtcctggccttcctgactggagcggtaggaccaaaacttgttgcgataaccctccttgccacacatgcaaatgcaacatctgctgcaagccgacaccctgcgaagctccatgacatagccctttacgtttgcagtgcgaacaggcagcctcgcacagcgtgggtggaggtcgaggccacgctcaaagcagtggtagacgaagccgtgcatgaggtcaccacatgcatcacaggccctaccgcattcagaggccagaggctttcggaggaaccgaaaaacggagcctgggaacagagggtgtttcagggtgtgaggcgctgttgcgcagcacatatcatagtacaccttggagttgcattgctcgcacttgaacctgtggccggcaccaagctccttgcagccatcgcactgggtaggccaggacctgacactcttatccagcctcagattttcatgcatatgatccgtgtgaggggtggggacaatcggaagatctgtgccaaagcccgaagaattagcacaccagatgaccatataaagatctaatacagtatcttttctttataatggctaattgaaggttttttcttaaaatcccatataaacagttaacactaagaggtgaaaggtttctcatattaataggtcacaaaatatctaacaaaagctcccacttagtctgaaaatgaaggtgtcttaatgttcaagtttttcgatgcttgtgacctaaagctcagatttgcatatggtatgttcgcttttctcccattcttgcctttactaaataaatgctactccctttgtttcaggttataagacattttgactttggacaaagtcaaactgtttcaagtttgactaagtttgtagaaaaaaataacaacattttcaacccaagacaaatttattataaaaatatattcaattattgatttaatgaaactaatttggtattataaatattactatatttctgtataaacttagtcaaacttgaactagtttgactttgaccaaagtcaaaccatcttataacctggaacggagggagtaccagaataaaatattattttctccatcattcagaatatattgaacattatgtgtcatccaatgtgctaccaatgaagggcaaccaaaccgtttcacctatactcttaatcctcgagcttgtctaaaatgattagtatttagaatcaggtagaagaataactaggcaatcaaatctgtaagtataggataattctagaactgaatatccataaggccataaccatgatgggcaagcacgatattagaacatcatatcccacagccagaaggtgataaagtataagcttggaaggaattagtttctaagctcatgaatattaaactgacacatgaaatcgacacttttagatgaacttacatcagaaaaaggaattttctgttcattcaaatatcaagccttattttctggtgcttacaacgtgggtttgtatatagcacaggattagctttgctaagagaaattaacgacacagctagaaatgttttttaatgacaatgagactattcaacatttgttttttcattgccatacagcacactgtgtggcgtgaggtacatgcagcttttaatttggatccagccactagtattgtccaatttattcggaaattgattagttggtttggactaaaagttaaaataagccggtgtacgttggtgcggccaaccggttattatctattggattacgtcataaggatattgtttttagaaaaagaagtccattttactcccccccccccaaactatttcattggaccactaaacccctaaactatttttcggctcattttaccacctaaactattaaaaatggttcaccttactcctttataacatttctctttttttttcctttttatataagttgtattttaggctgaatttttttagagccatccctgataccattatcaaacttcaaaaaaaaaattaagttttttcttgactgttggcttgaactttaaaatctccacatttaaatcagtcttagctgtttccgacttatgtaaagagtggggaaaaatctaaaaaatgttgagacgtgtaacagcccgccctacaaaaccgtgtttataagttggttccaaccttgctacactaccgcagttgatactaaacatgcgcacacagctctcatgtaccacacaggcctaatcctgattggaccggaatgtcacaagacatatgttgtaatgcatctatcgttctaccaaaatttcaatgcaaaatatgacttatatagagagaaacgaaaaggaacaatgggcctcaacttttcgcttatgcttatacttatcagccaaaatttgaatttttaatcttaaatttggagctaattttgaggttttttcatcaaagtttatttttcagcctttgcttttagatcgcttagaacacgtatataaaagttttatttacaaataatttttcgtttgtaaatatgccgtttcacttattccgcgaataagcgaaacgatggctcctaatatcgttagggagtaaagtgaaccatttttaatatttccaggtgtaaaatgagccaaaacaaaattagggggttaaatggtccaatgaaatagttcggacagtaaaatgtacttatttttcttctataaaaggaattatcctaatcttacatctttatgggctccaactggctatggtttggtctcttcagcgtgaggagttgcatgatctggtatttgatgcaggcaacaccttggagcgtagtcacagaacttttcaaccatattggatggtggtttaataacagctagcctatgtatcttttttttttttagttaactagcctgtcgaatacttcttttatcattttaatgaactttcacacacgcttgtaataatgtggctgtgtacaccttctggttgctgcttccattatctttgcaacagtaccatctctacaatgtcactgatctgatcattgggcctcttttatataataaaatcagtatgatgtgtacaaaagaattacgtagtaggatatgggatatccactgctgttgatcgacctaactaaagacattatactacagcaggtagtaggatgttttgattggtaaaacaaaaatgaaatggatgattgcaggtcaaatttgcatgtccaaatggcatactaaaatagatatgtggttcaaatgattaccctagttaaattctcaaataaaatattttgaatagcgaaaaaatcgaccatgtgcatctcgtccaaattccaatgttaaggcaaggagtgtatcttgcgcaaataaacacagaaaagagggcatgtttattgttacagtagggtatgtaaattcgtaccttttataaccctgttgatgaaccgtatgattacacttgatattcttgtattttgcctgatggcattgttcagtacagaggctatagccattctgttagcttcactagtaccggcaatgcaaatttttgcgctgaccttgacacctgacaagtgcttgaagcccacattttcaaggttgtattgctccactgtgctaccattgaattccatctttaacctttggaggttgggcatagctccttcatcaaatctcagacttgatacagtactacacttgaatttgaagtacttcaaaacatggaatcctgacttgtcaaatatgataggttctgcaggggttgtccggacatacagtgagaaaacagtgagggcattcagcattgagagagtctcaatgtctttcctcaggagttccatgactgctactttcaaaatacagagtttctcaatagttatgatccaactgggaagtctatggaagacgcaaacacgtggaaacaactcaagcctctgcagaaggctacaaggggggggaactttatctaagaaatccaagaaaatggcaatgcttgaattttcgttatcattagaatcttcagagaagcagacaggaacaactgttagagatttgaggctcttaagtatcccaataattgaacccaacagtttcatgttgtgcttaatatggtcagaagtggctatctgaggacatgcgagttgaagatcctgcaaattggtcagttcttcaatactctgtacactccctgcgtcaacaaagtaccctagattgggtggaagtctgaagtgcagcaacggcggaagatgaacaacttctgatctcaaaaaggtcaccattgcaccaatatgcagagtcctgagatacttcagtccttggagctctgatggtaagtctatgcaaacattaccttcaatctgcaaataagtcagtagaaacagttcacgaattctagtgaggtcaagaaattcgccatgtttaccatgaaggaatagaactcgaagaagatgaaactccgaaatggaaggcccgcacttccaaaatccagaaaacacaagtgatcgtagttgtgacaatctaatacatgctggtgcctttgcatcttttgaatatccgaaatggagagagagtcgtcgaactttgtctgctagtctataccagactgagaatgatcaattgcagtgacaaaattctcttccattgccttgcgtttgataaagttaagaaccatgtcatgcactgtgcaagatacaacctcatcactacagctgatatgttcagtttcaagtattcccctatggacaagctcataaaaatgattccttgcagcttcatccaaacttttcccttccgtcgcacttacaaaatcttcagctacccattgcttaaccagatcgtccggattgattatgtgatcctctttatatatactcagatacagcatgcatgctttcaaatgatgaggaagattgttgaagctattgttcagtagttgtgccattccttcggaagtaggttgtatcctcaaatctggaatcaacgacttctgtacatagatccattcatctggtttgtctggccgactcaataaaagactggctgcagcgatagttgctagtggcaaaccgccacattttcgtgctatctcatatgaaacttcattgagttcttcaggacatttgtctttatcaccaaaaactctactaacaagtaaatctcttgagaaatcgtcattaagcggttccatcttcaaaatatgcttcttgatcacgtgagatgcattatgttgagacttgtaaaaactccatgcctgagccacatcgttaatttctgttgttactactattctactacagcaatcctcttgtaaagcatgtctaacaacattccatgttgatacagtccacacattatcaagtacaatgaggcacctgccaagtagcgcatggtgtttatgttatatgaattcaactagaagatattgacaggttctccctgagtagaaatatgattgtaacatatagagaagaaacgccgttggtgtagaaataaataattgtacttcaaactctcaatttttttcatctatcccattaggctcaattgcaaaggggcatttaactatttgccacttttagaaatgcaaatttctaccgtttcttcgctgaatttcggaaaattttacctttgattacaggaagccaaggcttgaccttgccgccgccaagggcccgacctcgacgtgctcctccagtaaccgccaccgggcgtgctcgttctcgtcgcactttcccagccacagcccgaccccgacgtcgcaggactcgatctcaccgccctccccacgccgccgccgccggggggtccaagctcgcgacgctacccagccgctgccgtccgtcccgccgagacgaagcccgcagccccgcaccaccggccgctgctgcctccgcgtgttgtgaagtgacagggagagagcaacatgattcgcggccgcgggcggggagatgtcggcggggaacacgccggttggggccccccactccccccatgcggccggctcggcttcttcgccaccggacttttccgggcggcggatggctcctcggatgacttcacttggcggaaggcctcgtcgcctcctccccctttggcgttagggatgcctaccgaggcctcctcctcctcaggctctttcccctcttctctcccttcctcctctctctaccaccgaacctagctgctccggccgccggcgacgatgactgcggcggtgtcgtaccagtcggcggggaggggaggggagggacgccttcgcggcgtcgggtccgccaccacgcggcgcgggtgggccgcggcggattgctccggcccatcgaagcacgccggtcgacgggtgcataccgctgtcggcccgtgcgggaggcggcggcgtggaggcttatgggaggcggagcgactgcgaggccggaggggagcatggtgcacggtggattggtggtgtgtgacgccccgcaataattacggaaaaaaacgaaatttcttccaatcggtcgcttgggggaaggtagccgaaatcaggcgctccctcgccccaagatgcacgcccctctaggcctcactcacgtgtcccctgctcccaatcatttgtccacacacaactccatgcaacaaatcacccatatattttagaaactatctgttaagaaaattcgttttatttttttttcgaaaaaaaaaagtttcacctagtttactcacaatgtttcactatgtatagatctaatgttgcaatgaactgaaacattattttgtaacagatcaccaacatattttcaaaaccctctattatgagaattcgtttcacttttttgttccaccaaaaataatccagtgtacttataatgttttactatgtatagatctaacattgcagtgaactgaaatattctttcgctatttgctgaaacattgtttttatataaggtgaaacaacgcccgatttaaacgattgaacattttcgatctacttagtgaaataattccgatatacttggtgtaacatcgtgcaacatttaaaatataattcaataataagctaaaaaatttcgtcggaatatatccatgtgtggtcttgttttgaagatttaattgcaacaaatttaatagtataatcagatcataatttcgataaataatttaagataaaaaatagtttaaaatggtttttcacacatgcgtggcgctaacatcatgctgacgtcagcccccgatttttggacgcctggatcgggcgcccgattctaagtctcctccgacaaaaaaagagagagaaaaagcacaagcaataagcatgttggtctagaaaaaactaagggacaattgctcatttgaccttgttttaaagccaaactactaatctgatactacattttttagtttgctaatttgaccccgctttttaaaatcgagcatgccgtttgaccctatttacactatgccattagggtttcaaaaaagaaaagaaaaagaatcattttactattcaaagtgaccaaaataccctcatacatttcacttcaagtcttcaaccaatctctcattcacatctcggcggcagcggcacgaggaaggaggaggcgacggcgctggcgccgacgtggggagcgagcaggaggcagcggcggtgcaaggaggaggcgcggtgacggcgacggcgccggcgtgcggagggaggcgatgggcagatcagacggcagcgcaaggaggaggcgcggtgacggcgacggcgccggcgtgcggagggaggcgatgggcagatcagacggcgacggcgacggtgcacggagggagcgacgacaatgaggacacatggagggagtgatggcggcgagatgtggagggagcggcggctgtggctggatgcgccggtgccagcgcttgtttgatttttgtgatcttgtttgaatgttattgttggatgatgttcttagcagggatttgtttgcatgttgatatggatttgaatcgatgctggcatgttgttccggaaccatttgttgtggtgatctaatttgcgttctcaattgtttttttttggctaaaattcaaatctaattcaaattcgcacaagacatatcaattccaagtgaaatttattagaaattgcatcatgtacaccaaagcgtataaaaaaattagggtcaaatgagtaaggatataaaggtatttcgacctcaaattaacactgtcaagttggtttcacgaaatggggtcatgtctgatgtcgatagttaaaaagcagggtcaaaaaagtaggttaaaaaaaagcaaagttaaaaaaataaggtcaaattggttggtagtttgctttcaaaatagggtcaaatatacgattgccccaaaaactaaatactcttgacaatgtatgtttggctatgtacttgtagagaccgagtttttaatacatcttctaaaaaaaatattagtcagataaaattctccacaacattttttttttttggaaacacaagaggaggttatgatctagctgtttgtgttgaaggttatgatctcattacccatcttactaaatgcactttccaatctttaactaatttctgaaaattttctacttgtccacattaaatcttctgcaaatttgatcactgccgttgcaaagaatgttgggttggaaaataccactacaagaagatcagctacaaaataccatcacagggaaatttgagttggaaaatgccggtaccattactgtttcatccaaaactgcaattaatacctttttaggagagagagttttgaaaattccaacactacccttttttttccactcagttgtaatactcaacattccaagtcgcgtttggatgcatttaacaaatctcgcatttaatttatggtggaaatgtttagaaaatcagctaatgcaaaaattaagaaagagtaaattttacaaaattaatgtactttgatcaatatatcacaatactatatatttaagaaagtgtattacaaattaaactacagatttaaaaccatatttttttacaaaactatagattgaaagtatcattagaaaactacaattttataaatgagcatatataacatcagtttaacatcagatttaaatatatatatagtataacatcagttttatcagaaagctacaacttttgtaacatcaacagtgctatagatataaactctaaaatttgtagttatttgataatttcatttctaaatgcatagttttgtgatacaatgctttaaatatgtagttatgtgataaatttcatgttaaatctgtagttttatgatacacattttaaatttatagttttgtgatagtttagccaaaatatctgtagttttataaaatttagtctttaagaaataagcaataaaaacattttcaaggaaatagtacagttcataatttttaaataaatatattatttttttactgcatccctatcaacaataattgatgttcttgaatacatcaagtcaatgtgttttgtgtttaaacttttactatcaatttctattaaaatatttcgatttaattttaaaaattgatataggtatatttgtctttgaaaacaaaaaggagtttcaaaatattagaacgtccttgctatatttttataggttttatactagcaatcaatattgatcatttcggtaatcttgttgctttctaaaatgtcacttatttgttaccgaagggagtacgtataaggcaagcagtctgtataaaatattatgaaattgagagccataagtatagcaagcacaggaaacaaagaagaaaaaaaagcagggggcaaattagtcattttcttccctgggtggaaatgatcacggtaatggtatttttcaactcaaattctctttgtgatggactgatggtatatattcatcagcttaggttctatgtatatgtgatagtattttgcaacttgagtttttcctctaattctgttaattaattcttttactccaaattttcccatgataacacgtgggccgggtaaggtagcaagtagatactccagtaattattgtgctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccgagactaatgctactatagcattagtctcggttggtgttaccaatcagtactaaagatatatttttattatagggtggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaataacctagtggttacaagagtctcagtagcacataaggttctgggtttgactctccatgggagcaaattttccatgatttaacggcttgtgctttcagtggtaggcgacgtacccgtcgacagcgaggcgcctgtggtgacttcgtcaatctcaaggatttgcctgcgcagtcttcgaagatgctcataggggtagagtttacgtgcctccattgtgagtgtctgcgttgtactgtgtaatttttttaaaaaaatcctactgtccctcatggtctccgtggatccgaaaggtacggcatctaaaaatatctcagctataatcatacataagagattcggtttgacatggtattaaatacaagagattctgcgtgacatgggttagatatgtgtgattctgtgggacatggattatgtatcagagattcggtttgccaagcaaccaactatgtactgacccggtctaaggttctccactatttatacccttctggtcgatcgtctttctagcaccattcattcactaaaaaacactttcaacccccacttcaccacttcagaatctcagataccgagcaaaaaagatctagatcaagttagtaccaaaatttagtgttgtatcgatcgatgattgaggcagcagagaccatggagaaagcggtgataactgccttcgtgaacactgtcatgccgccgctgtttaaggtgctgtcaggcagttgtaagatggtcatgaacgtgatcgatgatagcgactcaatgagacgtaaactagttctgctcgcagcttccatggacgacgacctccggcggacgaagaaccccacggccgccgccaaggtgttcggcgaccagctgcgcgagctgacgcacgacatggaggactgcattgagcgcttcctccaccgcgtgtcctgcgccgagggagcgtcgcgggcgcgccggctggggcgcttcctgctcaccatctgcacacgctaccggttcggggacaagatcaaggcgcttaacaggcgcctcgaggagctgaccaatgaacgcctgtgccagttcgtctacgacaagcccccgccgccgccgccactggcgccggcggcggcacaacaacgcgaacatgttcaactcaaccccgtgggcgtcgagggagccaagggggacatcctcgcgatgctggaggaaagtccggaggagctgagggttatcgccatcgtgggttttggcggctccggcaagacgaccctcgctaaggcagtgttccgctcaactgatgatgatagaatccgggtgtttcgttcctgccgtgcatgggttgatcgagccaaggagaaaaatgcgggggagattttcagatcattactccagcaatttggctatcggggtcagggattattggtcgatgacgagcaatatctccaagcccagctcatggactacctcaggggtagaaggtgagagaatttctgtagctgtttcccagttgcacgcattacccatccacacctttacggtcattcagaatgtattggaactttacgtactacattgagtactttattgaggatcgtaaaaccactcattcgctgaaccttgcgcccggccgttggttagagcaagtttaataatatagtcaactactagctctaattcatctatagccaatctaatagctcattcatataatagttacatactacactatcaataactggtcccacctatcataaacacattgcgtcttggagtccgtaatacagctggctacaaatttgtagcccactgctcttctctctcctcgtttatctccttaaaatatatttgcagttggcttatagcctgctattgtacctgctcttacccgaaatttgtcagaaatttgtcagatacttgattgttattgatgacattgggaatgggcaatggaattctataaaatcagctttcgaagaaaatagtagaaacaacggaagcaggataatagttaccacaaccattaagtcggaagcgaatacctgctgtggcaatggcaaaggtttcatataccaaatgcaaaatcttgaagatcaatactgcaagacaatagctcttggggaggcaccttcacctgagttgcagatgggctcggaagaactacttaagaaatgtgatggccatccactttcccttgtttgtgtggccaattatttgggaggtttaaatgagcctactgggcagcgctgtcgcgaattgtgtcgctacctaggttcaaaaatacatgacaatggtaactttgaaagactcaaaggcgtgatcatggataattacacaagtctttcaaaccacgttgtcagggcctgcttgctatatttgagcatatttccaaacgatgttccgctcgagaagaaagtgataatcaggcgttggatagctgaaggattcgcaaggagcgaagatgtggacattgatgaccagactattgcacgttggaattttgagacgtttgtagactgggacatctttcatcctatcattgacacaagcaataatggcgatgtcaagatgtgcaagactcgcagtatcgtgcacgagtatatgttgtacaaggcgtcgagacttgagaggttcatcatgtcctttcctgactggcgaaggaaagttcgtcatctctgtatcgatcataggacacctcacaagcgcagaactacaacagatatggatttgtcatgcgtccggtctttgacgatcttcgggacggcaggtgacaccatttgcgagtttcacaggtacaaggttttgagagtcctggatctcgaagaatgcaatgatgtcaagaacaagcacctgaaaaatatacacaagttatggaatctgtgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagcgatcaaggatgccaggtgacaagattggacacaaggttgcacacagtggacgaacaccgtgtgaggaggtctttgcaacgggcttcagaaggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttggcagggaggccaagccaatccagccgttccacgtggcccaaggagatcattgggtcggttggcatcaagtccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagactcgtgggaccgggtcccccgcggtttttcacatggcgcgcgcgggaacgtggttttcgcgagcgcgcgcagaagcggctcggcgggaggaacggcgacatggcggcttctgacttgtggcgcgcaggtgcgagaggagcgggcgcgggctctctgggacgcgtggcgcggatgcattggcttggaggagcacgacgcggatcggtgtacactgattggcttggagtggaatcacgcggatcgcacgagggcacgcgacgtgaagagctcggatcaacaacgtggcgactatccaggaggtttccttcggatctaaggaacaatggacatccaggattttatcaaggctagggtttcgccccacgggtatttgagacaatgtcttaggggtcttaggctataaatagagggatggatgcaagggtggaggttgctccttttgtaatccttttgagatgctcggtgagagagtttccgtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccggcttgatgagtattttcgggggaaagatttgaattgctatattcaccccccctctatagccgttcttggtctttcaattagtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactatgcccgatgatgctgacatcacgcctgcaaatgtggctcaagttgattttaattatcgtgcaagaaatgcaatcattggtggaatttcttctggtgaatttaatcgtgttcaacaccaccagtccgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttgaagaaattgtttcgaagttgagatctgttgaaaaagaattttctgataatgataatgctcgccatcttttgaattgtcttgattatggtgtttgggaaatgaaagttacttccatcacagagagtgcacctttgagtgaccttaccatggacaagctttactcaaagctaaaaacccatgagatggatgtcttccatcggaaaggcctcaaacactcgatggctttggtagctgatccctctggtagtacttcttctaatgacttagcttttgtgtgtggtggcttctctcttgccgctttacactcagtcactgaggagcaattagagaagatccctgaagatgatcttgctctttttactagaaaattctcaagagcttacaaaaatgtgagagatagaaaaggaggaaaaaccaatgaaccatttgtgtgttttgagtgtggagagcctaaccacataagagtgaattgtcccaagttgaagaagaagagtgacaagacaaccaagaagctcgagggacaagggcgaaaggggaagaaggatttgataaagaaggcgatccacaaggtcttggcggctcttgaggaggtgcagcttagcgacatcgactccgacgacgatgatcaagaaaagggggacaaggacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttatagtgctagtgctgcttgctctacttgctatga

SEQ ID NO: 63897 - DNA, 4298 bp, Oryza sativa
cagtaagctttctgttaaagatggtgatacgattaccatatcacatagtctgtgttagatgtattgtatagctagctgtgtatttactcccttcttgagggtgctttcttcatatttgtattgagctttgtgtatatctgtttggcccagttggcccatttaatctgtggtccaatatttgcaacatggtatcagagcatatggtttagggttccacatccgccgccgtcgtcgtgaagctctctctctcctctcacgtgactggatccctcttctctctcgcgcgagcgtcgccacctctgccctatgacctcgcctgtggtcgccgccgcgccggcagtgtcgccgccgcgcctctgcctcttggggtcgccgccacgccaactggagtcaccgcccctcttgcgggcgccaccttcctctgctcgcgggcgttgcctgcccctgctcgcgggcgccgccgttcctgctcgcgggcgggcggccacgggcgggcgctgcctctgctgccgctgcctgcttctccctcatcttccaccgtctaaagctactgcctctactgtgatggcgccgccctcgggaaaaccgggtgccatttctcttctgaagcctccggtcatcttcaacggactcaacttccgggagtatgcattgcatatgcagatacacatgtgcagccagtggttgtggggctacctcatcggcgatcggccttgcccgccttgtccaaccttgcctgctgagcctgccatctcggcagatgctgatgagaacactaagcgtggtctccttgatgatcttgctgctgctatggaggcgtatcaaacagatctctctctatatgagacttggttagagcaggaggcctatgccaaggctattttggttgggagcatggaggttgacatatcactcgacattgcgggccttgctagctctgagttgatgtggacccgtcttcgctagcagtacgagcctcgcaacgatgccatgtttcttgccgttgtgaatgaggcacaatctcttcgtcagcttgatgccactgtggatgagttctttcgcaagatgtctgcggtgtggcgtcaaatggacctacagggcgctgatgtttgtcgcacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctggtgctcctagtactccttcaggcattgtttgcgggtactgtagcaagacagggcacaccgcctctatgtgctacaagaagaagagagatcagagtcatcgcacctctcagggctctcgacagggctcttctcagtcaagctctcagcagatcacatcgaccgagcaagagcttgtaaggctccttcgtcgtcttatgactacagcctctacctccacccatgggtctgctgctcaggcttctagtcttccaccaccacctccatcctcttcaggtatattgtcctcgtggtttcttgattctggtgcttccttccatatgacacccgattccacacatctttcttctatgagtcctcctgatacccctctcacagttcagacagctaatggcacctcacttcctgttgttgatcgtggcacactttctacttcttcctttcgagttcctactgtctctcatgttcctaagttaaccatgcagcttatgtccgctggtcagatcactgatcatggttgtcggattatacttgaggctgactcttgttgtgtccaggatcgtcgcacagggctcctggtggggactggtcctaggcgccatgactctcagcgtctttgggagcttgattggctacatctcccttctgatgcttctaccagccagtcagtcggttccactgcttcagcgttagctacttcagccactactacttttgctcagtggcatcgttgtttaggtcatctatccggtgctagattatccacacttattggtagttggggtcttaggtcctgtttctggagacaccgctctacattgtacgggttgcaagcttggcaagcagctgcaactcccctattcttctagtgcctcagagtctcagcgtccttttgatcttatacactctgatgtatggggacaagctccttttgtttcgaaaggtggccattcctattatgtgatctttattgatgactattcgagatttacttggatttacctcatgtcttctcgtagtcaatttctttctatttatcagcagtttgctactatggttcgcactcagtacgattcttccatacgggtttttcgtgctgactctgttggtgagtacatttcggcagcccatcgccgttttctagctgagcagggaacacttccccagttttcttgccctggtgctcatgctcaaaatggcactgctgagcgcaagcatcgtcacattcttgagactgctcgtgccctaatgatctcctcgcatctttcgcctcatttctgggctgaggctgtctccacggctgtttttcttatcaatcgatagccttcttctgttcttcatggttgtactccctatgagcgcctatttggtacacctcctaggtacagtcatcttcgatgttttggttgtgtttgttatgttcttctttctcctcgtgagcgtaccaagctgactgcccagtctgttgagtgtgttttccttgggtatagcactgagcataagggttatcgttgctatgatcctgttgctcgtcgcatgaggatatctcgtcatgtcacatttgatgagtctcgtccttactatcctcgctcttccacttgtgatcagtcctccactgtcaaatctatctcctttttgactcttccggattggtcctttccttctccaccaccagttccgtctccatcaccacacctccctttggtttctacgccatctccatcactgtcaccacctccttcgccgatgccatcatcacccatactaccatcaccacctcctagtactcttttagatgctccacatgagctagcacctttttcgctgcactactctcgtcgttcacgaccccttgttgagttgtcctctccctctatccttggaccagctcctgctcctgcttctcggtatgatcttcgtgatcgccatgctattaggcctgcgcctaagtatggctttactgctgcggctattgttgagcccacgacttaccgagaggctattgcccaccaggagtggcaacaggcgatggcagaggagattgctgccttagagcgtaccaagacttgggatgttgttcctgcacctactcacgtcactcctatcacttgtaagtgggtctacaagataaagactcgctctgatggctctcttgagcggtacaaagctcgtcttgtagctcgtggttttcagcaagagcatggtcgtgactatggtgagacttttgctccagttgctcacatgaccaccattcggaccctgttagctgttgcctctattcgtcagtggtccatttctcagctcgatgtcaagaatgcctttctcaatggtgagctgcatgaggaggtctatatgcagccccctcctgggtattctgtccctgatggcatggttcttcgtctgtgtcgttctctttatggtctcaaacaggcccctcgtgcctggtttgagcgcttctcctcagttgtcactgatattggcttcaaagccagcgaccatgaccctgctctctttgttcacacttcttcttgtggtcggacccttcttcttctatatgttgatgacatgatcatcactggtgatgactctcggttcattaatcttgtgaagaagcgtcttagtgaccaattcttgatgtctgatttgggtcctctcaggtactttcttgggattgagttctcttccacgtcttctggtttctacctctcccaagagaagtatattcaggatctccttgctcgttcgggcctcactgataagcgtgtggttgacactcctatggagcttgggatacatctacggcccaatgatggtgagcctcttcaagatcccacccgctatcgccaccttgttgggagtcttgtctatcttggcggggctgcaggaa

SEQ ID NO: 63898 - DNA, 7583 bp, Oryza sativa
agggtacacaaacgacaaagttgacatacagatccacgtcttacaaacattataaaagtcttacataaatgcagtggaaatataaaagataactagagctaagtctggacttggatagcagcgggaacaccactccacaggcatcctcgacggcacggacaaagcctactcctcggagaaaccaccattggacgcatactcgaactctgagggttgggagatagagcaagactgaatacttcctactgtactcagcaagtcataccggaacggagggtatgatgcaatatataaccaaaggaaggctaaaaggggatcatttgcacaaagctagcatttataaacagtagttgaaagcagtaaaacagttctaataattaatcaatattaaccatccactgtccaatgctacaccatgttgcaacaggcccaaccatccacctgaactaatcaattccattagactaaactagggtgagactaatcacagtgaatctggttgaccgcccataaccgcgggcacggctattcgaatagttttactctgatcagaggtgtacaactgtacccacaagacatagccccacaacacgtttccgtccgccggcatgccaccacgacataccggaaagagaccgtgacaggaccctttgcataacctcctctaaccaaacacaccacacctcaggtttcacccccactactcgcaaggcagcgggcagtcccctctcgtgcctaggtgaatccggaagcgacaaaggccgtcgcagggcccatcccgctccatcacgcccacccttgcctggatgcgtcagctagaggaaagctacactacaagcccaaccgttgcccaagctggcttgtggtaagtacgataagttcttctagggcatcccgcgaaccggtacttaactgccatgggcgcgaccatcaaaaccatacacccacagccaatcatttagcatattttagttaaccaacaccggagcggtggcactaaaccaacatcaatactagaataggaagtctaagtgttaatgtaaatcccccattgtgtgctagttgagctaagcatggctaagcaatccctagtccaacagctactcatgttataaccccaagctaacaaaggaacaaggtaacaaatagtatggctgagacaataggtaatcatcccatggtatcattataaaacaatgcaatatttaaaggagaacaataaagcatttgcaatgtgggatcaccatgttcaagtgacaagcatgacttgccttgctctgcggctggaggaatctcggcgactatctctaagtacatcggagcgtcgggagagccgaaatctatgcgacatacaaggcaaacaatacaaacaggctataagactactgaaacagagaacaaatatttttaatggattctttgcatttttcttgatttactgagacttgaatgggcttaaacgaagcacggatgaattttctatgaattttagaagattcactgtgtttttactataaaagaaaaaaccttaattggattattgcgcattaaataaccccgacatgcgggccccacatgtcatcggcacaagacgccggtccacggtggaccgagtccacgggatcggggaaaaggaccaccacgtggcgccgacgtggcaccgatgtggcggccacatgggccgccacgcgggcagcggaatggatggccccgatctacaagggggtagatcggacggcggaggcggcgcacgcgcgggtggcttaagccggcccggcggcctggcgtgcggcggcatggcatgcggtggcgcggcggcaagcggcggcggcgcaagctggcccgacgactgcaaacgggcgatggcggcgagcgacagcggggcggcactagcggctaggcggcggctaggaagagagagagggggaaaaagagggactcaccgaagacgacgagcgacggcgagcggcggaaaacggcgggcgacggcgggacgggctccggagcgacctggggaacgaaatgggagcgattagagagagagagagcaacggacggagacgccggccgaaggcggctgcaatggcgagctcacctgcgtgcggtgaaaggcggattccggcgacgggatcggacggcggaggggtggacggcgtggccctcgggctcgcgaacccgacggaggcaacggcgaggctcggcgacggctctaacggcggcgagcggtggccggaggcgcttagagcggtggcggcgggtggtgcacggcgctagggcagagagctcgggtgcgagtggttgcaaagcggaaaagagagaggaggggccaggggtgctttatataggctcgaggggatcgatcgtggccgggaggtgcgggaatcggccggcgacgtggggaaggtggagaggagagagacgggattagaaaatcgaatcccagccatctcgagcgcgggtgcgggcgggagagtggggcggcggttgcaggatgtgtggggcgtgcgcggggagggcgacgtgggcgtgggcacgctcggagagggcgggagcggcgattgcgggcgcggcggcgccggccggacgtgagagacgggcccgataggtgggcctcacctgtcggtgacctaaagaggaggtgggggcgcgggcgaggtggctggccgaggcccagctggcgcgtgggagaaggagggggagtgggccggcgggggagaggagggaatgggctggtggcccaaaaggaaaaaaggagggaaaaagaaaaagaaaaaggaaaaaggatttttccagggatttaaataatgcttgtgctcgattttaattggttaaaattatttctagggctctgaaaattccactaaaaatccggttagcatattttgacatgtagaactcttgaaaaatcccacatgccatttccgattattatttgcatttaattccattagggtttctctcttactttaacacatgaaatttcttaagaccacttattaatttaatttaggcttgggagaagaacttcagggtgtgacaaaaaccttctctttttttctcttctctaaaaataaagtgatgaattcatgacttgaacctatgatctcatagttctcctaatcaattcaccctgtgacgctatgtgattggagattattgtttgcttgctacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatgatgagggcaacaaagaggttaaattgggttgagccagtaagttcgagctctgcaatctatttttcctatatagttggttcccactacaagaataactcctataaagctgtctccaggttaagccacgttatcatcaccttacagccgttggatcaagtgccatctttgttcgattcatagacctgatagaaactcaaccagtccaaagtccacccagacacgatgaggaattgctagcgttggatcagcttgcagtgagttagaaaaatggagcgttttctgtgcgtcaaatttaggaaactgattaaggtgactgaggagcccatcttaatgaccgtcatcatgctttaatcgacgcccgttcagaggttcagcaactcagcgtcgctcacagtccctggagttcaggaatcaagatcatccttttggtttgccattggttgaaatcaatcacatgctctctcactcggatggattcaactctgttcaatagctggaattactttgcctcatatcaactcatcatcgataattgggacaatcattccagtgaatcggcgtcgtcgctcgatggcagaaacatagtcactgtcatatctcagactctcggcataggtaaccaatttgtcatcctgcagttctttttgggataatttcatcctttagtttttatttcgtagctggctcagattaagcttctttattttttcaacatagcaatacaacatgccatcacaaatattcagcaatttactacagtacgtgtctatacatacacagaactactcgaagcaaccttctaactgccagtggatttgcaaggaactatctcttcaccctaatgccagtggatttttttctacctttaaaatttcgaccatttttagcaattatgagttcatttgtccagtccctaataaaatggtgatttgagatcatctgaaaactgatgcactccattttccccccttttcaccgcaatacatttcttttcattccaatgatgcaaacactgaaacgcatcttatttgattattagcttctttataacttttgttgaagaaacttttgtcgtccgaatgttctcaaaattggcctgacaaaattgacctcaccagtccattcatatgtctcaaagttgaccttctatcttcatatcacttataatttgttacaagagttaaacatattttgttttgttgaacataacattttacaacgcaacttttacaggtcaatatgatgtatatagcatatggaaaacagcaacttgagctggagaaaaatacatgccaatgacaaggtttgcaattattcctgtgtctttttgggcattaaattactactgtctatatattaactggtttatcactaacccatctggcctaacatattgatagttgatttttcttataattgtattatgacacctttgtatcatcattaaacttgaaacgtcaaccttctagtgaccccattttataagaattggtcacttttcattcgtacaaaccatcgtaataagcaattttcagttcatcacttaaaatccccgccgcaacgcgcggggtatcacctagttgtacatatacatgtagccaaggccagctctgggcctagctaggccggttgtgcgaccatcatcaccacccccacccccacctacaggcctcagcccatagcctcagtagaggcggaactgcgcgcgggcggccttggagagcgatgcggcgatccagtctctagggcacgccgcgccagttcgtcttcgatctgcggcggtgcggccggcggccccgcgcggctagcgctttctctccgacgctccttgaccacgacacagcagctatcaacgaacgacgcgtcgatgccctctcccgtgattggtgatcccttctagcagtggctgggtcgtaggaagccaaccaggcaagcagcgcacgcacagccagcggcacagcaggtttgccttctaaacttcttccttgattccttctaggaaaattaggttatgtacttcggacctctcttgtttgcatgcttaattttcttccttcttgctatttaatttactttgcaattttacttaaaaatttaatttactttgcaagtttactttttgaagtgttacagaacgtattacctatttgtcggttctcagaaaagaaacagaagaaaatgggaagaataatttatcgattcgcaaaaaggtgctatatataaattttttatagcttcaaaatcaaatagtgttgttaccggtaatgatcctcacacatgtcaatgtggatgttgtggtgcaacaaaataatacccaagatcaagaacaaggatttgatcataatgtaaatgcagaggttaaagttaatgaagatcaatctgatcatatttatggtctgctaataaggtatttataatattttatttaattatactatcagtattatatatatatatagttatttacaaccgttttatttattatttaccatgttagaaatgtttatttgtgtttcttcagaccatatgtgctttgtaaattatatagtataaataaaaaatagtattaagggcctatattacagagttcgcctatggccctaaaggccttgcatgacgcgctcggggtcagcctggagccgagcggagcgcactgtcgaatccatgattgtctctgggcctttgtttgcatgttgtacgcatgccgcaggaactgcatgcaaaagcaaaacgtgggatgacatggacgcacgcaagcgacgtacgaaatcagagcgaggaggatgttgcagatgaaaattggaagcacttgatcgccgatcggaaccgagatagatagggaacgatagatgaagaaaaaaacttgaaaacaaattttattttttaagtaggtaaggaaaaatcatgtattcccccgtttcaggttataagatgttttgactggtcaaagtcaatctgcttcaagtttcaccaagtttatagaaaaaaatagtaatattttttatccaagataaatttataatgaaaatatatttaatataatatttaaaattattataatattttcaacacaatgctcgtcacactagggttgactttccagttgcaattgaggctagggaggaaagccgtcaactgagaaagtatacgatgatatgatggacaaaaggattagagatagctgaagaggccaagctaaaagatttgaagattgggctacattcatcgaagcaaccatctatcgtattatgaaagaaatgttgtcggacatttctacgtccaacaatgacatggatggcaagcacgctaatatttaaatttattataatattttcaacacaatgctcgtcacactagggttgacttcccggttgcaattgaggctagggaggtgaaccgtcaatgtgagaaagtgtatgattatatgatggacaaaaggattagagatagccgtagaggccaagttgaaagatttgaacattgagctagattcattgaagcaaccatctatcgttatatgaaagaaatgttgtcaggcgtttctacctccgacaatgacatgggtggcatcgttatgaggcgtgccgaggcactagccagctggccagagtatcaagagcttgttgagcaagaactgtggcaggcacgctaagcgcgtgcgtgctaagcgagcagaacacaagcgaggagaattcattgcacgagcaaactccatgtgcagtagaattcaagtggcatttatgtccttatcaagcaatggttacagggtgtacgaggaggtgttaacgtcacctaaaccgaggaaaacaacagcagcaacaacaacattgtcttgttggctagtccggaagatagcgtcaagtggtgcatttgaggttctttcttcaatgctggtggggatcacgaaagcggatgatagcaccagtgatgcatcatcttcttttgtacacttcgaaagaaagaatgcccgaaaaattgttgtaccgggtcaccatcatgt

SEQ ID NO: 63899 - DNA, 2299 bp, Oryza sativa
aaagaaaagtcagtatatgcaaagtttagagaatattactgtatgtaaaaaatcagcatatacctctctatgtaaaagtgcaatatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaaatactggtgcgtatcaaagttcagtctatgaatcactgtggaaagattcagtatagatgtggaaaatgcagtatatgctatcgtccaacaaagtagagaataaagctccccacataaaaattcagtatatactattgcctaacagagagttcagtaagaaccctgccacaccaaaaatcaatacttaataccgtctagcagattccaaaaagtttccctccaaagaaaaaatgagtatataccgttgaaaattcagtacgtactaccatctacatttttctttatgggggtgggggctaaaacagcattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctatggcccatcgattttgccattgttgccccgctcctgcattcagccgactctagatcgattacttctgcttcaggaacacatgctgttgagagaggatccatcgctggaggaaggggaggagtcatcactggaggaaggaacgaactgctatctctgtaccgccgccagccacacagtcgccgctgaatcgctggtccgtcgccgcgccgccccccaaaaccccaattttcgggataatctgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcctatatatatatatatatatctcataatccatatgattgttatgtaaggtcgttttatgtaatcggaatactatctaaataatgaaaagaaatactgtaattaataacttccagtctctacaattgtcggaggggttgcaaatcttatgtgatttttctagtggtcaagcctacataaataattgtagtgtgtaatcgattgtggtgggacatgcacaaccaagctagaaaagcaaataataattcgtgcgtacgtgcacatgttgatcgggatatgcatgctacggtgtgagatacacgtacgtgctgatgactcctgctaggtaataatagtaatgtaaaaatactccatgcataggacactggagctagcgagtgctattttttttaaaaaaaaataacaatcatttgactattcctttttctagaaaaaaaatatttgtgtaaatagagagatcaggcatgcttaaaatacttttgatgacatatttggtagttctcttaattaattaagtaattgaataaactgttggtcaaagtatataaaaacagagcttatatatattagcaattagctaacattaatacccaggctggacaaaatatccagtttggaacaataactaatcaagtgtaggccacgacgggtatttatcatatatatttagtggaaagtgagtatctataagttgcaaaagaaaaaatattaaatgtggacagcttactgagatagctagcaacatcaatctcacctatctaattaatatgcacttttgagatatatattacatcaatcgactaaatcatttcccgtagattgtactagctactaatggattggtagtggatactgaccactgaagtaatacatactctacttagatataatgttgttgtgtatcatggtataaatgatccagtgtatgcatggtaatcggtcgagactatctagataatacatccgtcgataattttttaaaaaatattatcagctgctttatag

SEQ ID NO: 63900 - DNA, 19508 bp, Oryza sativa
taaagctggtaggcagagacttggttattgtgccctacattgtcataattccagattagttgatcgatcatatataagtactaaaatgtagttagtctatcacaatagagaccaccgacctcaaactcagccaaagtcttcaccttttctctatacagaaggcgcatgttgtggcacacatagaatccgcactggtcacctatttgttgcttaaccgggaagtcttttttgtggataagggtgtcatgtcctgtcttcctgaggcctcctctttgcacgtattgggcccacgcttcatatatcgctagttgaattggggtcaaatcatatgcgttcttatcaattctggtccacttaggtgttatgaccagaaggatccaatgggcaccgcggcattaacatagtgaaagttaattaagtactgaaggaatgtgtcatgctgttgtgtatatttagataacacacttactgttgattataggcgcacataatgtactccttgtctcggcgggaccacaaggtgttgtagatgtaattgaccatttcttgatggtcattctggagatttgtgacagtgaccacttgtggatcaaggaaggcaatttccggtgcatgcttctgacaccattgccaacttaacctacacacaggataaacgatcttttaagtgagttaaaccgattgttattactagattgagttgggcgacaatacttacaaggagtagcacttaaggaggcttgtgtccatcgctcggagcctgtagagatcgaaaagatccttgaagtcgaccacgatataatttgttggaccaaggaatggctttccatcatgctctccaaggatatcggtagctttattcggcttcctggcgttagatttctccatgtagtataagtgaaagtccttgcaagcggtgcccattgcggcaagcacgtcatctccaaccaatggcatgcctagttggaactcctgtggagcgacgtatttctttttgacctctttgcccttagtctcttcctggaccttgcccagatctagcttccttggagctagaagcgaggcatgcacctttcctccccttcctctcccctttgcttcgggtttatcgagagtaattctctgaggggaagagtgtgctttcctactcttcttcatcggtgggggttcatgaatcgccttgctgtcggcctccgttcggtcctccccaaaatccgtgtcgtactgcaactacacatcgtaagattgtgcatgacgatcttgagcaggaggggctgaaggagcaaaggcgggtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaacagctcgtattcaggcttcaccgagtcgacttgaacttttgcacagtcggccctgagttgcactccatgcacttttgtctctggggtcggcttgtacgcaagtccctcggctgctggaaccatgaaggtcggcatcaccctaactgtgagggtgcagctcattggttcctgcgatagattaatcaatttttttagaatattatatatcatatggattcgttaagtctttcatgtattgagtaagttcacttttaccgttatgtggttgacggcgccgtcgaccgatgttggattttccgccaactcagttgatgcgcaactgctgcgtttttgggtgggacttcctaactcttcgtgcgcagcagcagcggcggcctgggggttctgttgctcttctcggatctcttgcctaatcttggccctcatcgactcgagcttttcatcgaattcagatgtcaactcagctcttatcgacgcccggatcttggcttcaaggcgtgcatctttctccgccttgttggaagtccgcttcttgtactgccacgcgtagtctggaaatccatacttccagggaacagaagacccaacgccccgtgtccgtccacggtgttccttattgcccaacgctttcgtgaggaggtcatcctcgcgtctttgagagcaggcctcttgcgaggcttgttgctcggcaaccaactccttctgcattacaatttagtggggttaaataaactgcacgatgggaaacaatgcaaacatacacgagcggcgtgttcgattcctccgcttcttcatcctcacgctgccattcgtcttccttaccagcatatccggcggtgccaagccggtgcggatgctggttcctggtctggagcaagcgatatgcctcgcttctagctctggactcgggggtcgacttcttcgcatggaattcctcccagatctgttctgtgatccaaggaaattactctcttggatctggattcgccgggttgtagacgaactcgccgactagcttagtcttgaagttcttccaagcattgcccataaccttgaaagcagcctgcctgagacggtcctcatgctccgcaggataatcgaagctctccttgaacgttagccaagcaatgtccttctctgtggccggcacgagcttgatgtcatcttgcagaattctaaatttctgcctccctatgaccccgcagatagaccttaatcggctcaatattttccttggagatgccagcaaccctacggcgcccaccgctgttatgcggaaccgttccttagggattttgttccctgtcctaggagtacgtgcccttgaggacccactagttgtcgtcgacattagttctccttgctgagacatcgtctacttttcttcaaaataacaaaaaaacacaattgagtgttacaatctattaaccacatttcacaataatttcagtaatgcacaacatttcatcccaacatgaataaaccacatttcatcccaacatgaaccacattgcatataaataaagttaaatgaaccacatttcatcaatcactacaatcatctatcacaaaattcataaatgcaccacatttcatcccaacatcgacatgtctcactcatagttcaatcacatatcatctacatccacatttcaatgacatgtcattcacagttagcagagggcggcacgatggaggactcacctgaggatgaccggtggggctcggtggagggcgtcgccggtcagtggaggcagcgccgggctcgatggaggcagcggtctcggtggcggcggcggcgggctcggcgaaggaggagttcgcggcggcggcgctgggctcggtggagggcggcgccggtcgggcaggtcggcgccgggcgggcggcgttgggctcggtgggcgtcggcgacgtgtgtcggtgaggacgcgggcggcgacgacgaggaaggccgacaccggtccggtcggtgtagaggctcggtggcggtggcggcgggctcgggggggtcgtcggtgaggaggcggcggaggtccaaatggagggccgaggaggctcggtggtggcggccgcgggctcagcgagggaggcggcggcctcggcctcggcctcggcgtcggtggtgacagcggcagactcagtgagggaggacgacggcggcggcggtgggctcggtggcaacggcggcgggcttggcgagggaggacgacggtggcgctagggttctaaggagacgggaaactgtagcgggacttagaaaaattttcgatccgatctgagaaaccctagttatagtagagtgatgagtcatctcaatcgggctttaccgtagggcccgtcacagatgactcatcggtgacgggctccatactaatgcccgattgaaatgacattcaggcccgtcacggatgagtcatctgtgacgggccctaagataatgcccgatagagatagattaatctctatcaggctttaactaaggcccgccaccgatgactatttttccatttttccaaacaagtctttatatttgtgagtacaaaatatatagctgatgtataataattcattttattagtcataatacattttcggatagtaaatgatttcaaatcgaaatatggtcaacaacaaaattgtagagcctttcaagatctacaacttttattttggtcatttttctatataattttttcccaacagcttgaaattgattttgacaatatgacaaatctaattaacagcatttgtaaatactaaatgatttcaaattgaaatatggtcaccaacaaagttgatcctctcatcaggatctacaacttttattttggacatttgtaataaaacaaaattagccatattaatgactacacatatcaagtctttgcaataaaacaaaatacttcattcattacaatagataagtacaaatgcatcggtcacaaggttatgccttccgtatgatctgaatgagcatatgccacaggctcttggggatcatcgtcaaggtcaatgtgaggtcttacatgaatattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatatactaaagtgaaaccttccttgtcggctttgacaccagtgcgtagattcacccaacggcagcggaacaaaggaaccttgaacttgacgtagtttagctcccatatctcctcaatgcggccgtagtatgtgtttgatccaacttgattctggaatgcatctatacggacgctactgttttgcactgtgcttttgtcatcttgtttgacggtgtaaaatgtgtatccatttatatcgtatccttgccatgtgtgtacggtccaagacggtcccatccccaacaactgtactgtctcatttgggacatctgtggacattgtcacacgattcttgaaccattcgttgaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttatgaacgtacgacttcagaactcccatgtacctttcaaacgaccacatttcccttagaaaagccgggccacatagttttgtttgcttcaccagatgaacaaggagatgaaccattatatcaaagaaagacagtgggaaaaacatctccaggtgacagagggtattcacaatataggtctgcaacccatctagatcttctggatctataaccttctatccaattgcattgaagaaggcgcacagacgttagatcgtgtgacgcattttcggtggtagaatgcctctgatagcaactagcaagatttgtgtgattagcacgtggcaatcgtgagacttcattccaacaagttttagaaggtccaatttaacatacttacttatcctcgctgaatagcccgatggaactttaatatccttcaagcatgttaacattgcgatcttctcatccttcgacaatgtatggcaggctggagggaggtacactctacctgtctctgcatctcgtatgggctggagttcactgcgaatattcatgtcatgtagatcaaggcgcgcgttcaacccgtcctttgtcttcccgggaatattcaacatcaggccaaccaaactctcacacacattcttttctacatgcatgagatcaatgcaatgatggacatcaagatctttctagtaaggtagccgacaaaatatggattttttcttccacatacccttctcctttgtcttgctacgttttcttttcttcccaaactcattgcttatgtccttgaccatattgtggacctcatcttcggacaaatctttgggagcaggctgaagttctctcttaccgttaaaaattttcttctttcttctaaatgcgtgacgtagcgggagccacctccgatgacccatgtataccatctttcgtgatttcttcagccaccgacttcgtgtatgttccttgcaatcggagcatgccttctttccttttatagtttgtctggaaagattaccaagtgcagggtagtcattaatggtgcagtacaatagaactcttagcttgaagttctcctgaccatatgcatcccacgtttccaaaccttctttccaaagaatctccagatcatcgataacaggctccaggaatacatcgatatcattgtcgggttgcctcggaccttggattaacaagcacaacataatatatttccgtttaaagcataaccatggcgggaggttatagttcgcaataagaattggccaagttctgtgagtactactcatgtcaccgaaaggattcatgccatccgtacacagacatatcctcatgtttctagggtcggcagcaaagtctttgtgttttcgatcgatattcctccattcaatcgaatctgctgggtgtctaagcataccgtcattccttctcttcgtggcgtgccaacgtactaacttggcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagtatccaagtccgcatattgcttgtggtacaatatgcagtcgtttggacaagcgtaaattctacggacctctaaccccagtggacacataacctgctttgcttcgtatgtcgtctcgggcaatgtgttctcagcaagaagcatagccttcaaaattcctaaaagacctgtgaaactcttgtctgtccatccactactttccttcagcttcattaggtccaaggtaactgacaacttagtgtgttttgctttgcatccagcgtacagaggcgtctcggaatcacagaccaacctgctgaacttcattccatctctctcattctgggctaggtcctcaacgtcatgtaacatgtcttgcagcagatcgtgatacacatcaatggagaaggtacaaacatgtcatgctcatcttcatcttcctgattatgcgcaccacttctgtctgctactgctccacttcctgattcttgctctccatgcttcacccaacatgtatagccctccatgaatcctcgttgtatcagatgaccatgtacgtcctctccgctatcaaacatattctcattcttgcaatctgcacatggacaacacatgtaatcactgtttcctcttttccgatcctcctccgcggcgttcataaaatttattacgccctttctgtactccgtagaatgacgtttcaaatttttcgcatacatccaacttcgatcaattgctacaaaataaaaaaaaacaaattagaggcacatattataagatcagtattgcaaaagtaagacgtgatgaaattgctcaattaatgaataatattactcacttgattgatccattttgatcacttttgggaatttaatttctattttccttggaaaaaggacaaaaaaatcgccctctacagcctcccaccaaaatagtgaacagtgggatacatttacactaggtggtggtgggtatttatactgtgcaacaaatatctgtaacggccctaaaacaatcaaccgtgacgggcatacaagtaatctctatcgggccttaataaaagcccgtcaaaaaagagtgtcatctgtgacgggcattaaacttatctcaatcgggcctctagttggagcccgtcacagatgaccctcatctgtgacggacttcttttagggcccgattgagatatggaaccctcatgtcaatcgggcctcaactatagcccgtcacagataagtgtcatccgtgacgggctttagttttatgccgatataccatggttatgcgaccatatctcaatcgggcgaaacttcggcccgattgagattacttccttgtgacggcccgcaaattccagttttgttatgggccgtcacagatggaaggatctgtactagtgcgagggccttgtcaatagggagggagaaggatcacgctccaggcaaccgctatggcacccaatttctaggtagctgcgagacggtagggaggaggatcacgctgtcgtcgccgtcaaagaaagaggctgagagggagagcgcgagggaggggtttacttggaaagtagtgtcctagagtgtgagacgtctactttaataatattttttaagttggcctacgggctgaagggctcctgtcattggtgccatttttctccttaaccggcattaatgtttggcccatcagtgccggtaggtttttaaataaacctgcactacttgcaaactagtgctaataaattagttcatcagtgttgggtttttaaataaactgacactgatcacattagtgcctactggtttttcttccgatcgatactgtcgtaatcagtaccggttatttgtccttcagatcatgcatgggttccaggaggagggggcagaatccttaccagtgtcaggtttaatccaaccaacacttgatagaggtggcattgataggctgtactttagtagtgaaatttctactaaaattttgatgtgaattttaactgaaatgctcaatgattagaggcatgcggagtaacatagatgtatactttatattggaactagctgcgtggcccgcgcaattgcacggctagcactcatataaaattatctattatttaatatgaatttactaaaaaattgttaaatagctatcttgttgtatcaagactttgaaaggttaaaccttatcatccacgtgtttctaattttatagtttttaaaagccatgctagttgctaccccttatttcttaggcacccctcgatgtaccacttcttctattcattctccttagaatgtttaaaaattagaccttgtagtttttaaaatttattgtctaatcggatttcatttttataatttttagatgtctcatccactgtctcctctttttattgtcattgtgattttcaaaatcaaacaaaactattgttcgggttcaattttttactttctagaagtcccaccaaaccgccagcggctttgcccccttacttctctacaacctacccgctgcctcctctcttcgttgtcattgggattttaaaaatcaaatgtaattatgattggggttcatgtttttactgtctagaagtccaatcaaaccgtcgtcggctccgtcactgtactcctctacgacttgcccgctgcctcccttctttattgtcatttagattttaaaaatcgaacataattatcattgaggtttactcttttacttttcagaagtctcaccaactgccgtaacaatgctatttaacgacccgcccgctgtccctcatcttaatcgtcgttggattctatttgagattttgtttatagtttttagatgacccatcaaccgtcaccgctctacttgtttacggacatgttgttttcccctttttattatcatttatcgtcattgtattctagatggatttgtttttttaaaaaaattcaatatttttcattccgatgttttgttatttataaattgtattcgtacttgaactcttataattattttatattttacgaatttattttatttttattttgaattttaatttatctcgtgatgggttttagatgatcttctctttcaatagctagtttttatgttttatttcgaaattgggttatttataaattatattctaattaaaatcttattttaatttttctattaatctcatattgtgttatatatgaattactgttttaatattccttatttttattcccagttttagtagtttgtaaaaattattcttaatttaactcttatttctgattttctaattttggaattaattttatttttgtacatattttaattaatctttaattgtgttctacatggactcttctttcaattttttatttttatttcgattttcaattatttctaaaatatatttccactcgaactcttttttttcttcaattaatgtggaaatttctagccttcatagtgaacatggtgactcttttaatttttttatgttttattttaattatttataaattatatttctaattaaaatatcatatttcttttttctctgattagtgattaatgtgagaatttctagcctcttgagtgaatgttggccattacaatattaggtcccacgttgatcagacaatatatatttcttttttttaaggcatgtggcgttatatatatgcctcattgttaatcacccgttaattgatagaatgatttcactaatagtatataacctttttaacatagtaatatatgacttatatgcgtaaagatgttctaggttctcaatatgtgctactactatgcgcttaatttggtctggtaataagctgcaaggtgctgacggtggaacagtggcttgcatgttattgtattttatatacctttgtttaattcaaaaaattcaattgtattgcgtttattaacatttatgttatcaatcttcaccgtataattggttctaccacaatctaacagcttagattttttcttcgattgctatgataacttataatagaaaaaaatataggacgactaagccgttgtcttaataataaagatttgtacccctctagaacgactatgatgattttctaagttatcttaataatatacatagataaaaggaatatctggaaaagacaatttacatatttattgttggtattatgtttttactccaaatgttatttttacgtttattttggaatctatattttcaaagaaaaactttttaattgtattgcttagggtatgcacctatcttgctgtcgtgcacatgctatcgtgccttctggttgctgacgtgcatcaccgagtccgactcatcgcgcagccgcacggcttgacctgctgctgcggatttccgtcgctacctactagtatctatcttcagatcaacaaaacacgtctaaaatagggctatgcagtgctttgttgcttgctgcttcatttattgcctaattcatctaggtcctaaatctgtttagtttcggaaatcggacaactctgttgagtccgtttgcatgtttggtcctagtttgagattgattctaattcagcacgtgtacggtgctccttatctcttactttaacatgccggatttatgttaaatctcatatgttaaaatatagacctaacaatctaacggtgtaaataattcatattttctccgattaatatgagaatttctagcctccacagcgaacgtggtgtcttctttcaaggctgttttaataatataatagatagatagatagatatatgcttatctaaaaaactgtatgtaggaattaatgtgtcatttcacaatgtttaatacatatactaattaatttattaatttatacagtaccagtatagtaaactaaactaatcattgtctgttcgttctaggacctactgacaataatgagagtatatcacatccattcaggcaaataaacaattccatgacagggtaagctttaattaggttctcgtattaatttggttaaagcttttgaaagcatgagcttggttagacaaaaaaagccatcacatccattcaggaggtctagaaaaaaattaccacatcaattagggaaaaaaataaaatatttccaccacttaatcatcgtgttagattgttaaaatgttgcatacaaaattgtgtctgtgaaatctgaagataagaggttgtatatcaaataatgtaattattatactttctaagtccattataaatatacaagatacaattatgtaaataacaactaatacaccatccgttttttgaataattatcaactttgacaaaatcatttattttaaaatactcgtcaccacgactttcgttagtaaaattacaactttgcccctactctggatatttgtcaccgcctatttcatcgcaaatcttcaactaaattgttggcttgttctgcgtacaatgatcaaaatgtctatgagttaaggagagagagtactggtatatataatatcctattttacttttacaatttagctctgcaaaattggtcgattattgcacgggggaaaatacactaaccaactatttcttgttagataattaattagatcattgctgatccgtttttgtattatagtcaatgcaaacagaacagatggagttctctcacagactccagacctactagctgcaactaattaagccagcatgcacatatggacatgaactttatacaaagctgtagctgtctaataacgattgaagcaaccatattaatttgttaacgaaacatccaaccgtgcatctggaagcaacattcgtgtagtaccaccatttattgtgtggccaaggatcggtagtacggacgtcgccgatctgctactgtgtactgtatgtgttgtcattgaggtcatcgtcatagatcgatgcaaaattgcaaaccgcgcgatgcgtatagggacgatgagagggaaattaaagctagcgacaggggctgggggctatggcgaaatcgccgaaatgtgagtgttacccttcgaatcttcgatcgattttaaaccaaataaaaaaaaagaacacgtcaataataattaaccagctagctagctagacgggtttgcgtttgtgtcgtgctaaaagccacataattttgtcttgctaattattagctattagttgtatttattattagttatcacctgtattggagaatgtattggttgtgtatactcaagtattgatgcaaatgtgcaatattgaaatataaattcgtcgtcacgatgtgatttgatttagatatataccaaatgtacttgtgatccaccaagttgggcgatcatgggacaccaaggaggcaattgtattcacgggaagggatctgcctggctataaaaactggacaccttccgccccacttgatcaaggaaattggccggatgcaaaagtagctatcccgctgaaaaagatgggaaaaagggtttagtggccctacaagtactatctatgtggagattcacaaagggggtgtttagatttaggggtgtaaagttttagcgtatcacatcagatattatatagggtgtcgtatggcgtgtttaagtactaataaaaaaactaattacagaatccgtcagtaaaccacgagacgaatttattaagcctaattaatccatcatttgtaaatgtttactgtagcaacacactgtcaaacaatggagcaattaggcttaaaatattcgtctcgcaaattaatcataatctaagcaattagttattttttagtctatatttaatacttcatgtaggtgtttaaatgttcgatgtgatagggtgtaaagttttggtacgggatgtaaacagggccgaagtcaccataaacatctagaaaccttgctgtcgacggatatatcatttatcacttaaaaaattaattagtcgtaaatgcgtgtagctggtgataatgcaaaacatacatacattgatgtgccggtttggtctaaacgaatgctttcttcctccaccttttctaccttaaattgaagaaaaatttattgtcattgaggatgatgtaccatcatttgaattgaaaacagtataaaatcactctcaatggaatgttgcagggtgctggcaggggcggtgaacctgcgcggttggcaaggcgcgcggctgcaacagaacggcccatgcatgcaagggtccgtgcgattaagggcccattgccgatttggattaacttttggagaacaaggacgtacgttcctagctgaaagcacatggttagatggttgctacatatgttgactcattttaatatactttttaaaagtttgtttgttttgcaatgaaaataaacattgttgtacttttctataaacttagtcaaataaacttagtcaaatgtaaacaaatttgacttaagataattccaaacaaaatttatattatgaaaatagagggatggtatactttaattagggttgtacgcctgacgccaaaagaagttagagaaaacttaacactctgcactaggcgtacttgattcctgccaaatgttgctcctaattaaaccccatgcatgtatgcatgtgagctagccgcgaatactccataatccaggcatgcttaattaatatacgtgtgtactccaagtgcatgcataagccagatgtagctagctagcttagctctgatcgcttaattaatttgcaggcatgtaccctgaacaattttaaaaccgttgtgagagatcattagtgggggcaatggaatccacaggggttgtgcgtagcgatgcctccaaagccggcacccaactcgcaagattctcgctttgccaagttgatctcgctcgatcgttagcttgcttctgttttgatgggacttgagcctctctctctggaagaggccaatattgcaatgcaataattttttgaatggaattgaagagacgtaccaatgcaatgcaataattgttttgtctgctggagaaaacagcggaatgtaaccggccaaatactatacgtgcgtcgtcggcggcgctagctttgacgtggatgtctatacatgtgtgtgttgttcttctaagttctaaggttgcaaattaactagaatgcggctaattggccgatgcaaatggagggagttgatccttgaaaaaaataaaatacccctctaataccgagatttattctaaggatgtcatgataccatgcatgaagtaactcgattttaccttcgtgatactacatcaatatcgatcatttttaaaacccatgattatcgttgagtatcatcgtatattgataagtatcatcaagtatgtatggaccaatatcattgaatatcatcaagtattttatcgcgtgtatatcaacaagaatcattgagtatcatcaagcgtactatccagagatatcacgacatagtatcaagtattacattataccaatataataaatcaatatcatgatatctcaaggtaccatgatatgatattatatagtactatacgatacagaatgatagatcgatatattatggactggtacgacacctcgagataccatgatatggtaactcaaattatcattggtatcatcaagtattattggtttagtgataaatattattatggtatcataaatatttcatatgttggtaccaaagactcaaaaacaggctttcacgactaaaagaaataggcctgttcttttctccaataggagttggatgaaaattaagattttcgtggtacgttttttaaactgctaaatcgtgcatttcgtgtaaaaactttctatatgaaagttgctctaaaataacatattaatctatttttgaagtttgtaataatgaaaactcaatcaatcatgcgttaataccatctcgttttgcagaaaaaacttaatcttcatcttcatgaaaaaataacaccaccatactctatcacaaaatgacaaaatgacaaaggaaatagaaaaagtaatcatggacaatcagcaagcctcgacacactgtcgggccgcgacgtcaccttcgcgcggtgtttgctccgcctccgcgcgatgccgggctactgctacttcggcctctccaagcgtccgcccgaaccgtgtcaaataactgcgggctgcggcgctgtccctccgtctgcgtgatccgacaaccgcctgtccgcctcgcctccgtgcgtggccggacccgacccgacccgaccccgcccagctgccgcgtgttgcccggtggggacgcctcatctccagtccacggctcaacgtccacgcacacgcactgcgcagcgcgaggaggccgcgcgccgcatcacatacacgggccacggcctcacgggggggccttcccgtggctagcccacgtattcccctccttcctgggcctaagctagcgcccgtaagccaaatcgcggccggtttccgcggatctccccgtggacctcctcctccgtgtggtgtgatcgccagtaacgcccaggagcttcgagagaattccacaccattcccccctaccaccacgcggcgcatcatcacaatacacagcctctgcttcccccggcaacccaaccgattcgcgctcacgccacctgcaatccgcgaccagacgcgcgggccgttgagatcaacaaacacatcgcacgcgacgccgcgtgagcccgtacgatcgccccctcccgcgccgcgcctccgcactctggttggttgcctcgccggcgatgtcgacgcagtccatctcgcccgccgcggcggccgcgtccgcgcagtactcgtacccggctgccgcggcggcggcggtcccgtcctacttccccgtcccgttccacctccagaacgtgcagcagcccgccacctggccagcggcgcccgcggcgtacaacgccgtctaccccatgccccaagtccagcaggtaggaactctgcccctcttcttctgattacgttttcaaccgctcctttctgtgtgaattctactgcccgtttgttgatgcggtgatggcggattagggaggatctagactctgttgttttagaggcttggagtaatgccagtttggggataatgcgctatgtcatgtttgattcaactgaaaggctcatttggtctttcgtcatccacctttcatccttgggacaacacaatgtaaaagtggaatactcaatggaagccaattcatattgcactataccagtgtatcatatacagtttgtaggttgtgaaatctgtctgcagaatgatgcacagaaatctacatattcggctcatgttatgcaagatcttagatgctacgtcatgatttcatttctatagatgtagggaggcgtgccaatgtttatgttttctaactctgaattattaacatttgatgagagacttgttcagtgcaactgtaagttgtatttcagtgtaaatggaaaaggatgtagcttcataaatcaagaacctgatagtactaatttttattttggaaactagctgtaactagtctattatggtatcaccacgacgcaggttcagcaactgttccagaaagattcacagataatcactcctgaagctctagctactgtgaaagctgctattgcaaatagtgagaaagacaagaagattgaagcaaacaaaaaggcagtacctcgaaaggcagctgggcaatcttgggaggatccaactttggctgactggcccgaaagtaagatctctttctcactatttcttcctggtggttgtgttggaatgttgtggttctatgatctataaaatcttgaacttggcagtgtgactttcccctcgtctgaacttgtctgaatgtctgttatcctcacgtcaacaaaccatcaaacaccttcaattccccaggcaagatctaatgttcgatctatgtattctaataagacaaactttcccctgtttccttctgttaaaggtggccgaggatgtgatatgtagcccaacaggtttcagagttgatgcctgtctcgtggaattaggtgggctttgcagatgatatagtaaacatttcctgtgcctttgccattagtttacatgcattgtcatctcgtttttgcatgcctaatttgattatatgaatatgatatttgaaaatttttcatagagttatacagagaaatatgttctactgcgcattttggtgcaaactattccacttatattttttattctaatgttcctggtgtaattttgatgatacacttaccatcctaggattaatatggtgatagattcttgttggggactgtccaaataaagatcttcccttatatatattgttatcaacaaagcatgaacattattaaaaagttttgttccatatattagtgattgcataaaggatgaggcttttagccaatcaacttactttccacaataatctgattttatcaattcgtcatgttgcgttcctgttagtcaatataacatgtactgtagctcagctcttgcagattgtttgtcatccttatttttagatttttgtacaattaaatatattaactgtatttagcatttttagctacagttttctagttttacatgcttagctgacgtatcagataccactatttagttgtaatacttcatgatgtgtcatccatcatgtaacatgtctaagatgtagcagccttgctgagttgatgtataataatttagcagcagcatgcaatgttggcagcgttaaatacttatgatgctatattgtctttggaatttactagcacctgacatgagtatgtatttgtgctgtcatgtttcgtcataatttgatagaagcaaatatattattctactttagtctgtagcaatgaccaaaaatggtgctataacagttgtttttctcaaatgtgccctctttttatttcaaagcattcacacttacatctgacaaattttccccatccacagatgattttcggttgttttgtggcgatcttggaaacgaagtgaacgatgatgttcttacaaaggcattttcaaaatatccatccttcaacatggctagggtgagtcacaccgtatatagcatggcaagcttttagattcttcattataatacctttttgctgcttcaagatgactgttaataatggacgtcttctgcttcaggttattagggacaaatggactggtaaaactaggggctatgcctttgttagttttgctaatgcgtcggatcttgctgcagcattgaaagagatgaatggtataagttcatgcccccattccctgtcaccatttgcctggattatcgtcgcactgcagatatgattaacacatctaacatcatgcaggtaaatatgttggaaacaggccaatcaaactacgcaagagcacatggaagaacagaatcgactacgaggcattacagaagccgaaggttggttcccattgttatcttgtaagacttcctctttctcttgcagaagtgttcatttaactgatttgttttatgcgtgcagactcaaccacagaagaagttcaaagcgcagaaaaaaagcattctacacaagtgaagtaaattcactctctagagagtgatccctagtgtcatgttgcacatgagtcctttgttgctcctgcaataaacgacgttaaagccttcagcgcccggcggtgcgcttgtcacgtttggcctagtgattgttctagggtagtatggctcgt

SEQ ID NO: 63901 - DNA, 1406 bp, Oryza sativa
attaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagcgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaattttgcacgtacctgcctattagtaaaaattgtgtgtattatgataaagaatattatctttacttccaaatcttctgatagaacatttccctccccaactatctgttaatgcaatatcagtcatcaaatatgtgtcactacataatatttatataggtatatcttttagttcaaagagtataattcctcctgttaaggggaatttaactatttgccacttttaggtttgccacttatctaaatgctcctcttaggcttgcgcttaataatttaccactgaagagatgatttcttaactatttgcca

SEQ ID NO: 63902 - DNA, 1847 bp, Oryza sativa
tcaccggtaccctaactgaagaacaaattcagagtaaatgactctgtctcagcctctcaggatgaacagttaactgatctagccacagagagcaatcaattcttggctctgttcttagctagatctcgtgaaatccaggacttggggagttcagggtaaagaaaacggcagatgttttttcagcaatttcagctgaagcagagtagaagcagcagctagtataccttgggcggaggagggattggttggcgtgggagtaggcgaggtggccaaggtcgccgagctgcagggacacggccggctcggcggcggcgaggaagcggccgaccagctccgacgcccgcgtcttgggcgacggcgtccggctgccggcggccaccagctccgccggcacctccaccaccgcgccgctgaacacagccaacatcctctactctactgtactgtctgtctaatcaaagctaattaagatcactacacacaaactatgaaactactccaatttaatccaatcctactgctaaaactctcctctgctaatgatcagattagcatagataaaaaaaaaatacgtgtggcgttccacactccttggatggatagatggatggagcaagaaacggagctcacactggatggatggagaaatggaggaggagaagctgctttatatagccacaaacccaagcaatggagctctgtttacgtgggggccgcactgacgttttcttgtgtgttaacctccgattaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagctgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaa

SEQ ID NO: 63903 - DNA, 3704 bp, Oryza sativa
attttcaaaattttgataatttcggtaaccctggcataaaattcaatttcgaaattttaaaccctgcccgtggaacgggcacgggcgaggtgtctttggatgcccaaagcgtctccatgaaatacgtcgtcggaattccatatctttagtttcaactcggagaataatatttgcagtagaaatataaatgggttaattcatgaataatttactattaaaagtttgatatctgtattatttacgactttagaagttaatataaaaaataaactgcaatataaaacctcaaaatcaactttaattcataataaattgaggcgaaaaggacctcaaaagcagctgataaagtcataatttcttttgaaataatacaactttaatgaaaaattgtaaaaagtatatggtgattgtttgaaatcacaaatttaacaccatatcgaacaaatcgttgttcaatagggtttaaacaaatcgagaacttgggatgtgcgtacatgcatgtgagtgggttgtggggcctatcgaactttgggagtttgataggccaccccatatgcttgctatttttttttaatcaagtcaactatactgtcgaacggccgttgttcgacacgtatatctgtaaaattttacaatggttgtttgataggtatcttatcaaattacggttgttcaacacggtgctaaatttgggatttatatcgatcaatatctattttcacaattttcattaaagttgtattattttttttgaaaaaacattcgataaagtcaacaggtaaataatgaaatgcttctaatatcccgtaggctcgtagcaaaagagatgtcggagaattttacctcatcgtctttctatcgtggcgaatttacagtggattttgttgagtttactaccttattatgaaaatcttgataatgtaaaaactccaaatgtttctattacaaatatatttaacaaaatatacatgctgtttaaaaccggattcttccgccctctccggtctccaccccatgtcgcatctaggtcgcacgaagagcaaccaccagctcccaaaaagaccagaaaaagagcagttcactagaaaaaaaaatgtatatatggactcgtatagcctatcctcgatcgtatgagcccgttgcaaggtttgacggcaagtcaacacattgatccggaaatatattttttcttttaggcaaaccagaaatttcattactcatgatccgagatatcctcagcgacctaaagactgatacaaactcgggggctgttcagattatagccaaaataaacttatcaaattttgacattagtaagttgacaatattgcaagttttggcagaatagccactattgtatagttgcctaattccttatgtatttaccaaagttgggtaaaaaactaaatgtacacacatctttgacaactttataaaaaaaagagtatgatttgaaatagcattaatctagacaacccctgactatgctatgtaaagtgccaatactttggtatggctttcaaaccaaaaactccatacaaaccaacttcacaaatatgacgcagatgtcaaccacaataatgcagagaatgcaagcaaacaaaaaagaaagccaatagacgatcgggcgctatacatttttgtttggaatatcagaaaaattgtttcaggtattcagtaggaatttattttcttccagatggggtttgaccgataaatacatttgtgtttacttaaaagaagacaagcacatttctgagacgttagagatctacgatgggcctgttcactttgttgccaaaaaaaaccttaccaaaattttggcaagatttcttatatagttatcaaaatttggtagcaaactaaatgtagccacttttttagcaacattactaaaatttggtaagtttgaaaatggcatcaaagtgaacaagcccgataaacagagcaaccgatcaagaatgacgctagcactatataggatagtaggactataggtggtagtagaacaggcttcaaaagctccaaatcttccaaggaacacacataatgcaaaagtacaagagccagcaacagcgagaatgaaatctgaatcacaaaccagatgtcccaacacaatgacatatcctaacaattagatgagggcaactgcaactaatagactatcacattctgtcagattctgctaaattgtccttagtcttgcctagtttctccccccaaaattaaaccgcagacctaatggattagaatagagcccataatttgtcatcgcacatggcaaagattaacagccatgccctacaaaatgtgtcagggatgggggtgacaaaagatgatagctcaatagctgatgctactcctgaggagttaagcagacattgatgtcaggtgaaggcctgtgccccatggactgtgagctgactggccacccaaccatggtgaaacctgtggagcttgagctgttaaggttcatggcgccactggctgttgcactgtgctccattacaccggtgtgggcttgcggatgcatagatgagacctgcggcgcatggcaaccattagttccaggagctgcctgagagataggcattgcagctgtgagcacaggaggtggagccataggcggtggtagtgccggggcagcagatgttgctgttgtaggcccatcctcctctgatgctgctttaggctgttgggcaggaagctccccacaatcacctgtccaagaggtttgtgttagtgaacagggaaaaatggtatttgcgtttaacaatggcaatgagacaagaggagatcaatgttttatgtcttgttgagttaattgttgagtgtattggttgatttggtagaagatgcccagttctctttttacctgaatagggcttgcggcacgcagcatcccagctactacaccaccaacgacacggccatcaggaccggcaagcgatacactgagcccaccagttctcctccgaccaccttcttccgccattgtaaaggagccagtcagttgcagaatctcaaaccgaccctgacaatcagataaacgagatgatttagtcttaagagtttgaaaatgagcaccgtaaatacaaactcatatgcaggatatatgacgacttctcttaaattgttatcctacactcatacggccatccaaatgaaactttttgtctcttatgcttgcagttatatatatggagttatggtcttatggatgggacaccttaacccttagcacacatcccatgctagttgctgactgtttccaggatgatgttcctgagcctcatgtacaactttcagtcatgcataatatgcgataacacaaactgcccaaaatcaatgtgagctatcatggatggagcgaaaaatggtaaagtcatttaagcagagtattaccgacttttagtgacgaaaccttcaagagcatcttacatgaggtagctaagacttaagactcagataattgagatgaaacagatgaaatgtcaaaatataccccctcatagaacatttaggcaagaaaaccatttgtcgtatttactccgttatttattacagtggtgatatgggacctaaaagacttggtagagaagaccccaaactaaatagaccaaaatggttcagcttattcaggactttgtacatacccatcaaaagttaacaaaagcgggtaccgagctcgaattcgccctata

SEQ ID NO: 63904 - DNA, 4211 bp, Oryza sativa
ttcaggtgtgctccgctaaatgttctgctataaattatttaattcttgaatgtttatcaaagcaagactttttcacaacttgcttgtgtattgttatattgatgtgcatgcaatgcacttttgatcccgacaaatttatttaatgttgtgagacattgagtttgtttttaggatcaactcaagtacttgatattattgttcagtgcaaaacatgaattaaacataatattttgtttaatcattttccataatctccaggaaatttgcaaggaactacaagattcttcacctgcgaaaggtttttgcaaagatgaacatccttcaaagaatgattgcatttctgagctgcttagcagtgccatacaggatcatttgaagaattttgataggcaataccgtttaacagttaagaaatcatctctctccgggagcaaataattaagcgcaaacctaagaggggcatttggataaataacaaacctaaaaatggtaaatagttaaattcctccctattaatgccaaagtatacctctaccttccacaaaccgaaaattattcctcactcaaaccgcaaaaatgattcaaataatctaggggcaacagcaaatttaccacgatttgaatcgtcattaggaaattatgaccggaattgtcattcgaatggcattcttgtaaaataaaaaaaaagatcaaaaaatttgcaaattccccaataatctatgcagcatctcatgaccagatctgctgattgagcaatcgcaaaataagcggaggagaatccacctccacaagctgataagtggacagcatgaactacgacactgttgtagtgttgtagagaaaacgactgacgtagcaccccaaattcgtccacaccattaaacatccctttagttcgtaatgatctgtcttaaaattgacttgcactaaaacatctaattccccattcccgtcgggtacgctcaattatgcacaaaaagaatttgcaagaaacgaaatgatatttttttggtcactcagggaatcaagaatccagcaccatacatgtcgctttggtacgttagagaagaaaacaagtggataatcaattaactcagttagatgattaattggatgacaaagggatgagtcatcgactcatcgttaattacgtcttcagagaataatattttcctctgagcggacgagaaaagtcgagtatctgctctgagccgagccaattttgttgaatttaggacttaatttcataaagtcaccagcccatgcattacacagattatctaggttgtgatagcacgatccacctaatcaacaattaattctttctggttaacacataagctctttcagagtgtctaattaatataggtgtagatagatttagaggtcttattaattaatgtaagcttttttttcagtcttagcccaatgaatttcttaaccaaacataattcgagaaacgcctaggggttttctggctagctacacaagatagtgagctagataatctgggttcgaagcataacttcatctaattatttgatattaggtcattccttaatattcatgtcttttaaccatacataattcttccggaaaataatgtatgcagtcttcttgttgccaaactgatctgcattgtatagtgcttgttcttcgttaccaaaaattaccattcctcgagcgtgtacaaaatttaaatatcaaaaatgtttatatttgggaatggaaagagtagctaagttgaactaattttcattttaggtacattattgattaacctacatactatgttacacctttcattaaaccattttgaatatccaatccaaatataaaaagaacataaagataatagaagttttagaactttccaccggacatgctacgtttgtattttattcagtttatttgtctgtatgcacaaaagcaacactccattattttggactcaagttaatagtctaattcgaattatgtgcattaaaatatcgaacttacgcaagccatgacatatgttgatagtcccatgtataaacaagtaaaagaataaaagaaaacccagtttgctatatcgtgtgacaccctacgtagtacacaatacaccatatgctcattgctaaaaaagaagaatatcctagagtccaaggagtaaggaatcattggcaagtcactctccttgcaatacaaaatggaaaggaaaacaaaacgaacacaagtggctaacatttttgcgaagagcttgacatggtgacacaataggaggagaacgatgaagcatttgacaaattgttttgctaaaaccatttgacgtttcagtttgttttacacaaatacaagaaaataaaatgaaactcacatttatactaaatcagtcctttcatataggctgattttttaaaaaaaactttttagagacataaaaaaccctcatatacaaaaatgagccttgtggggctgtggcacagctaaaactctgacattgattgctcagcagggcaaaaccttgttgtgcaattatgccaattaacaatgtcgtcttaaaggaaaacaaaaacaaaaaagaaaaggaggaagaaagataaaaagttgtacgcaatttattgtcaaatcgatattatggaaataagactgaggtggtgtttggatccagggatttaactttagtctctgtatttagacactaatttagagtattaaatatagactacttacaaaactaattacataaatgaaagctaatttgcgagacaaaatttttaagcctaattaatatataattagagaatgtttactgtagcattataaaggctaatcatggattaattaggctcaatagattcgtctcgtgaattagtccaagattatttatgggttttattaatagtctacgtttaatatttataattagtgacaaatatccgatgtgataaggacttaaaagttttagtcccatctaaacagggtctcagtgagtcagtattagtctatgtaaatgcacattagttgtgcagtcagcttctgcagtagcaagctgggtggctgcaacttcaacctcatctttgaattgaatggaacggcttaattatcatggtcccggataaggttcatctgtaaaatatgaaaaaataagtcattcttttgcattctatttatctcttcggtcttgttgcaaacccttaccttttgttttgatcttttttttatatatagttgtgtgtggcttagttgaatccgttccgagtagtgaagtactgaccaaaatatccttgtttaattgttgcaaaaccaatgggcgcccacaggattagataagacttaagacccacggatttgctgatttttctgcacgacctgtggactgcagagagaatctagccatgtgattcagtgctaatgggattcttctttagttcttccaaattgtgttccaagagtttaatttgtggtatggatacattgtaaagggatcaaatggggacttgtcaactttagttaaaattctgattaaaagtggctggcctttgcatctccaacatggtcagcacaagtctgctgttcttctcctctaggatattttttatcagaccttgtgtttatcacatccttttctgtatattttttcttctaaatatgttatgctagtactactagtagtaatttgtgaaaaggaatcaaacattattgttttcaccctttccctttcatgagaatgacagccactgaaattatcctacaactaattaatacaacatcagtttatctaagctaaaattatgcaaacatagcagctgcaagttggcaagaggcatacctaaagttactgcactacattatttcaatggccatcgcctcgaaagcgattgcctggatcaggggaagcacaaagaattactactagaaaagcaagcaagcaagcaaagaatcttggctttgtaatttgccaacccacacggtgccaatgaatctagtacacttttcagcgtgtcaattcatcaaataatccaagttgcagtattgctttgggcatataattataccaattcatgttaatgtgaatctttggtttcgttcttaatacgaattggaagcatctcgaaggaacagttcaggaatggtttgtgcccacagtttcgaaaccaaagtctccccaaccagacaaggtttcagctggtaaatttcttcagagcatttctaattggataccacca

SEQ ID NO: 63905 - DNA, 992 bp, Oryza sativa
aacagcagcactcgatgatttgggactcaaggacatagtctaattcgaattatgtgcacacaaatggagaacttacactagccatgacatacgtaagctagtcctatgtataaacacgtatagactagaagataacccaggctgctatatcgcgtgacaccctacgtaggacacaatacaccatatgcgtcatcgctcgaaaagaagaatatcctatagtccaacgaacaaggaatcataggcaagtcactctccttgcgatacaaagaggacaggaaaacaaagctaacagcagtggctaacattttagcgaagagcttgacatggtgacacaataggaggagaacgatgaagcatgtgacaaatcgttttgctaaaaccatttgacgtttcagtttgttttacacaaatccaagaaaataaaatgaaactcccgtttatactaaatcagtcctttcatataggctgattttttaaaaaaaactttttagagacataaaaacccctcatatacaaaaatgagccttgtggggctgtggcacagctaaaactctgacattgattgctcagcagggcaaaaccttgttgtgcaattatgccaattaacaatgtcgtcttaaaggaaacccaatacaaaaaagaaaaggaggaagaaagatataaagttgtacgcaatttattgtcaaatcgatattatggaaataagactgaggtggtgtttggatccagggatttaactttagtctctgtatttagacactaatttagagtattaaatatagactacgtacagaactaattacatcaatgacagctgatttgcgagacaaaatttttaagcctaattaatatataattagagaatgtctactgtagcattataaaggctaatcatggattaattaggctcaatagattcgtctcgtgaattagtccaagattatttatgggttttattaatagtatacgtttaacattgatcattagtgaca

SEQ ID NO: 63906 - DNA, 4395 bp, Oryza sativa
gtgaagtttacacatggtcagaccagatggaacgctatcgtcaactacgaacagtggctagtgaagcttttttccgatgttccatgacagaagaaagtacactgaaggtgatgaaaatgctagataatttgatgcttgaagatgactgtagtgcaaattgtgacaactttgagattcagtttggtcatgtggttcgtcaaagtatgcgcactgacattgaaagtagtgagaaagtgcttgatccagaactagttgtccctaaaggagctcctacaaagagaatgagaggtttcttggagaaacgcaagaggaaatgtgggttttgtcgtttgacgggacatacaataagaacttgccctgtttacctaaggcaagttgtcctatttgttattaacctcttcataaagctaatattgttttattcactgaaattgtaatgttactttgaacatagtactttcagtccacgaagacataagacgtcttgagtctgaacatggcaaactacatgaagcgtctacatctcaagttaccaataggatttagggacttatattgcaacactgtgtctacatctcaatttttctttccaaccatgtctttgaatctatcggttctgattgtcccaactgtatgaactattttgacaatttcaatctatcaccaccgatttattgggggaaatatataatacccatacaatgaataaaaaaccacaaaaagcaaccaattaacacacaccttatggatcagttttctccctcactctgcatgttgtgccacgcatcgaggccgctgcccgcagtggccgacgattcaccgtcgccgccgacgatgcagccccggccgcccgccgtcaccgacgaatcatagcttcaaccattgccgggctcccgccgacgaatcgccgccgccaacgatgcagcgccgcctacgcatcgaggccgctgcccgcagtcggcgacgattcgccgccgccaccgccgatgcagcgccgccgttgcatccagaaaagtcgcgtccgctgtcgccgacgaatcaccaccgccaccgatccagcgccgccgacgccggccgtagccgtcgaatcgccaaggcttcccgatttgggccgccatcgctcgcccttggcatttagggtttgtttgtctcctgctcctgcccgacgaatacgaggctctattctctcgcgatacagagaaggaaacagataacgcgaaagtacaaaactaccctcccacacacggtactgttgtgatacgtacgtgcggtacgacgaggtaccatcgattttggaccgtccgatgaggccagatcaatggtcaggatttggtaaggatgggaaagatgctcttataattgagggtcgaaaactaaattaaaccaatccccaaaaaaaaaggtgccatctaatcctcagcaaccacaattctagctggagatcggttaagttcagttgcaatttttggacgccgaagccaattcaaccagagttaactgctaaatggcattcccaattgtgagaaaaatattatactgctagtttccatcacacgatgaatgggagattctccagagtatcactcgcatccgccactaataattctctaccaaattacagacaacgggagatacatttcagaaagggcgatagaatttacttacgcgtgggcgcgcgcggcggtatcctgctcagggaagtggtcctcgatggcagccgtagccggtgagctcgagctcggacggcggcgccggcgatgggagtccttgacgtttgtgcccaagttgccaacccacgtagaagatcacttccccttagatcaatacaggggtagctccggcggagactgcaggcggcggaggcggcggtgatggaacgggccggactgggtcaactgataccagtagtttaatcgaagcccaacatggccacgtgcgtgattacaggctactggcccagaacatattgggcttcaagcccagtacacgttggtgtctttctaggataaaagaagtaaagaaggaataagtttatttgtcatccctcaactttacgtcgagtttgattgacatccctcagcggtgattttgcttcacatgttcttccgaagcaccgcaaatgtccccaaatactgcaatacattgctaccctgcataggacatcgcaaagcagggcattgcaaagtaaacttacatctacaaatattcctcagtaaaacggcattgtatttgtagatgtaagactaggctaaaaacaatggcaagactaggttaaaagaaaaaaaaaactcctgtcttttgatcgggaaacaatagggtggtaagcactgaaaacctgatcactgatcatgatgccctctgtgaccctgttcgttcgtccatcttgctcccgacagctttgtattaaaactgtaaccctgtgtcgttcgtcctttgttcttcttttccatggcgcgtcgcatgatcaccgtagctgcatttggctttagcttacccagctagcatctgttacaactttctctgaatatataccatatcctctttgcctctttgcagcatatgctctgcttcatcatctttttccgctgtaattaacctgaagaaacgtggctggagatgatgcagacacgctggtttcatctagaagtacgcacccagccagaaacgaaatctgaacaaacagcagctgccagtctgccactgcacggtagcagtgtgtgacagtgtgatggatactgtcgtgcatactgatgcggtgcaaagcgaaatgcaggattccatttagcaatgatcgccactgcattgctcctctcgccatattctgtcgcccggttgccggacacccacaactgtactcactccgttaaaaaaaaacgaatataatattagatatgacatattatcatagtaaaataaatctaaacatgttatatctggttctagattgattttatagaacgaaggggtacgtatcagtagcatttttttattaagatatagagtacatattttatcttagtttctattaacatgcttttaacatgttaaacgatgtttttttataaaaaactttttatatagaaattacttaaaaaatatcaaatctattttttaaatttataataattaaacctcaattaattactctcttcgtctcaatatataaatatttttagcatagtgtcaagttaaacatttttaactttgactattaatagaaaaaaaataaaaagatcaatcatttaaaattgatgttacatgatttatcattaaacaaactatgataatatgcaactcttttaatttaaaacatcttatttttacaggtattgttggtcaaagtactatctcgaagactatattgaagtctaaaaatacttctattttaggatggaggaagtatatgtcaatgaatttctcgttttgaatgtgctgtctttatcttcattttaacatatctcaaagatagcatctctgaactagcatcatctcattactcttcctataaattggttgccaaaactcaaatttagagttgatgtttgggagttcttattttccatgtggcttacttttcggtgttaactcaattttaaactacgaataacacaggttaaaactttttatttgtttgttcatatgtcattttacagtttatctgttgtagactgaagaatatttttaagttttatccacaaattattattattttattgcttatatgcagttttacggcctgtcagcggtagaccggaagaacaaatcttactagtaaaaagaattcataaatacaactcaccactgagcaacatgtttcaaagttcataggaattttgcggggttacatgctcgaaaagtccaaatgggcctaaaatatttgtatatactagtatagcactatggagatactcgttaataagttcttttttggtgagacagtcaccaaccaggcaagtgaccacgttcagacaaagtcagatacgcgcagcaataatttactcccgtccggggggacacgcacccggcaactatttggcgcgacagcgcggcgcccgcgtgcgcgccatgccagttcggttcgccgccgtcccgcgtcccccaccacgtgcgccggcaatggcggcttcctccctagctttgcacgttcatccatggcagcttcctccattgggatagcctgtcttgtcttgtctagtagtactccacgggtgtgccggggcagctgtcgtcgtcgtatgacatgtcagcgttcgcggcggcggcgttcgcggcggtggcggtggcaactctgaacggcgggggaacgtacggaggcgtggcgcaacggaggagcgcccagttgacgccgctgaagaaggggtgccgcttgatcaccgcggcgccgacggtggcgcc

SEQ ID NO: 63907 - DNA, 14159 bp, Oryza sativa
atgaacataataacctaagtactgtactgtgatgtgtgtattattacatcactggagcaagtatacactagcaggttgtaaacaaactctaaaacgtgtgaaagagataagagagtagagagaaaaaaaatagagaggagattataggctttgtttagatccaaagtttagatccaaacttcagtccttttccatcacatcaacctgtcatatacacacaacttttcagtcacatcatcttcaatttcaattaaaatttaaactttgcgctgaactaaacataaacacagccatagtcgtaccaatgtgcgacttataatacactagtttaaatgctaggctcaggtcaggtactagtataaagatagtgatgcgatggagtagtactataaagaaaagtagggttgtcctcgccccaaaaataaatggtagagttaggtaaaaaaaataactcccactcccccaatatataagtatttttatcatagtgacaagtcatctattttcaactttaattattaatattaaaaaattaaaaaaaccaatcatgtaatattgatgttactaggtttattattaaactattataatatgtaactcttcttatttaatacatcttatttttatagatattattgttccaaatagtatttcgaacatcgtattaaagtttaaaaatatttatatttttaaaatggagggagtactactatccattagagccgcatgttttggacgcgcagcgcctcgtcttggcgcaggccatagcgcctccgcatgcggcgcatcgcggtatgccggtatgatgtcaatgatggcagctaccgtgcccgtgcgccagcgagcgtggcactggcacacacacatgacattggagctgcagatcttttggcgcgagcgcaacgtgcagccgtgcaccaagtctgagcttctagaatgagccttgtccttctctcgctgcatgattaaccttgtactataccattgccaaagctgcagtgatgatgaggtggcggttggtgtccacaagaccacaagttcagtgtggatcatgtgcacacaacgaatttaggaattgcataatcgttaaagctgaatctgaacaggtgaatgcgccttgatgcccagaccaaactttctgctgagtcaggcaacacacagggacagcgacagtagtagttttttttcccccaaacgacgtcgatgtgcatgtcctctctgatagtgccagctacagatatttgaaaataaacttatacagtaatcaatatcacatttcaaacgacgtccaatactgtattactcccttcgtttcttactataaatcgtttaacattttgaatataaaacaaatattatattaaatatatttaatgttaaatttaaaaaattaatttgtgttatacagtacatgttactattttttataaacttagttaaacttaaaaataattagtatatcagataagtcaaacgaattatcaaatgaaacaaaggagtactaaagaaaaatgtaacaaacctgaccttcctgcagattgacgagagctcagagaacccgcactggcgagcgatcgggtacagcccgccgaccgacgaaccgccggcggaggagcacaccgaggcgacgaagcggccactcgacgacggcgtggtcgagaccatcaacctcacggacgcgtccctcccgtcgtccctcgcggagaaaggcctcgcggtgaccgatgacgcggcgcgcaacgtgtgccgggtggagtgcgacgtcgccatcgtcggctccggctgcggcgggggcgtggcggccgcggtgctcgccggggccggccacaaggtggtggtcatcgagaagggcaactacttcacgtcgcgggactacacgtccttcgagggcccgtcgatcaaccagctctacgagtccggtgggttcgtcaccacgatgaacggcggcgggctgctcctggccggctccacggtcggcggcggctcggcggtgaactggtcggcctgcctcaagacgcccgagttcgtgcgcagggagtgggcggccgcgcacgggctcccgctgttcgccacccccgactacgccgccgccatggacaaggtgttcgagcggctcggcgtgacgtcggggtgtacggaggaagggctccagaacaaggtcctccgcaaggggtgcgagaagctgggctacaaggtcgacgcggtggcgaggaactcgtcggagggacactactgcggcagctgcggtttcggctgccgcaccggggacaagcgcggcacggacacgacgtggctggtcgacgcggtgggccgcggcgcggtgatcctgacggggtgcaaggcggagaagctggtgctggaacgcggcggggcgaggggcaggcggtgcgtcggcgtggtggccaggagcaccaacccggcgatcacgaagacgctggaggtgcgcgccaaggtgaccgtgtcggcggccggctcgctcctcacgcccgtgctgctgcagcggagcgggctcaccaacccgcacatcggcaagaacctccacctccacccgaccgccctggcgtggggctacttcccggacacgatgccggacctgaaggggaaggcgtacgagggcggcatcatcacgtcgatgcacaaggtggagacctccggcgccggcgcgccgcaccgtgccatcctcgagacgccgatgatggccgtggccgccacggggacgcagatgccctggctgtccgggcgagactcgaaggagcggatgctccggttcgcccggacggtgcacatcttctccctggtcagggaccgcgggtcggggacggtgcacggcgagcggcgtgtcgcgtaccgcctcgacgcggcggacagggaggacatccgcgacggcttgcggcgcgcgctgcgggtcctcgtcgcggcgggcgcggcggaggtgggcacgcaccggagcgacgggcagcggctgcggtgcgaggggctgaccgaggaggcgctggaggagttcctcgacggcgtcaccgtggtgcgcgggccgcagtcgaggagcgagacgtggggcctcttctgctcggcgcaccacatgggcagctgccggatgggcgccacggcgggcgacggcgccgtcgacgcccgcggcgagagctgggaggcggagcggctgtacgtgtgcgacggcagcgtgctgcccaccgcggtgggcgtcaaccccatgatcaccatacagtccgtagcgtattgccttgcaaatggcatcgccgactccctgtccgctaaaacgacttaattagctcctatcgtatcttctactacaaaattcatccattccagtccattccagaacatcacagcttgcaaattcgattagtacgttttagcgtatatgattgttacgaggaccagaataatgtgcatgattcttgtcgtgtgaagttatggattatctgtaattatctctataaaaaggaaaaaataaacaccgcaatgaaaatgcttcctgcatactttattcagtctagaattcgtcgctcttgcacatatcttttcattacattagagatgcacagtactcacaataagtactagttaaattgagcacagttggagaatagagtgaccgtcgacccaggatgtagagggacgtggaacgaacctgcgctgcactgcacatatgctatcagaaacaaattaaaccatgcgtgtgtgtttaaatgtgttgatggcgcacgggcattttcgaccgggagatatggcaatgctcttgactcagcatttcagaagaggcgtcaacgccagaacattcatgcatgaagcgacaggtgctgtgcaagcagcagttgagtgctccgtctttagccaccactttgcctacccggatggtattgccctccatattactgctgcatacgtctattgataggtgatgccattaatttttaatatatgtttaatcatttatcttatttaaaaatttcatataaatacgtaagacataaatattagtaagaaatttttagtgataaaacaactcataataaaataaatgatagttatatgttttttttaaataagatgaacgattaaatatatttaaaagtcaacagtgtcatcaattaaaaatgtgaagatgacactgctagtttggctcgtggtttcggctatactcaattgtcaactttgctttgtaaaagtttagtggtttcctcttttgtcacaggtgggacgtggatgggatgatactgcaccagtgtaacgatgttatgatagcattaatgtgcatttccaaagaaaaaaaagttggagtgaattaggagcttccgtttcgaaaattctcttcgtgacttcgcgacgaacttgtcatttaatgctgatatttgcacacgtaggtgcaatatttttcatcgaaataaaaaaaagcatcaaaataatcagtaattctatgtgtttaatctagcattgctgcagatgtgcagtattaggcaaaagaacacgacaggatgtgcattgcccttccataattccatttggtcagcatcatatcttctcagtagtttacatcaaaattcatgattattccttcatgattctaacagctattcccagtagtagtttacatcaaaattcatgattattcattcatgattctaacagctattcgtactagtttacatcaaaacagtgcaacacaaatgacatttcactacgagcgccgaatacaagttggtgatggcgaaagaatttagtactagccttcaagttacaatgaatctacaactgtactgtaggcaaatacatttgttagatgcctgggcctctacatcaactttagtcctagcttatccgagtcctctattgtcgaatgtcaactgcataattgaatgaagaagctcaagtaccaaattttagggaaatgcacacccaaaccgttcagataatcgatcaattttgttcacgatcaggcataataaaattacgcagaagcaaatttaagaaaaatgcacaccgcaaacagtccagataactgatcaattttgttcacgatcgcgagaggaaggcgtaataaatcaaagtatgccaaactacgggcacaagccacacaggtgctctgtgacatatgtaatacaaagtgactacaccttcagcttgatttccggcacaatgtagtgcacagttcagcatcaaaagaagggttagttggcatcatagcattagctagcgtccaataccatttcagtattagaacagaacaatatgatcataacacgtcatcataacctatagccaagatgttacagactttacaatcagttatcgcgcatatgcaaagtgtaaagccgtactctcttgctcaaggcaaaaacagataaactccactttaactttggcaaaaagaagtggttgctcagtttggtgccgacagaggtttattaacagtagaccaaaatgtttctaggggaaatcaagccaaaataattccacttcaaaaggatttggggttcccaacttcagacccctgaaatatgtcatgagcaccgctcatcttgtgccagcaaaaaataaacttgatgttggtatactacaaatagttaattatttgacagatgcttttacagctttctcagccgcatcatcaagatcctctgcagtgattaaggtcattccactttcctgcaacaggacatcacagtcaggtacgaaagtttccagtgaaggacgacttggcagatattcctacaaaaaaagaatgcatgcaagtaatttttacctttagaatcctcttcccttggtcaacattggtgccttccaaccgaacaacaacaggcaccttcaggtcaacctggcggtcaagagaatgattcaatacagtgcaggaaagttttatattgtacattaaccagcaagataatctaaattgtcccgcaaaaaacaaaaatataaaatcatcaatccaaggaaataactgtgtcattacattcccaagaaacagtaattgttaaaagaatatttctcaaacaaatacaagagaaaatgttgtggaacagacaagattccacaagaaattgtcatagggttaatctcaaatgttttatacttgatgcaataccagtagtactttcataaagaaaagaaattgttctgaaaaatttaatagaaaactatctcataagaaacttccacatttaatggaaaaggttaccatggaataagaaagattcaataggtatattgtaatttattaatttgaagcaagagggaaccacaataagctgctttagtcattaaatgaaaactacatacaaaatttgaagacaaacctgttttgctgcattcactattccacttgctatcacatcacatttcatgataccaccaaaaatgttcactagaatagccttcactctatcatcggaagtcaaaatcttaaatgcttccacaacctgaatacaagttatataaaaagtttataaatgaccaaactgggaagcataacatgcaaaaacaaaataacaatttagcatggattccaacaaacagattatcagttatatgaaaatcttttaggctgtgttcaggaggaggggttcggttgggaacccctcttccccggcacgcaaaacaaagctcatattattgcatgattaattaagtattaactattttttaaaaaaaatggattaatatgattttttttaaaacaactttcatatagaaagtttttgcataaatcacaccatttagcagtttgaaaagtgtgcgcgcggaaaacgagagaggtggattgggaaaatgggggggaagaacacagccttagtggcgcgattcacatgagatggtagttacaaaaagaattctcagcttattatacctgtccctctgatgcacttccaccaacatcaagaaaattggcaggcgtacccccatgcaacttaatgatgtccattgtagccattgccaatcctgcaccgttcaccatgcagccaatttctccatcaagcccaatgtagttcaagtcagctttggcagcagccacctgtaaaggtattagagataaactcataaatatcttcagtttccattctcagaacaacaaaagctgtaacatccctccagaggcaagtcaagccatcctccaaaagaaggggtaaatgaaaaaaaaaatacatagatagagataaaggaacacacagactacaagagaaagtgaataaaggaaatggcaagcagtaatatacctctctgggatcttcctgtgttgtgtcacgcatggcaaatatctctttctgcctaaaggcagcattgtcatcaaagttcaactttgcatcagcagcgaccagcttgttgtcagctgtctcagcaagaggattaatctacccacataacatgtccaaattagtcataaccagtgcagtggtaaagcgggccattccaaatgagataccatttgttattgattacctcgagcagtgtgcaatcagacttgcagaacagttcatagagcttcttaatctgttctatggaagactgtctgtcagctgtctttggtgccagaccatcaacaactttagctgcatcatcatctgtgattcccttgaatacatcaataggaacctggcaatccagagcattgcatttcaatgtatgatcgatttcattagaaacaattaaaaaaatgcagaagcacacaatgctgttgccaacagagggatattgattagaggcaatagatttaccttgatgatcatatcagggtacttctctgcaagatcttcaatactggttcctcccttgctgcacgctataatgagctgaaaatgagtgaaaatcagttagtctacagcaagaagtcaagaacccctatctgaaataggggaacatgcatattaactacctaatggtttaattctttaagtaattcaggcacaagcaaaaaaagaaaacaaaatgatagcaaaaaaggatttataaaaacaattatgatgcgtctaaattcagaagtgagcacaaaagtaatcctactcgaaggattgattacatcattcccatgtataatttataattataccaaaaccaatacaaaatatttttgagaaaaaaaacaatacaaaagtggaaaataattattggttcacagccttagaatgcttgacctttacaaagatgcttagtgacacagctactgcatgcaattatctgttactaattgtgaagcccattatccgttgactaaagatttatgtgaaccttcatcagctcatgcacactttgttagtttatggtattgaaaaaattaataaaataaacaagtacacatggttgcaaaacaacaacaaactgttattcttgtggaaaattgatccatattttagtacttaccactccttaacatagtctcataaattatcagaatctaggttacaagaaatactgaatctagatggaaaagtgtgcaataccaagcttccttaatttattcaaataatagaacaaaactcagtaaataaaaagagaaaaatgagcaatacaaaaaaattgcttgtgttcaaagacataccggaccagcagtattcctgtcaagggtgatggcgaagtacatctcattaacaagtgacagtttctcacataagtagacctgtcaaaacacaaatcaacgaatttagtacttgacaattttcagtgatttgagcagaaacatagagcattaaaaagtgtgactcttgctttgaaagataaggtagtgaaagacgcagaacttatggacagtcgcatgacaacctgtgtaagcctctttctacatgaaattgcatctaaatttgcattcaaaaaagtaataactacaagatccactatgattagactgaaaaaagaatcaagggaaacaatcattgccacagcatgcaccaaaaaaggcactccgtatagtgtaatggcttcttccaattattccatttatttctcatatggaagtacattaaacggcattggatttacaagttcaatactgttttgggcgaacacagtcatatgctaaagcttaaccttctacatatttgcaacaaaaaaaatatagtgataaaaagctttcttactaaagaatcaataatcaagcaaacacaacaacagtactttctaacaatgctggaaacaccaaatgaaactgtggtagcaaaacaaaatggcaagctgattgcagttcaaattggaatatagatgctgaagggggctacatattactaaaaactaaccttgctcacaatcttcccctgtggaccagtttgttttgttaccagaatctggccaagcatttttgctgcagaggagataacataaacacttaaaagtaggagtacatacacaaataacatgtatagtatacaacttaattgaatgactacgaagaaaagaattgaatgactatgaagaaaagagagcattgcatgtcacttaaaaggccattcacttcaaatcataaggcatcgaggcagtcaaactcagaaccaaaacaacaaataaccaaatcttaagttggtgagaaaggtaaggaactaattaatcaattgaaggaataaatcacctatcatatatggatttattcaaatctgaaggtagtatcaaggatgtcagacttcatacaataagattatctttacttgcatatttcattataacacatgtaattgccaaaaccaaataatagcaataaattgcattggaggttactgtgtagactgtgaagctagactagtgtgcatggaacagttatgtataaacttctaaatcagctgcccattatcatctgaagcaacaaacaactgaagcacatactgggagaaacttgtcaagctgctgttcaatatattcgtaagtctctgacattaactcgtacctgcgaggctttcagcttcctctgccttaacaatatgaacaccaccctgcagtccacttttgaatgttcccaatccacggccaccagccaggatttgactcttaacaactatctgcagttgtgtcatgttttgagtatggctgaattgaaccacaaaatgattcatgcaataatacatagatctaccctacaaagtaggctagggacaacaatcagctagatttgattttggagtaggccagcctaccatctactgactcatctttatagttttacggaataacaaacattttgaagcggaataccccaatactatcttgtgataagcaaaaggtttccccttaaccaagttaagggcttacaagccacattgactataaaccttggcaatattttcctagaagatatgattattttaaagagaccacatgtgggtgtataatctttgaaaaggagaaaaaaaaagtttatatgcagtcctatgactaaacagcattgaaaaattactcaaaacaccaataatagtgtcataccagagtagctaagactaattacaagtaatgttactttccaggcaccaacagtgatgtatttcacccattcgtattatatgaaactatatcccgtatactacagcaaccactaacctcccctctggagaaaaactggtcaggccatcagcagaaattgcagtaaactacattctctatatacatcctaataccatcaaataactgccacaaccaagtctcaaattggccgcacaagcaataaagaataaggaacggaaacatcacctctttctcactagggaagacgttcttcaaggtgtttttgacctccttcaccgatcccgccgccgcgcccctgggcacgttgatcccgtacttccccatcagctccgcgccctgcgatacccacacatccacgaaccctagcgcgttagcccaggcccctaaatcgaagactccaaaaaaaaacccgcaaaaatcgaacggaatatggtgcgggaatctgcgggatctggtggagggggttgcaagagcacctggtactcgtggatgttgaggcggcggagctgctggtgctgccatttcccggcgacggagagggcgcgcgaggccagcttcccgagcgatccgcgaaccatggctgcggcggcgtggggggctctctcctccgatccggaaaccctacaagcgtggagggatggcacgcgtggtctttcgctgttcctctctctctatatgcgggtttgatttttcactcggttttttctctcgtcttcttttcccttttctttcttgcgagagggtgcggcggcggcgtaggagaggaagagggaccagacgccggcgcgtttgactgacatgtaggatcacgacagtttcactgacatgtgggtcccagaactgtggggtccatatgtcattgtcagatgaatgtagggcgcggttgctcaggtatagaggcacttgtgcttcgagcctttgatacacttttcatgggcctaagcggcctaactggtatccctgctgtatgggctggacaggtccagataagctctaagatgaaatgttgttgggctggcctaaatctgtgatttacacacatttaggcagtggccagtttagcccacacagcccagtgcaggaaagtggcactgggaggcacatgcaatgcaagtaatcaaacacgccccaatttgtattcggggagtttaaaattttgagaaacaattagttggtagctaacttccaagaatatggagaaggtgggttttccaacttctagctcctagtttgttttctagattttacaactgtagcttctcagaatttaaacgaaaagctagattatttgagggagcttctgatgctgggataagctgcacctaccggaaactcccccaaataggtcccaagagtcctagaccaccgcggctttacatgttgtaagcacaggtcgttggtattctgatacatatcttattcgtagatatgccaacccaaaacgatggaaatcccatcatttatcttaattttcatagcatcacgaacagcataagagtttaatatgatctcactagattggtaggaccttacataagatctcgaccctacgattctacataagcatcttttaaatttcatgtgtgttgaaaataacgtgaataagcctactgagatttaaaaaaatactatctctgtttcatatcatatgtcgttttgatttttttcaaacttctttaagtttaaccaagtttctagaaaaatatagcaatattttgaacacaaaacaaatgtattatcaaaatatattaaatattggttttgatgagacttggtgttgtagacattgctgttttttataaacttaatcaaacttaaagaagctttaatagaaaaaaatatatcaaagtaacttataatatgaaatgcattgagtaccaattaaatttatcaaaattaatactagagacttcaaattttaaaacatgttacaaaatttatataaaaaatatgtaccttataaaaatctgatagatcccaagcctacaatattatttgaaatagaatgatccaacctaatattccgatcctaacaacctcgcaaacacatttgggatgtccggatgtagtcgtcttggtatgtttgcggtagctgatagctaaatgataacttggatgtaccgtgtactccttacgcggttacgccccaaaataaaccaacttcttctcctaaaataaagcaactatactttcttagaagtacctactattggttcataactatataaattctattccttcaatacctctcacctatccatccagtaatataacttctctattaattagaggcatttaagtctattgtattgctccttaaatatatcttgaaaagatgggatttgaattttttggaccaaaggagtttttgagatttgtttccgtactttcatttacattgaaaaacacatggaagaaaaaacgtggaaatttactcaagaaaccgtacaacttttgttccttttgctcagcaaagaaactgctgtaattaggatgaatacacccaagccagtatacctgtttggcaattggaactcggcaaatgcatggtagttcagactagcaccaatcaaattattctagagttggcatggccacgattgcaagctatcttcgcaagaaagaaaacgaaaatgttcgtgtcaaaagtgaggtttaacttaattggttttttattgtagaacctgcgatagatttaagttctaaatttagtatgagtgctcatatttacgactaattatttttcagtgatacaaggtatacccatcgacaacgagtcgctcataataatttcgtcaatttcaaaatatactggaacagtttctcatagatgcccctaaagataagatgtgtgtatttataaagatgtgtgcgagcccccttatctgtaccctattttttagaaaaaatgttagtgaaaaaaaaaacaaaatgtttactcataccatttgccaccttggcgggtaaacgattgtccatatgtttcccaagtcccgccacgtagcacggcccacaaaaaggcccaaatccgaaccacaataaacccaggtcaatgaccattataccctcgcacctaagccagaactacatacctatctttacacggctgcctcactacatcccctcacgatggcaataccgaagtttcaaccaaatccgatggctaaccctagcaaacccgtgcataaatacaccacccaagccgctcctccccgcccgcctcttcatttcccctcctccctcccctttgccccgccctctcgtccggccgtttcgtggccgtttccgtgggtcccatccacttgtcctcccgtgcaatttacgaaattgcccctatcatcttcgggtggtccccacactccacgactttctcttgccccctcccttttctccctccctttgtttattccccaatcgctatcgccgagcgattccgtctcgtctcgtctcgtctcgccgctgctctgctggcgtggcggcacgggggccgtcgagatgtcgatctgcgcgagggcggagccgccacgtggcggcgggacgctcggcaagcggaaggagcgggaccgcccgtcgtcggaggagcagcgggcgccgccaccgccgccgccgcctctgttcccggcgatgtccgctaggccccagccgcccaggccggctcaccccgctcggttcgtcaagcccatgccaccgccgccgccgccattccc

SEQ ID NO: 63908 - DNA, 9236 bp, Oryza sativa
  unsure (1)..(9236): unsure at all n locations
gcaccggtggttgcaccgcgacctcgccgccgtcgaccgcgccaggccggcgttcgtggtggcgctggtgcacgcgccgtggtacaccagcaacgaagcgcaccggggcgagggcgacgccatgcgcgccgccatggaggagctcctccgcggcgcgcgcgtgaacgcggtgttcgccgggcacgtccacgcgtacgagaggttcgcgcgggtgtacggcgggaaggaggacccgtgcggcgcggtgcacgtgacgatcggcgacggagggaaccgggaggggctcgccgggagctacgtcgacccgcagccggcggcgtcggcgttccgggaggcgagcttcgggcacgggaggctggaggtggtgaacgcgacgcacgcgctgtggacgtggcaccggaacgacgacgacgaggcggtggtcgccgaccaggcctggatcaccagcctcgcctccaacccggcttgcaacaagtgaccccatcaatccatcagaaattcagaatgtagcagaaacagatttatgaattatataattatataagttaatttattgcattgatatcgataattagaaatttagcattagtacttctacagttctatgtatgttagaagatactctatctgtcacataacttagaacgagatgtgagcctctcatactgatttgtttttcttatgatagaaacccaaacacgagttaaatcattagcgtatgatcaattaagcattagaaaaaaacaaaaatagattaatataacttttcaaagtaactttccttgagaaaattcttacaaaaatcacagtgcttaacaatttgagaagggtgcacgtaaaaaataagagagtatggttaagagagaggagtatagaacacactatccttatataaaaagttttgaaaatctaatagcgacaggcgcaaacactttttcctaactactctactttcttcaattctataattcttgacgttttagacaagattaaagtcaatgtttatgactttgatcatcaatatatttaataatatttaatttaaagataatataacaacatatacaaatttatctatcttacggagtactataattaaaaataaaaataaattatttattacatatatgataattaaaaaatatagtcaaaatatattttgaaaattatattaatacccaaaacgtcaaataattatggaacttgaggaagtaacaccgtaaaatgctgataattaaattacttgttgcaatctctctctgtaacgttcattccgagacgaacggagatggttaatgatctcgggggcgatcattgagaaatggcaaaatactcgctataataacgaaactggtaaaccagatcgaggctcgcaaccggcaaaccctaaccctctcttatccctgccgccgccgccgccatcttctctcatccatcgccatggctgctgcagcccgtaattaccttaatctggattttgacgtttccgatacgaaacctctccctgactactgcttctcagaggcttcggaggtgtggagagctcattctgatcgatcggatgaggaaagggaacaggaacaggctgttttgagggtaattaattaaggatatcgaagcctccaagaagctttaatttgattttctttgctttgattgtgcctgcatatatacacgcacgtatcttccatcctccgattctttaattgcatatattacttcgtatgaatacatgatttttaattgtactgcatttctttctgatcatttttgtgttccattctgttacgcaattggtatatatgcatgatctttcttaagatgcttgtagttctacgaagagaaggaaaaagagctggaggcaattgacgattgttctgaagccctaggcgacgtggattgtgatgatgaggaggaggaggaagatgaaggaacatgtgaggtgatgatatctactgtgtgacagtctccatttgcagcacagtttgagattgatcactattcatcattataataattaattcttggcttaattggttgcatctgttcatcatctgcagctatgcatgaatgaagggttggcaccaagcccgagaaaccatggcgagcacttgtgcccagtgtacctggagatggtaaatcagcaaattctggaggaaataaaggatcaagaccttcacaatgtaagtattcatgattagttcgttaagtttgctttgtcattttttttcttctgattttagtggctagttcagtgtcacacgttattcatattgacagaaacgatgacattagattcttctgtttctacgatatactccctctgtcccaaaataatctatgaacttattaaaggaataaaaaaaagtagcctccacattcgctctcacggcttagaaattcccacattaatcggagaaaaagaaaaacatagtccatatagaaatacaatttataaatagttaaaattcagaattaaaaaataatgaatattggaagaggagactagagtccatatagaaatacaattaagaaacaatagaaattcgaaattaaaaataaggaatattaggagtagagtatagagtacatatagaaatataattaagaaataatagaaattcagaataaaaaataaggaatattagaagtagagtaaagaatccatataaaaatataattaagaaataatagatattcagaattaaaaataaggaattttagaagtagagtatagagtcaatataagaatttaaaactaactaaaattcggaataaacataataaaattaaaagtagagtttagagttcgtataaaaatacaattaacaaataactaaaattcgaaatttaaaaaaacatgggaagaagagtctaaagtcaatataagaatacaatttagaagtaactaaaattcgaaattaaaaattgaagaatagtgaaagatgagtttagagtcgtccacatagaaatacaattagaaataataaaaattcataattgaaaataaataatatcggaagaagagcctggagtccatataggaatataatttacaaataactaaaatttgatattaaaaataattaataattaacacgtatataaaatacaatatgaatattatacattagtagtttcgtaaagggagtacaaaatttaaaattatgttgttattttattaatatatttgaataaataattgagaaaacatatatgttattatatgacaggaaatataatgatgctagccgcgtaatctgtgcgagccaccatactagtttaatctaaaataagatggtgacgtacgcattctaatgaagttggtttgaaaatcaaattaattattggtatatggtatattgtacatttttgtgcttttgtgcaaaggaggacaacaatatttttgaacgttttggagtcatggttgactgggaggatgaggacgaggacgatgatggtgaggaatttgaagaaatcaacaaggtaatttgatttttgtgtccagccagtgtaattaaacaacagcatatcagtattgtgatttaaattagtcgttaacataatagattactaactaatatctgtaataatgttagaagtttattcagcttctgggtcatggaaatgaacttgctcgtgaaataatggatggcgcccccgctgcttgaggcgcttgccactggcggctgcagccgataattgggctttgagttattgggcctaactagccaaggcccaaggagcggaatgcatgggcttcgatgggaccggcccactttcgatcccctgctttatgctccagtttcgagcaattcgtgtgttaaaacaacggttaatgtgttcaacggtgtattgcttgcttgtcgcctgcttgtaggtctttgcttctggtggtacaatttcgtcgatttatgtgctacattatatgcaactttatatgaaacaatccaattcttgcacaaaagatttccagcacatcagagcctcaatttattgaggccacctttggaagagaggatatatatcattaagagtaatttcacataaattaaattagttttaagcctcatttgaaacaaatgaaaaaccatagaaatttcagaggattttatcccatagaaatcttatggaaccatttgaaacaaataattgtttcctaccaattccttcaaaatttcaatgaaatgaaacattctagaataatatttggagaaaaataagtataaggaccatctcatgtttttctcttgtgtttataattcctgttttttcatttgtgctaacgttttaaaacttttcttcatttcaaaatcctatagaaatccaatgagtatgacattcttctttattcctattttttttcctttatctgtgtttctcaatcccgtgttccaaaagcctttaattaaagaacttgctactactaaaattcatttactactacagtgcatgagggtaggtttggcacacaggttaggtcagacatgatgatagtcgaaactgcagcccgctagagtactgatgctgagctcacattctctgctcccaatgtcctgcaccaaaattgacattcctaactgccccagctcactcatcacggtgagagcaagttcaatagtatagtcaactactagcttcaatttatctataaccaatttaatagctcattcatacaataattacatattacactattaatatctagtcccacctattatagacacactgcgtcttagagtctgtgctacagctggctattaatttgtagcccactgctcttctctctcctgatttatcttcttaaaatatgtttgtagctgacttatagcctgctattgtacctggcttactgacactgcaacactgtgcaagcttagctgtgtttgcaggacaaccatttccaaggcttgttccatcctgtccctgttcatgttgctgtcacaaaaatggagctgctcctacactggagtagtaggcatgatcatttcctgtttaccaaatgcatgccttttcagaggaagatcacggcaactcacactccagtttcgctctgtccgtccgtcctcctgaccggagttgtacacactgtcactgtgcccatacggatgcaggatcacttccaaaagtcaacacgtcagatcagacttgaagaatccaaatcttgaagccaggattattctgcaggttgctgccaatctctcctgtaggagtatcttcgttttaactgcagtgcaagatgcaggggctgtgtttaggccggtcannnnnnnnnnnnnnnnnnnnnagtttggagaaagttgaaagtttggaaaaaagttgaaagtttatgtgtgtaggaaagttttggatgtgatagaaagttgaaaatttggggtagttgggggtgaactaaatacggccagggtgtgtttagttttacatcaaaattggaagtttgaagaaaaaattggaaatttacgtgtatagaaaagttatgatgtgatggaaaagtttaaagtttgaagaaaaagttagaaactaaaccatcatgaaaacggcgagaagaactgaaaattcaggtgatccaggaggaggaggaggatcacaagtcaaaatacacaggaggaatacaggagccaaaaagatttcattgtatcatggcctcacgaaagacacaaagtttgtaaaggactgtgagtcaaaaacctgagtcaaacacagcctaaatgacaggttgaaaattttaggcatcttaaagaacagtaaacagaaggccatgatgcaatgtttcacatcagatcttggttccgaggagatgtgccatgatggtcgttgctgctgttactactcctactccatactagggtcattgacgaacagaagacatgcacttgaatgctgcctcatcatttgttgatgccttgggacagtaagagatctgttgcaaagatcagcaaagagcatttcgagttggaactaaaactcaacagtgtgttaaatgttctgctttctgttttgccgtcaagctagctgctacagtactacccataggctataaaagcagatacaatagcaggctataagccagctataaatatattttaaaaagataaaaaaaagagagagaagagcagcgggctacagatttgtagccagctgcagcatggactttaagacgtaatgtgtgtatgacagatagtaccaggtattaatagtatagtaagtgactattgtacgaattggctattacattggctatagatgatttggagctaatagttggctatactgttgaacttgctcttagctgcctgtggtttcatcattgaacagtaaataggagtattaactgttaggatgggcattgttcagcctctagtcaaacttgatttgaaagcagtttcaatttcacggtaggatttgtttcactagtgcaggagtggtgctgtgtcctgcattgttcatcggcaagctgctcctagagtagtttgccactgatgaagtattgatgttttggccataaaatgaggaactcactgctaataccagagtgctagtatctgcataatgagggtttccgatatgtatgtgaataaaatcatactactgtatatatgaagcatgattgatagactattcaaaacaaaatcacagcaagttcagaaatcaagagttgtgaaacctgcattgttcatcagcaagctgctcctagacagaaattcaacacatctcacatcaagttattgctggtactagtactcatgatcagagagagtaaaggcaatctaggatgtggaagaagaagaagaagaatttccaagaagaagaatttccatcgattgcgtatctttggacggaacgtgaactgcgtcatcaattcatcaccatcatgaccacattttcttgacagctagctactcctccctcctttaccacagagatcgagttaaggccttgtcccttgtgcagttcagttgtgcctgcatttctgctgttcttctgcaggaaagaggaatactgacgttactctcctccgatccatgcctataaatacaggcacccccattcaaacccaaactccacagcacaaagaagccaagaacaagttccgtttcaagttctctctcgctactcttcagagattagagattttagaggtgatacttacaagcatcatagttctagctagtattagcatgcaaacatcttttctgaaatgatcgaaattcattctgactataaatgtttttgtctgaatttcatttgttgatcgatgctgcagcagaagggaaggaagaggatcgatggatcgggtgacgaacctgtacctggagaacctgtgcataatgcaggagaacgagcggctgaggaagaaggcgcagctgctggacaaggagaacaaggcgctcctcgccaagctcaagctcaagaacaacccctccaccgccgccgccgccgccgccgcctcctcgccgtcgtcccagcagcagccagacgccggcgcctcggcggccgccagcgtcgtcaaggccggcgcggcggcgccgtcgtcgtcctatggcgggaagaagaccaagtgatgcagctagctagctcgagcatgcatggagatgatgacgtggatcttttgtaattagttgcactagcttaagtacattagcatatttgatgttactagcatgcaatgcatcatggagcattaacgatcgagtgttagatgatcaccaggtagccagagcagcgtcgttttggactaattaagctagctattagctaagcttgcagtgttttgtgccagtatttgctatcttcctgctgcaagtatcatgagatggtcaatgtgctaactccagctctagcacttccagtctagtatactgcgtgctttgcaccttatggaagtgaaaacctttatacgtacttattgttcttcaaatgatggataacctacagaaatggtgtaactctacttttagatttaacacaaaatgcggtcttaatgatctatatgcggcattctcagccaaatgtttcagcgagtgagacctgaaaactgcaagctagctataagtacttctacatgtgcataacaaacaggccatatgctctctttctcaaaaaaaaagaaaagaaaaaagaaggccatatgctcgctaatgctaactccagaacttcctttgatttgtgcaccaatgttgtgtgatcgactgatcgtaagcaggagtactgacacctgatcgactagctttgagagagagagagacctttttattaaaaaggaaattacggatacctacaccattggcactgtagggcttgtttattttaatgtcatttttaaccatgctatttttagtaaagttaaaaaaaatattgtttactttgttgttaaatttggtaaatacataagaaatcctgctaaaattttagcaatattgctatcttgctaaaaatttagtattgccaaaacttaataaggtttattttggctataatctgaacagctcttaaaccctcggatcttacacaaatgttgatctgtgtgcaacgtttctcacacccatgcaatgtttcatagagtgagagacctgcagaaaaccgcaaggtgcaagctagttttggccatataggagtagttcattatcacttcgtcctaaaaattaactgaaaaggatgaattctcattaccgtttttgcaagaaaaaatgctactcgatcagagctataaaacaagacattacttaactgtcgagattattttggtattagagccacggtcctgtagcaattttggtcgcaagagataatactccatcgttagagcatctccaacagcatggctatctcactcttcaaactaaaatttagcaattttaaattaaaaaaagactccaacaaattagctatctcacttttcaagctatatgactggccaaactgagttccttgctggccaaacttggccagtcaaaatcggctggccaaccgcggggcccacaccgtttctcttccccgtctctctgtacactccgacgccgccccagccccttccactgacgagccggcgtctcctctccccgcctcccctatcgtcccccttccgccatcgcccgtcggagcggaaacaacaacgataacgaagatgatgcccctctgtgcagcggtggcgacacatcccagctccggtatagcccttccagtgttgccgcccgtcatcttcggcaacgagacgttgaggatcggagatcgcaagc

SEQ ID NO: 63909 - DNA, 754 bp, Oryza sativa
ccttccccgtcgccgccgtcgccattagcggcggcggcaggacgatcaatgccgccgtccccgtcgtcgtcgtcgctgtctccgaggcgttggtaagcttctagtagcgtcactaagttgtcgaacgcggtggcggtcgccatggatgatggttcatgatcggtgccggcagaatcgctttcggtgcgtcgtgttccgtcgacgtcgtcgtcgttgtccatagtcaaaaatttaaaatccgatcagtttaattttggactatatatttatttatatctaacaactggatcatggatctgtttgttttgatttgatttgctcccgtatcgcgtgtaatctgctactgctgattaaacttatagagagatatacgacgtgaatacgtgcgtgactacgagagttcgtgtcggagggggatgcgtaccggaattggcgtacggccgtacgtgcagctcatgaaccgtaccactaccaaatacggcgtatgtgtagaaggattctgtttcggggttttcgtttttagattttttttaatatttacagaaataatctatcgaccaaaaaaattgcagaaatagcccctgccgctctaatggtgggcggcaagctgaggtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcat

SEQ ID NO: 63910 - DNA, 4329 bp, Oryza sativa
gattatgtgcttggattagtttgagctcccgagcacgcaggcagaattcaaatcgttttgcagtttccaccttgatacaagtaccccaaatgatgctcaaatcaaatgctaaattgtactggtagacctaatagtgaaattaattatgacatggcatccctttctccctttgttttgatgaatccggagaaacaagttcaagtataaatcgatttctgaatttgcttcaactgtatagaacgatacagttgatttctgtataggtctacaggaacaatcagtaaccatatggattatgtctattgtcctttttttctctggcctgctttaaaacaattcacttccaacagaaatctggaaaagaaaacccctgcatgcctggaggctggagtcctaagaggagcttaaatggttcggcgtgctacatgatagtggatactagacagcgaaaaatgtagctcacgttgtccctttccttctaatcaacaaacacgcactattggaaactgaacattggatatagtacttcgaccctacattacaacatgaccagtatagaaccagaatttgtattaaaatagggagtactttattaaacatgcttcaatttccctttgttcttaacccgtatcctggtttttcaggttcaagtgataatgagataactgtagaggaagcttcttttgtgcatactgaacctccgcaagatggctctgtcccacctgtggtttcctctaatatggaggtccttcatgacaaagttaaaaaacaagtcatcaaagaaggccatggcaagaaaccatcaaagttcgcgacgtgcttttgtatgtcataaatggtttgatcattccctatatttatcctggtgatttatagaatgaggctaatatattccaccttcattagcatttgtcttatcatcacatttcatctcgttgttgtttctatggaagttccataataagagaacttattctctgtgtatcaggggctcagaacatacatttgtaaagttacatgtactaggggctcagtatttatgctctgttgtactatctcctagctctctgtttcttttttgtacacttctttttaactaaattgccagtactggaactttctgtggaaagagcttcttattcagataccagaaatcatgaaatacttaacagtattttaggatgaacaattcgatgtacgcacagccttctctaacaccacaggcttactaataactagtgtggcacatagcagcaccaaactcataacaacttagagcaaatgatatttaaaactagtcatgcacttgtgctttgctatgaatcatcagctttgagcacttcttaccaagtggcacgtccatcatttgtataagcatgtcaacgtctgtctattacagatcaatcttccattctcagaccatgtatatacttattcagaaggagagcatctgcataatgtttgtttctgttttttctgttacagtgcactatagagcttgggttcaaggctctctgcataaattcgaggatacttggcaagaacagcatcccattgaactagtaattggaaaaggtgaaaataatgatacttcattttatccctagttcttctacactgcatgcatgccttctatagatgatacacatcaaatagcttactcttatgccattctgatcttatagtgccacaaataatctatgattctaataagggttttgaaaatcagttgatcgatcagcaactttcaacttgctattgatattctagttttttttttgggtgtgtgtgtgtgtgtgtgagggcgattgacaacttgcaaggacataaagactaaatagttatatttttattactaatatatttccccccctgttttctgatggttcactaaatatacaatacaggtacagggtaactatataactttcctacaaatatcttttggacactcttgagcatgtagagtatacctgggatttatcagtgattatcacatatggaataaaagcctttttctctttttaccgacagagaaaaaacaaatgtctggtttaggcattggtgttggtaacatgagaagtggggagcgtgcactgttgcatgttggctgggagctaggctatgggaaagaagggagcttttcattcccaaatgtccctccaatggcagatcttttatatgaagttgaacttattgggtttgatgatgtcaaagaggtagggaaacatccttcttaccatctccacccaacataatgcttatccttattatttctgatagtaatctgagactattgttggttggtttcattttatttatggttttcaaggtgatttggatgttctaaggaaccttacaaattgtgtacaactgcaggggaaagcccgaagtgacatgacagtagaggaaaggattgaagcagcggacaggaggaagattgagggcaatgagtatttcaaagaaaagaagtttgaggaggccatgcagcaatatgaaatggttagttgtccttcttcaactgttgtgagatgattctctaatcgtaatcctctagctcctcctctttacaggcgattgcatacatgggagatgacttcatgtttcaattgttcgggaaatacagagatatggccttggctgtgaaaaatccatgtcatctcaacatggccgcatgcctaatcaaactgaagagattcgatgaagctatcgcacagtgtagtattgtaagttttttttgtttgcataaagttcaatctattaaaactcatgctgtcacactcacaccagtcggtttgtgtatagcttcagatgaattaggattttgatttgactttcagacaataaagacatacaacatgatattattatggtaactagacgcttggaccaaaaagtgaagaatatagtgcagttgcctatattttcctcaacttatttttgtaagacaaccctcactaatttcatgacgtaactgacctggcaattcatcaagtgaagaatttttccccctttttccgaaaccgaataattattgactggatgatgaactcataatcctattcttcaggtgttggcagaggatgaaaacaatgtgaaagcattgttcagacgaggaaaagcaagagctgaacttggtcagacagaatcagcgagggaggacttcctgaaagccaagaaacattccccagaagacaaggagatccagcgtgagcttcggtctctcgcggaacaggataaagctctgtaccaaaaacagaaggagctgtacaaaggcctctttggtccaaggcccgaacccaaaccgaaggcgtcaaattccatcgttcgcttctggcagtggctcgtgtccttgattggttatctcataaaactgttcaaacccaagaatgaatgaataggaacggatagtgcagaactgacgatttgacgaccaaaacatggactcattgtactgtaggctgggaattctactacaagtagttgggagtgttgaactgcacgcaatcggtgtcaaattctacaatctctcggcatttttgtgccttcagtccttcactgcattgtgacttgagctttgggagctaaaagttcagacatttttcctatgaacaatacattgcctttatggtgtcaatgatttggtatgttatgcggtgctgaatagttgaatgatttgttacgattattttgatggtataaatgaattaattaaatattataaagttaaaaataaattgaaaaccacttttctaaggaaactcatatatacaaaaagtattttacgtaaatcgcaaaaaattgattataagtcaacgcttattagaaaaaaaaaacttacaagtaatattttggcttaaaatctaattatgtaaaacaaactacaataaaaaaaaataaaaatcacctctaaaaccaagttttaattcaaagtttagctacggctaataagctgaaagaacaaacgatagaaccatataaatttgagaaacatgcatattcttatttcgacctggtttagttcccaactttttcttcaaacttttaacttttccatcacatcaaaactttcctacacacacaaacttctaacttttccgtcacatcgttccaatttccattaaactttcaattttggtgtgtttattgccaatgtttgaaatagcacatctgtctctcaaagttggcatttcaacatttcaggtgccagcaataggccaacctagcaaagccaatgaaagaaatcaaagaaattattttcctaaaaaaggaaaataagaaaaaaaaacacattctctttgctggcgctgacgatggaatacagcttgg

SEQ ID NO: 63911 - DNA, 6008 bp, Oryza sativa
tactatgagaccttctttgatcacagatcttacaatgtagtttgcgcatatagcggaactccatacctttatacttattgggtagtaaaacttaaagttaaatggcatggattctacagtgataaatagaaataaccacacaaataattaacaaccaggattctgaggaaaaattatctgagcctcatgggaagacagtttggtacgtcccttggatgagaacatcacaggtaattttcgtaccccattttgcattaattactagtaaattgtttgccagtggcattactgatcaataaaagctgcatcacagtcctcatcctcattatgttacttgtagactaatattttaacatgaagtcagtctgaaagtaggaagtatatgcattggtgccactgaaatatttagttataggctgagtgcttcaccatgaactttggtggtatggtaggaggtaaaacttgtgctttcactgcgaaacatatgaaaagccacaagtattttctgcacattgcactgaacaaatatatattctgccttatgtagttatgtacatctcaaaacaataccatcttcagtttattttctagggattgtgtttgaactgaagtagcaaatcactccaggcccagtttctgtcataaactgggtcaattccttttcttcttaatataaaacaggaacccctgtcctcctcctcgaggtttaccttggggcaaaaaaaaaaccctgaagtgtcgtaagttcaagcatgataatgggtcctgttgttttagtgatgagatatatagaatatgtaatactctataagttcattcatcaatacccatgctcaagtaaatcctatttgtttgaatgataaaaaagttcacggtttagttcaagctctttattataagtgtggcaagagcaagagtgcaagaccttggtcatgatggaaaaggtgaaaaaagaactgaaatcgtcaagctgacacagttcatcacaaatggttgcaggatttacctgtacttaacttgaatttgtcatagaagattgctcttatctatcatcgtctgcagaaattttgagttaggttatcgcgaccggtgtttgatttcagagctcttcattaacactttaactctgtaacttgtattggagtaatggactgaaaactgccaatgcccagttctgtcgattcaaaatcgatcaactgggttttccttcttgattcactgattcattcacacgattcattaagaaggtgaaggtatgcgactcctgatatttaagcacagaatatttcacttaagagttactaacatccaacaactaatgaaagcacattgttgacaattgacaggacatgaaactctttttttttttcctttttccattgttccccgacctcagccaagttgggcagctacttgccttggaagggtgctcgaaggccatgtgcaaggttagattaaacaccatattattttgcagcctactataggaaaaggttctctaggtctgatttctctgtttgttttcactttaattatcatctggcagctttataattttggttcctgttttgctttcacctcttttgcatattaaaaggtgtaaagaacagaggtgtgtgagcttctcccgccactttgttgtttttatattacatgaagcttgcaaaaacgtttcgtatcagaatccccactttctttggctaattacacaatactaccatcacgtctctttaatcaaagcttattggtaatcgcctctattatattaaaccttgggaggcgagttttggcttcttgtgagtactcttgaagcaagtacagctatccattaatccataccccaactgtcaatatctcaacaaaactttccttatattttcctttcttgttatggcctaacaatcagaaatgtgttctttggttcctgattgttaaccgtttagtttagcagtctaacataaaaaccaataggtatgtctaattacactagtatcagtacatgtttgccattagagggagaatccttgttaatgcatgtttcagtatctgaaatgcaataaatgcaatatcttttacttacagtgtactacattgcgtatccaaccattgatccgcagctcacatatctccccatcttttgcactcgccactgcacaaattttgctccagctagctgttgtactgcttcacagagttacagcgttagcactgtaagcttttgtttccaaggaaagggatactgaaactccctctcacccgctcaagttgttactactctgtagtctgcacaactaatttctctgcaatttgttgagtagtattttacacttgatactccactgtttttgtttctgcttctcttgtagtctggtgctccttaagttcttttaccaccagtaggagtttctttctcattgtcattggggataaaaaaaagggtatggatgggatagcaccggaggccttgtttattcatacccatctatttgttttataacaacgaggatttggagcttttacagttacagcgcatcatggatttgactgggctttttttatttttcaactttgaattaactccagctactacactgatttcccgaaaggcagagctttactcctttcagtcttatcccctcagcgccagttggacagctgttcaggctgttttttttttaacgaatggctgattaaaagaaatacagaattggtttttcatggaaaggtatgcagacctccctcatttgctgtttctggagtacgttgggctagtgtttggagactgaccaataatactaggaaaatgggttatgtgggatttttttatagttttttttacaagaactgaactaactcatgaatattcttgcattccaaataaatcctaattagttctattgtctttttacactatttggaactgtcaaagattgagacaccgttctatcttcttccatgttttttatatgagcatgaaattcaaaacacgagaaagatagggaatcatttctttcttatttttaactatgtaacgaccatttttttagaataaccgatgctgtttattttactatataaaatttgaccatggataggaagattagggaacactttaattttttttgttaatactatgtaacggcctttttttccggaataaccggtgttgtttattttactatataaagtttggccatggatagaaagattgggaaacactttagtcttgtttaaactatgtaacggccttttttttttggaataaccgatgttatttattttactacataaaatttgaccagttatagatttaaaattgttcaacgagtgaattaatgttgttgtaaaatgattcaccgagtgaattaatgttgtattgtattaattctagattttccatgcaaattaaaacttttaagtttttataaaaatctgttactaaaaatagtggccaaagttttactgtaaacacaatgatttcagttatttaaaaaggatggagggataacttgctgtacaatagctattgcccaaagtactgaactgcagggcacatcctccaatgtgattgcttttttcttgctgactttatgatataaacaacaaagtgtgaaggaaaaaacaggggaaggaaagacatactggtaaagaagaattagacaaatatacagtggtacaaatttagaataaaagaatcttacttggacatttttatagggtttgcatagcagatacttcctccattcttgaataattgttactgttaactacaaccgtctcattctaaacagaaattacttttcaattattacattatgatggatcggagttattcgcttatatttatgatggcatatacttcgataatatcacatatttttaagtattttttttacgaaaagacaaactgccaagtttaaatttgaatagtgtaagggtcaattttattcgagaatggaggaagtaactagattcaataagattacagcatatgacaaaaaatattggccttaaaatgtgccttatgctgtcatgtagtcatgctaacaaaaaaaatgcagactagggttaaatattatttttgcatttagaaataattatattggtattaatctgaagttttaatttgttcctacatcagatacatttcgcatctttatttttctcaccattttttctgaagacatcgtgcatcgcattggttatgtctactgttcaataaaatggaggtacgtactcgtatgctgtactacgtactccagtacactttttttgcagtccaaccaatcagccaagttggtcaaaggagagagagcgaaagagagcaggaaccccgccattcctgtgcagtttctgccccaaaaatctcatttttaatcatcccatttttttcccctgtctttaaaaatcttcctccatgagacttcggtaacaacagctactactggtgcctggtagtaaccagacacagagggaaagcaaaacaagagtgggtgtctcctgttgtctgtcttcctcctcgtttgagctccaagcaagcttagccaagaaacaccataaagaagagagtgagagagagtgtgtgtgtgagaggaggtgagcttctctcacatgcacatggagggaggggagggcattgctgtagcaggtgcaggtggtggccatgaagccggcttcggtttgttcagagcggccgatgtgaccatgacagaggcgcaagaagcagccaaggagtaccagtcttctccctcctcgccgtcgacgtctcctactccttccccgccgccggttgctgcctccggccatggaggggaggccgctgcaacgccgaccatgtggagtttgggcggcgagaagatgccgagtgaggctgcaggggacaacggcatgcagatgtcaggccacagtgagcatgctagcttgagctccggacggcgtaggggccggccaaaagggtccgggagacgccagatcctagccactctaggtcagtatctcccttccaaaatcccaagtttattatacatttttttgtgtgtttggaatatactcatttttccatttttgctggttattttcttgctatattcgccatcgtttgtggatttttctgtttcattgccttggatggggtccagtcagggtgatgtgtaagctcccttttgtgctgaaggaaggctagctagtcaataaccgttagttagcacagtcctgttctgctgttcttgtatcgcattcgtcccctatttttgttcaagtgattatttttgttttcccccctttcttctcagttggtactaaccttacttttgaagattttgtctaatttctgtagattattataatgcaattaaggttttgtttcacatggtcttgtagtctggttattcagaaaatgcgcatttgcttgactgattggtattctgcaatgcttgtaaaggggaatggtatgcgctatcagctggagggagcttcacccctcatgtcatcatcgtaggcacaggggaggtaaaccctctatgttattattcctttttcacaggtcatgactagcttggcattgtgatctggtagcgagagaatgaacactgactgttcttgtgcaatccgttggtacttggtaggatgtggcggggcgcataatgtccttctctcagaagggtccacgctcgatttgcatcctctctgccaatgggaccatctccaatgtggcattgagccagcctggctcgtccggtagcaccttcacctacgaggtatggaatggagttgcatcttatgatggttctatgatacttggcaaagttgtgatctttgacctgctagcttttgttaacttttgatgggtatgtacaaagtcctgaataagctgaaccattttggtctatttagtttggggtcttctctaccaagtcttttaggtcccatatcaccactgtaataaataacggagtaaatacgacaaatggttttcttgcctaaatgttctatcagggggtatatttcca

SEQ ID NO: 63912 - DNA, 12921 bp, Oryza sativa
gttccaagttggatcagcaatatgtgtaatggtcttagagccagaattagtactactgtttaatggaacctatttcatatttaaattgagcatggttgtgctttagagattttgtatgactgatggctgttaaatagtttccaacatatgatcactggtgatttgtgtggactctactcgttaccagttgagattgccgtgttttgctcgtgcagcatattgcagtcttgagtcgctgcaccgggttattgaatgttacaccacctactgagactggaatattcacttgctcagtcgtgccgaatggcagacgctatctgtttcaatttttcaaatggtaggcgtgcttctacattgaagaatggaaaatcgttccatttcctgagttagatggaaaatccttccattttctgagttagcaattttttctctcattttcagtagttggaaaattaaaacagcaatatacccagtctggactggtaggataaaatttaatgttttgttcatttgggtctgaatttgattgtatgtcatagttgtataatttggtttataaatggatggactgcatgtaattatgttttgagacattttaaaaagagactgtctacgaaaccaagtaatttatgtttgagacattttaaaaagagactgtctacaaaacaaaaaaatctcacctcatccatgcgaattctatctagatcatctttgagccgccttcaacaacacctaacccgtgttgctgactagaaacccaattctatccatctctaagttcagtcactatacaaccatttcgcacactaactctcatcggatccaataagaaggagccgcctgatctagctcttcatcggatcggcttctgcctcccaagtccgatgacacaatagcgtgtatgatgacggggaaggaaaaaagacaaggaaaaaagacatctggttgtgcatataaaggcggagaggaggaacgatggtggctcatggataaagtggcatgtggaccatcagtcatcataaagaaatagttagttttaaagtagtaaaaaaattgagataaaggtagagtaagtatggatgaaaacactttggaaacggacgaaaaccacttatcgtttccgtttccatattcttttcaaaattggaatggaatcagaaacacggatacataaacaaaatcgaatattatcgaatacggtaacacttatttatcggaatataaaaaccccttaagccgaacttctaaaatcaatgaagagatgtagctcgatatcttttctgaaacaataaatcaatatttttagtttttatcattaataatacaagtagtcgtacactttattttcttggagaaagagaactatattcatctataactgcaattgttattactatggcacatagtataaatataaatatttagagtagaaaagtctggagctaataaattgcacatgtgaaacacttcgtttccgattccgagaaaaaaatatgaatccgtttcctgaaattttccaaattcgttttcgacggatagtagcattatcatatccgtttctgttttccgagaaaaatatctgaattcatttcctgaaattttccaaattcgtttttgacggatagtttcaggaaacatatatcctaaacggatagtttgggatatatgtttccaaattcgttttcgacggatatgtttttaggaaacatatatgaaattttctgtttccaaattttccaaacatatatgtttctgtctccgagaaaaaaattcgaattcgtttcagtttcttagatccaggagttggcaaatactacctctgtcccataaaaatcgaaattctagttaatttagaacatattaggctttgttcgttgctaccaagtttctgtacgaaagttgcttaaaaaaatcatattgatccaactttgaaaaaaataagctaatacttacttaatcacgcactaatagaccgctccgttttccgtgcgcggaagatttgttcccgaccactcaaaccgaactcagccttagagcatgtacaatagagccctaacgctggcgataatggttccacgttagctcgcgtgatgcgctggaggaaagaaggaaggtgagtgggcgactatttagtcgccgagctgctcacgaactctaagaagttgggcccacagatacaacacgaggggaagctggtccacgcaacgcgaggaagagagataaataaataaacatagatggttccgttaattaaaataaatatataatgtgtcagcaacttattattagagcacaactattgtatcatgtgtctcttaaattatactatatgatgatgatgtggaagaattggagctaagagcgggctgtactattaaacttgctcttaggaggatagacaaatgaccagaataatcttatttaatgaacccatatatgtatatatttcatagtataaaattgattagaatgaattttgagacaattaacccacataattagaaatacttttttttagtaaatttcacaaaactacacgttttgtagtccaagttgcagaaaaccacacacacttttgacacttggcacttaagtatatatatttttgtagtgtcgtttcacaaaaccacactatcaatgaatggattcacccgtgagatgatgtgactgtttcatctaggacgaggacatatcatcctattaccagccatcgcacgaaattaatagggtgccacatcctcatcctagatggaacgaccacgtcatctcaaaaggtgaatccatacatcgacagtgtagttttgtgaaactaaactactaaaatatatatatacttaagtgccaagtgtcaatatttgtggttttctgtaacttgaaccataaaacatgtagttttgtgaaatttacttttttttttttttttgataaaacctcatagctagaaatctcctgtaacacgggtatcttcccttcgctccgttggcgtaaaataaagaggaatctcgcgtctcgtcgtctcctccgctccttgcgccaagacgagtagcggctgaacacaacaggcgaggggcggcggtctccatctggcgagcagagcaggggatgggaggggatcctggtgagcatccacatcctctttctgattcatctctcaatcccaccgggactacttttgtctggaattcgcttgcgtttgttaaccctagcttctcttctagatctggaagaagcccttctcttaatttcagagccttaaccttaatacaagtagcagtttgtttgttccccccaaaagtttcccaagttggatccgcccctggttgttaacatagtagcaaatacaatatgaacaatgagagtcgaccaaagtggagaaaagttgcctatgggggaaggcagccaggctatgacgataaccacacggacgagtcattccttgaggagatggttatgaacgccaatgttgtcaagagggacctcctgaaagtgatgatcgactcggtctccatatctcagtatctctgcattgttgctcttgtggtttcaacatggacctatacactgaacttggtcattgatgaggtcactcttttgaagctagacactagtctacttcttgccgggttttcgatgctcttgctcacggcaagtccgttctcgctcaagcttctctccaagtatgtcctcaatacatcattcttcatcagtggtctgtatgttttggcaccgatttatcaaaccctcactaggtccatcagttcagattccatatgggcacttgctgtatgccttctgttggttcacctctttctgcatgattattctggttcaactataaggccacctggtgcactcaacaacccaaaattgaccagcaatatctccttgaatgcatcgatagtagcatccgtccttgtagcttcgcgcctgccatctaggctgcatgtctttgcaatcatgctattctccttgcagatcttcctgtttgtgcccctcgtcgcgttttgtattaagaagttctctcttagacttcatctgctcttctcctttgctctgatgatcatgaccctaggcgtcacataccaattgcatcacatgttcttcatcctactgctggcactgcttgtttttatctcaattgtttgcccttactggcttataagaattcaggaatacaagtttgagatcaatggtccctgggatgaagctaaactctgctttgatataactgaataacagaggaaagtgcatgtgcagaattttggtttcaatgttcattatctataattgatgtattaccattagtcttattattctggagcaatttatgtgcatgtatatgcttttcttaacatatactaccttcgtcagaaaataagttactctattacgggacgtgacatatcttagaactacgaatctagacatgtctttgtccaaaatcgtagtactaggatatgccacatctcgtactaaattaacttattatgagacggagggagtgtctacttgttcccttactgtgatcaatatacatggcgggccttatctgttctgccatatattgataagctttctgagcgcattcagtggtttaaactttggtgtacaaaataattaggtacaaacatcgtcacatgtaatctttaatcgagtcaagagagaactgctcagcccagtcacatggatttcttgcaataaggtgcaagtgcagattaaccctaacatattggtacttgttcttgtgttgcctccagtttcgttggcagtgctgctcactgctctgtattctgttccgattatatactgccggagttttttttttaagatataaaagaacgttccatcttttgcgcgttcgcgaaaaaaaaaaagaatgttccatcaaccacgaagccctaacacaacttcagcaacatcagctgggggcattacctagcaaaaaatgatcaggacccatgtacaacttcattcctgtacatgtagttgtgcctggttgtaacagcctttttttatcttaatacaaagatatgcattttgcatatttcaaaaaaaaacaaacaaacaaacgcattcctagctgaggtaagtgcatagtactttattacaggttattgagaaatattcaacagacacaacagctctgaacccaaccgtagtagttcaccactggcaatagcctcagattcacaaatgttcttggaacaaagaagattcagttcactcaaatttgcctactgctagagcatatttgagttaaatcagttgtcaaaaagtgaaacaaatattttgatagttagaaaagtaactgctagttgaataacgatatctgatcgtatgatatattaataacgattacatgatctccaagtttttaaggaaataatgtgacggagtatctaaagggcactaaggcaaaaaaggatattgattatcttaagagtatagtggcagagtggcagaagttctagttgcagtgcacaaaggaaatactacgtgatagtacatattttgctagtaatgaactgctttatttcaataacatttctacaaatatttgatcaacatcagcattaattggaccagcacagttgctggtccgggttcttctgaatggcgtgtaaaatgatttctttaaccatttcttttgcgccaagattcagtaagcaaacttcactcttaagcatatctcagcatcatctgtagcacagaatggtttttacttgttgatcagtaatcatcgtgtgaaggaatccccagtgtcctcactggagcagcaactcacatcttttgctcttcgaagcattatttccttctgtcagcactgattgaaaggcgttcaaaggtcctcaaagtgggatcatcatggacatttcttgcagttttggtaagcgaggacctggtctcaagtcctgttgactggtgaagcctctgcatagttgatgggcgactgctgccactgctggttggaattaggttactgcggttcggatcaatgggatctccagaacttggtctgctgcttgacaagagagccttccttgatgtgctcccattacgagatgatgatgtgggccttcttttatctaaatcaacagcctagcacgcatggtaaaattgacataagccttccagaatacagagttccagctatcatcaacagcaacgtaatgtaaaaacacaacaaaagatttctgcgaaaagatggtcaagactaacgaagaaacatccgtctcattatcctgctaatttgagcagtttttttaggatactgctagaaggtgatctagctgctcaatttcttaccgtcttgggtgcaagtaatgaatccaatatatttctgtgctttgtgtgctctccgtaatggccagaaccagagccagttcttctagcaaatggatcgactgtaccagagaatctgtcaggaacatcctgtcttgctgttgagacaacaccccaaaaaacccctgttattttccaaacttatttcctaaatataaattcaaaaaatgtctatgctactgacaaacctgcagctcgttcagtccgttctgcagatggtcccaccaacccacttgtccttccacttgactggaagcaaggaaaagatgctacacatttagtacggtaaagctttgcattaccaaaaaaagttagaaaaaggaatagcagacatactcgcaatctgttactttctgaaccttgcttcgtccaatcaaatatataatcaagctggtaccctgcaagaattgagaggaaatcattttagatgtgtatgcagagatacttcattgtattatatttgagcataccttcacggatgaatagatctcggaaaagtctcttcaaatagctgtagtctggtttatcttcaaatcgcaaagatcgacagtaatggaagtatgaaatgaactctgtgggataagatttacagagaacctatacaaaattgtgtaaaatatgataaggttaagttgcaattaaatcaaaaaatgtcatgcttcttcatagattttttttgcatggaaaccaatttccattacctcaactgggagtaacattttcttttcactaatttggccatatttctggtttttttgtgccagcttttagaccttgccaaggaagctgaaatggacaagttaacatagatcaataaaatgtattgtcgtataaaatggaattttaaaaaatagaaaacaagcatcgtctcaccttcctcttaagaaatacataagcacatagcccagagactctaaatcatctctcctgctttgttctgtagtgaaaaacagaattaaaagaacgcatatactagcagtcagagtgcaattgactaattttgttgcaagctaaactttatttgtttcaaaggagctacacttgttcataacttttcagtgttgccacattttgcacctcttaaatacatattagtttgcgttagttcagatttttaaaaaataaaatctcttctgatgaaaacgaatcagtaacaggtaaagacacttacctactccaagatgggtgtttacactagcatagcgtgctgttcctgtgagatttttgttctccctatggtaggaaagaaaaacatgtaagcttcaaacatatatccccagaaaagtatgaagcataatcatgcatagaaatataatggtagataaactggtaaactttttactattagtatgaaggaggtaactgctaagtagtgaatagtgatagtgtaacccgtgttactgaccaatgtcacagtatagtactaaaacataacagaaaatggtttatcaattatcacaatcatcattgatcaaattgttgcaatgctgctgtcattactcactactatcaagcatttctcttaatttcaagaagtaaaaacagataacaaaattgtgtgggcttatctatatagttaatagcagatactgcttgccaatatggttaatagcagatactgctccaccggtagtgtgccaagcacagttatggtaatgaaaaattctaaattaagcactttgagctctgtcagataaaaacggtgttgctaccaaaacaatatactttagtatgatttttcataagctgagtgctctactacaacaatcttccaggtgtaaacataaatactttctaaaacatttactagagaagaatttctaattacctgtaaggtatatgcttatgagtttggaggtcccggtatttctttgcaagaccatagtcgatgacataaacctgttacagaattgtaaagatcactcacaacaatgtctacaaaaagttgtgcttatttcttgatgttattcattgtaagatatatcacatatgaagtaaatgcaggctttcgatcatcagttagcagcagtactagaaaggcagttgatatgcatatgctgagtaacagtatgcacaaataagagaaaacagaaatattatccttgtattcttcaagttcttacgaaataataaaacgtatggtaaatcgatgatcacagtcagcagtttaaattctccaaagtctttctacattcataaaaaagatgtttctaaaaaatactaaaatttattatacaagataatttctccataaagaaactagtataatcatcaagcacacagagcacagctgacagctgttgttggtaatatcatagcctctcttagaaagtataattgaagatactactgccaattgacaaaacttcatagcaccaaaaaagatgatacttagaaaccaggccaaatactcgaatcaagatgttatcaatacaaaattatacagaccaggcaaccaacaacatccaaagcgcagaaaaataatgaattatatctaccagcaactgcagatgaatgggacaaacctggcttgctttgcggcctaaacccataaggaagttgtctggcttgatatcacgatgtagaaaccccctagtgtgcatgtactctaccctgttgatctgtatagaacaggaagttagtggttaaatcagacaaataaagtcttgaaatttactttccttgatcgttaattaattgaaatttagtcatacaggtaaccaaaattaacagccaaaataatagaattcagtaagaaaaacccaccatctgatcagcaagcataagtactgttttaacagaaaactttctgttgcagtagttgaataagtcctctaaacttggaccaagaagatcgataaccatgacattgtactccccctccactccaaaccacttcagatgaggaattccagctgaacataaccaagacataataagtgaacaattttatttaaatagataaacagtttcccgtattacacttacttcccccctgcagaagcatgtatagttttgactcataatgaagctgaggatgccttgattttacagattcctaacaaaataagagatgacagaaaaggtttaggtaatttgtcccagtgtcagcaaggacaagtaatcagtgctgacagtgactattcatgtcaatatagaaatacactttccaagtttccgaacaccttattttcattattaccaacattttctcatagaacaaggattgcaccatttaagaaagcaatccaatgcatacaggcttacaatatagaaatggcattcatgattagaaaggcaaagctggttcacaaaactagcaactacgtgaacttacaaggtaagttgcttgaaaagtagatgtgaccaaactactaacaatcatatcgaaataatagaagcttctaaaagaagtgcattgaccactgaaccggagcaataatatcaggagaatccttgaatgctgctttgaaacattgaaatagacaataaccaatgcttcacagctacccaacctagccaaaacatgcacaaggtattccaaaaggcttcgtttccccagacggaaaagctttgtttgcaggtcttacaggatgtgaacagaatcacgggcggctgccctgagtcctaatgttacaagagcagataatatagtatgacaagggttggtgggctgcctcatgttatttacagatgtttcagaataagtgctctcgtaaaccacacacatcacctagatgaagcaattaaataatgtcaacgatccaattggaagctgaaaaatcttcacctcttttttcttacttcccaattctgaacatctctaatagaccagttaggtcggagaaccaaaaaaatttagaagacctggtttctacttgtatgaaagagtatgatactaagcaagaggtcatgtcaacgatttcacaaggacgtatacatgtagcttcattcaaatttctgatcatgcagcaatgcaaactctgttacacctcaggtgatctaatcttttctaggagggcagaacaaaccatattcgcatcacaacatcagcacaaaagaaaccaatgcaatactaattactacaatatatacattggcgtaagaaaaggcttatatatcagaaacgaaatcatcttcacataccaacttgatggctacctcctcgctgctctgtatattcacacctgtaatcgaaacaatccatgaatcaacgacatcatcacaaacagcgtaaacagtaagaagaagaaaaacgaacggtgcctcgcaacgagcggcgatagacgagagatccgagaaccccacgaggaacgtaccaaggtatagctccccaaaagatccgctcccaatcttcctccccagcttaaacttccccccgatcacatgctccatccccgcaagattcagcaccgaatgcgcgcgcgaatcgcctcaccccccacaagaaccccagtcacattgcccggcggccgcaagatttgcgtcccgggaacacccaagaaaaggaagatcccggatctctccccccgactccagcccaagattcgccgccctgagacggcgcgggcagatcgaattggcggcgccgcgagattcaggacgaggctagggatcgcctccctctctgtgggggggagaaatttctcggcaggaatcgtgggggggcgggttaatagatggcgatggacgaaggaagcggaaaatgtgggaaacggacgtgaggcaacggatagataggggtagggcggtggattttcttccttcctttattactactgctagaaggaggaggcgggtggcgatggcggcggcggcggcggcggcggcggcggggggagcgtgggaggaggcggccggtggccggagtagaggtgggaggaggaggatgtggagattatgggtaccccatacccacacggcatggtatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggcatgagacaactagatcgtcagatcaatacacacccggcggattcaaatccccaaacaggagtagggtattacctctcattgagagggcctgaacctgtctaaatcctttgtctccacatccatccacttttaggtctcgtgcgctaccccattttattattgccgaattcatgtttcgacagttggcgcgccaggtaggggtgcgtcgagtttcccattgacaagtgcgatggaaactaaccttcagcattgccggattcgtcgtcgctttacaaccaatctcctgcttcggtttcttcgtcgacgacttcggaaagctctcgatttctcacttggacctaatcaagtcgggaaggttcaagactaccttgatctcgtccggccgccgctatgtttatcagtttcattgaagaaggtggccgcaccgcagtcatcatctgttttaatctattcagggatgcgtatcaattctcagccgccggcatctgtggcgccggcatcttgttggtatcgtatctcccgacgagatccaattattaatccaaatccgagtcaacttgtcctcgcagccaatcgattggagcaatcatcatgggccagcgtcattagcaattgcatgtaacaagcacataagccaatccggtactttctgtgtgcatgggaaaccagccgaccaatcagaggaagccgtcggcctaaatacagctatgcatgcacatcgatcaatactgctctgcccagaaagattactctacaatttagcgtcaagcgtatacagagcaaaatcatcatcaccaagaccatgaaggcaatggttgaatttcccaagtcaccaagattcatcttgtatttcaaggcagggactatatctacgcacatgcatctcgcatcaagattaccaagtatcgctcgctgcctctgccgccactgactggtgtcctcgcctatacggttggttggtcacaccaccgttcatgggcgtccatgcctccgcctacacggctggcctattatgccgccgctgttgggcgtctacgacttcaccgccggcctgcctccgtcgccgccgactggtgcctccgcctacacggctagcctattatgccgccgctgttgggcatctacgacttcaccgccggcctgcctccgttgccgccgagtggtgccaccgcctacacggctggcctattatgccgccgctgttgggcgtctacgacttcaccgccggcctgcctccgtcgccgccgactggtgcctccgcctacacggctggcccattatgccgccgctgttgggcatctacgacttcaccaccggcctacctccgtcgccgccgagtggtgcctccgcctacacggctggcctattatgccgccgctgttgggcgtctacgacttcaccgccggcctgcctccgtcgccgccgagtggtgt
